United States Patent 10,724,096 (METHODS AND COMPOSITIONS FOR INHIBITING AND TREATING NEUROLOGICAL CONDITIONS) - sequence listing, part 75

SEQ ID NO: 1522 - DNA, 3491044 bp, Homo sapiens (residues 1,745,523-3,491,044 of 3,491,044)
gggttttgtcatgttgtccaggctgatcttgagctcctgatctcaagtgatctgcgtgccttggcctcccaaagtgctgggattacaggtgtgagccactgcgcccagccttaatgtgcatatagtacaaagctcattttttgattaaaaacacaataaatataaaataataataaaagtcaattaacttttattatttgaatttttagcagacacattgcaccttgtactttttaaaaatagcatctactcaactttattttttatgtgttttttttaatacaaaactccggaccttatttttctagtttttccacgaatgctccttttctgttctgggaccctgtgcaagagattccgttgcatttagtctcaggcctccttagcctcctctggtctgtgacagcttttcagtctttccttgtttttcatgaacttgaccattctgaggaggactggtcaggtattttgttgaatgttgctcagtttgggttgtataaagtttttcctagtgatttagactggaataatggatttttaggaggaattgcacagaggtacatgctatcaacatggcctatcactgatgctgaccttgattgtggaattaaagcagtgtctgccaggcctctccactgtccctttccttccttccttccttccttccttccttccttccttccttctttccttctttccttctttctttccttcctttcttccctccctccctccttcccactttctttcctttctttttctttctttctctttctttctcttttctttctttctttctttcttcctttctttccttcttccttccttcctttctctttctttcttttcttctttccttctctctctccctctttctttctttctttctctttctttccttcttccttccttactttctttctttcttttctttctttctttctttctttctttctttctttctttctttctttttctttctttcctctttctttctttccttttcttcctttttctgtcttctttccttctctctctccctctgtctctccctctctctttctttctttcttcctttctgtctctctttctctctctctctctccttctctctttcttttccttttcttttctttgacatggtctcactctgtcacccaggctggagtgcagtggtgtgattctagcaacattatccagttatttttaccttccctggcctcccatcccaaggaaaaaagagccaggaaggccttggctggaagcccttctgggctgcagccttgacctttgggctcaagcaatcctctctcctcagcctcctcagtagttaggactataggtgtgcactaggatgcccagctaatttttttatttttactttttgtagagacaaggtcttgctatgttgcccaagctggtctgaaactcctggcctcaagctgtcctctgcctcagcctcccaaaatgctgggattacaggcatgagccaccgcacctggtcctatttcccttttctagactcaagctatactccatatttattggaagccagttactaagacccgcttacactcaaaaggagtggaatcggtaagtgtggggtgtctacagatattatttaaagttctttgttaggaagacttgcctcttttaccccagtacattaatttattcaatcaatcatttattttatactttgggttttaaccttacactgtgttatttattttgttgctcaaattgttccagctttaatcatagtgagttttgggccttgcattcctgtgataagctgtcccttcctttttttttttttttttttgtttgtttgtttgtttgtttgttggagacagactcttgctctgtcacccaggctggagtgcagtggtgcgatctcggctcactgcaaactctgcctcccaggttcaagcaattctcctgcctcagtttcccgggtagctgggttacaggtgtctgccaccacacccagctaatttttgtatttttagtagagacagggtttcaccatctctactaaagagactaggctggtcttgaactcctgacctcaagtgatccacctgccttggcctcctaaagtgctgggatgatgggcgtgagccactgtgcctggcccgtccccttgtttttttaaagcacgtctttacttttcgtcactacaagatgctgcaggctcatcttgtattttctctgtcccagaccacaaacagccatttctccaaggagccatggttcctggagaataatagtgagaaatgaagactgggatgtggtgacaaactttaattttattgctctgtaagctttcccaagctccccattgggctataaacctcattctgcgtggtggttttgctgtctctctcaccatgttgcctcttgtacatacaatatctagtatttattgaatgaatgaagttcattgaaacaagttttagcttttttcttgattcttttaatattacactaattttacttttgtgtaacgccgtaatctagctagaccaagaaaatgagtcatgcctgattattattattattattattattattattattattattgtttgatgtggggtctcactctgtcacccaggctggagtgcagtggcgcaatcttggctcactacaacctccacctcccgagctcaagcgattctcccaccacagcctccagagtagttgagactacaggcgtgtgccaccacgcctgactaatttttgtgtttttgtagagacagggtttcgccatgttgctaaggctggtcttgaactctcggactcaagtgatcctcctgcctcagcctcccaaagtgctgggattacaggtatgagccaccacacccagcagagtcatgccttattttatctccctgtcattatgaaatgactgatatctcagaaaatgaagacatgaatgcatttgtaatgtattcatggagtatgtcctaccctgcatgcatttcaacagtagtcacccataatcaatgaatatttgtaattcttggttatttgattttattcctggccagaaatttaaaaaggaaagtgtgtagtaggaaaaaaaaaaaaaagcaaattgactgttttttcctactacacttactcaactccatgcacttctgtgaccatatgggtggggttttccttacatgtcagtactcccatgggtaccaactgggtatcctctaattcagttcaattctgacattatatacttggagtcagatcccacaagataaggactcagtcccacaagtctgcttccacctcagatgccaatagcaagtctgggcctctggaactgaccaactggctataaattaggggttcccaccaccctctccctaatgatttgctagagtggctcacagaactcaggaaatcaccatacttaatgtttacccatttattataagggatattacaaaggatacagatgaacagccagatgaaaaagatgaggcacagggcaaggtatggggagaggggctgtggagattccatgtcttctgatatagtgtggttgtgtccccacccaaatctcatcatgaattgtagctcccgtaatccccacgtgttgtgggaaggacctggtgggaggtaattgaaccatgggggcaggtttttcccatgctgtttttgtgatagggaataagtctcatgagatctgatggttttataaaagagagttcccccgcacctgctttcttgcctgccaccatgtaagaatgtgcctttgctcttcctttgccttccgccatgagtgtgatgcctccccagccatgtggaattgtgaatcaactaagcctctttcctttataaattacccagttttgggtatgtctttattagcagtgtaaaaatgaactaatacatcctgtatgggtaagacaccctccatgtgttcagaaacctagaagctcctcaaaccccttgatttttatggaggctttatcacataggtatgattgattattaagtcaatttccagcctctctccccttctcagaggatgggaatggggatggaagttccaagcttctattcttggcttggtctttctggtgaccagcccccacccagaagccccattgagagttcccatattagaacaagagatgctcccatcactcagaaaattgcaagggattaggaactctgtggcaggaaccagggttaaagaccaaatattggaacaaaagatgctcctaacatctctattgcccaggaaattgcaagggatttaggcactatctgccaggaactggagataaagatatatatatttcttattataaatcataatgtcacataaagatacattgttgctctgttcttttctaattcttttccttccatctatttccatatgtcaaaattggaccagtgtcccaaggcctaactaactccaaagccaagtctttccagttgcctttatatctctctgtctaaaatgagatctcccttatctctgaatcccatgagtttgtatttacactgtgatatttacctttttaaaattgtactcatttatatatgtcataatccttctctaacactgtaaattaatttctggcagggctcatatcagattcaacttcttgcctacaaatagcaacaagaaatcaattgtttaaagagaatttgaaatttaaaaaattatattatggctctgtaatagctaatttcagaatggaggaaaaagaacaactaaatcagttgatcagaaggaggggaaactatacaaattatgttctggctataaaattacaagtgattgttatgtagaggatagatagggaagctagtactacagtgaagttccccctttcattctcaaccccttaaatttggtccaaagaaactcaaccaaccaaccaaccaactaaaaaaaagtcgatacatttggtatcgaagaaggtatggtgaaaaggttaaatatatatagttgaagggggaagaatctggtctagaatgataaaagatgcacatacaagaaaatatattaccacgctgtttgcaaaaatgaaaaccagagcattttggaagcgacctgactgtctgtcaacagcaaatgactggataaaatttgatatagctatactatgtgatgttatgtggctattaaaaacaaattagatctctggctatttttccaaagacatgtctgtggtgggctgtaaagtgagaaaaggaaggagcagagacaggagttgagcttgattctagttttgtcaaaatgtcaacttacaggtcagggtaaggacctgtaagggagggaagagaaaacgggagggtaggagaccagccaggctagatagggacaaggttgcatgttctcccacaatgcgtccaggtagcctcttattctgaaaaagacacagtcaccttgccaacggccatgacctgctagtctcattgattctcataggaaagaaacatttgtgcccagagttttaggggatttgaggttccagttggggatttccctgaggagagcgcatgtcatcatgcattttgacgtcatggcatcttgaactttagataaaagagaaccaattcatgttgattttttgttgttgtggcatttaaaaactctgagctttatcttttagaggggtaagatgaaaaggagtgaagatcagccttcccctttttacttaatgggaaagggtttgtagatgatttaaaatgtcacttatttcattgaaatgaatgatacatttattaaagatgttcaaactcaccagtgtcagagatatgtaaattaaagtaacagtgagatatccctctcaggctgggaaaaaaaatggaaaagaccaatctcacctatattgttgatgggaatgagaattatttcagctgtgttttggccacatttattaacataaaatatatagatttttggaaattatataggactggatatataggaaataatataggtaataagacacataaattatatagaataatgataaaatgaacccatttccaacctaagaatgtggtcgtcaccaatactgttgaagccacctgcaagcttctctctagtccactttctctgccttctccgcctttctctagaggtatctactaccctgttctcttgctttgctcttttaaaaatagttaaagagaaatacatatactctttgaccccgtaatccccatcctgggactctatctcgtagacataaaggccatggtacataaggatgtttgtagaaaggatgtttattgcagcactgtttgtagtagccaaagagggagaaacgagtgaatgcccattaatgattgaacaaattacaggacatccacaccatggaattttctgcagctattaaaaaacgatgaattagagcaataccagatgccttggagggatttccatggcatattgtagaatgaggaaatgggagctgcggaagcgtgcataaaatgacaaatgcctatgtattatatactgtgtgtgaatacatatatttgtgtgtgatttatgagtatagagacaaatttggaaggatgtattctaaattgtcaatgaggattaacagaaagaggaagggtggtctgatgtggagggagaatggattaagccaaaagagaagaagaaaaaaacccaaattacctgggcttcatcagataaatggagatcaaaattccatcttattgttgttccagggcttgtaatatggttaggctttgtgtccccacctaaatcaaatctcatcttgaattgtaatccccataatccccacagatcaagggagagaccaggtggaggttattgaatcatgggggtggtttcctccttgctgttctcatgatagtgagtgagttctcacgagatctgatggctttataaggggctcttttcccctcttcgctcaggacttcttcctgccaccttgtgaagaaggtgctttgcttcctttttgctttccgtcatgattgtaagtttcctgaggcctccccagccatgctgaactgtgagtcaattaaacctctttcctttataaattacccagtctcgggccgttctttatagcagtatgaaaatggactaatacagcttgtgtgataatttcactggatgatgtgaaggcttttttgaaaatgttcaaggctctgcccaaatatgtgatggtggaatttattatgatatgcaaatgatacttataatagtgatgtgattttatttatttatttattttttttgagacagggtctcactctgtctctcaggatggagtgcagtggtgcgatcacagctcactgcagtctcaacctcctgggctcaattgatcctcccacctcagcctcttgagcaactgggactacaggcatgcaccaacacacccggctatttttttttttttttttgtattttttgtagtgactgggtccatgttgaccaggctggtcttgaattcatgggctcaggtgatcctcctgtcttagcctcccaaagtgctgggattacagatgtgagccactgcacgtggccagtgatgtgactttgagcaaataattttttattcttctaggtctaataaggttttatccattagacagataataataaccaacctcattaatagctgatatcctttcagatgaactattgaaatcactctgcctggattaaatgtagtcctcaaccatggcaaaattcaaagtatgacctgcttaacctgactgctaaatcctcccctgacccccaccacagtttcccctctgctaacaccttacatcgccatggtacttttgtctaaactcagagatgggaactggcgcattgcttgtaactaacctccagagtttatatggctttcacttttccaatcatgttctgtttctgttttacgatccaatccagggtgccacactgcattttgttggcatgaatcctcagtcatttcttgtctgtgacagtttttcattattttttatagctttttttttttttgagatggtgtcttgttctgtcacccaggctggagtgcagtggtgtgatctcggctcgctgcaacctccgcctcccgggttcaagcaattctcctgccttggcctcctgagtagctgggattacaggcatgcatcaccatgcatggctaatttttatatatttttttagtagagacagggttttgccatgttggccaggctagtcttgaactcctgacctcaggtgatctgcctgctttggcctcccaaagtgctgggattacaggcatgagccaccgcgcccggcctacgttttatggctttgatggtcgagatgtgctggccaggtatcctgtagaaagttccccgatctgggtttgctggatgccttctccagattatgctggagcagtttgtttttgtgtgtgttatccagactaatctcctcttggaataattttgcctatataaatgtgacccgccgggcgtggtggatcacacctgtatcccagcactttgggaggctgaggcaggttaattgcctggactcaggagttcgagaccagcctgggcaacatggcaaaaccccgtctctaagaaaatacaaaaaattagctgggcgcggtggcgcacacctgtagtcccagctacttggggggctgaggtggaggatggcttgactctgggagtttgaggctgcagtgagctgagatcatgccactgcacttcagcctgagtgacagagtaagaccctgtctctaaaaaaataagataaaataaaagaaatgtgaccctagagttgtgtgtgagtgagagagagagagagagagagagagtgtgtgtgtgtgtgtgtgtgtgtgtgtgtgtataagaggcagggtctgtctctgtccccaggctggagtacagtggtgcaatcatagctcactgcaaccttgatctcgtggtatcaagcaatcctcctgcctcagcctcccgagtagctaggactacaggtgtgcaccaccactgctagataattctttttttttctagacgtgtggtttcactatgttgtgcaggctgaaactcctggcttcgagtgatcctcctgcctcagccttccaaagtgctgggattacaggcatgatataccaggcctagcccctagaggtattaaatgggggtattaacttgtctttttattcttcatttaaatgattgcaaatgctatccaatctactcccgagaggcccctcagggagttagtttccattttacagatgaggcagccggacccttctgcatggcagagaggacattccaacccagatgccagtgccagaggctgcccatagctccgctactgttgagctgctaacaaattggtttgtccaagggcatgttcaactgtaaccctccgttcccctttggagaaacttcactatcacctaattaggtaacatggtaactgggcaaccattacttataatagacgtggagttgtaaattattctatttaattaagaactgcacatttcctattaaaggaaagcttatcataggttagtaaatttattgggaacacttaactttagctaattaagctgtttgaactcaaggcgagggcattcattaataaccaagcccaagcagttaagggcaattagtgaaacagctggtctttatctcactgttaaaggatggttaatagagatctttgcagctcttataaacctccccaaagcaatatcttcttcaaaagtttgcattggtaaagaaaatagaagaggaaactaaacataaaagaatggagtgtcggaagcagtctggatctctaggctcatgatgatgccagaaaaaaatgaaatccagaggcatttcctagtggtcctcatctttcctagtggtctgcatttacctgggagagtttgacctcgaagtcagcagtagatgtgttttagctcccccctggaatcttggctgccccaggagcatggggccagggatgggtcctttatatatgcagagattatatgtcctgaaagaaaaatgcaggaatggtaacctctcattcagaaatgcagccaggtagccttagacaaaatgctttttttggatctgcaaacgtctctatgtagaaagtctcacagagtcctcatatgtcttattcagtaatttgtcagatttttttttttttttttttttttggagatagggtctaactccgtcacccaggctggagtgcggtggcgcaatctcaactcatcacaacctcagcctcccaggctgaagcgatcctcccacctcagcctcctgagtagctggtactacgggcatgtgccaccatatcctgctaagttttttgtatttttaataaagacgaagcttcaccatgttgtccaggctggtcttgaactcctgagctcaagcgatcagcctcccaaaatgctaggattacaggcatgagccgccctacccagccagcttgaacttttatttagaaatgttaaaatgtgcatagttattaggattatcttgtgtttcaggaatcaactgtcattatgtatcctgtgattggagggaaatgagtaattcttaccctacctgcaaatagttgtttcttggtcagatggtagggattctggttggggatggtactttcatcactctgccttcagacatgtattgattgcctgttgtatgctgggcactatgctggtatgtgacatcacatgagagcatcaaggagcctgtttagcttgcaatccaatgagagaagaatggacagtaaacaggtgttgtttttgtttattaaaacaaggtaatctttggctgggtgcgatggctcgtgcttgtaatcccagcactttgggaggtggaggtgggaggatggctcaaggccaggagtttgagaccagcctgggaaacatagagagaccccgtctctacctaacagaaaaaattagccaggcatggtggtggcatatccctgaagtcccagctatttgggaggctggggtgggaaaatagcttgagcccaggaggttgaggctgcagtgaactatgattacgccactgcactccagcctgggtgacagagtgagatcctgtatctaagaaacaaaaaaacaaaaaacaaagtaatcatggactatgatcaatgctttgaaggcaaagtggttatccaaattcagcctttcttggttgttgccttgccttataatagtgtctgcttcatatttcctttttagttggctcatattgctttaaacttaaatatatttatttgaaatgaagaccttatattcctacaataagtgggaagccagtatcacttatcagaaatggaaactaatcagaagaataaatacataactattaaaatgaaagctgtcacatgttctcatttatacgtgggagctaaatgatgagaacacatggacacatagaagggaacaacacaccctttcagagggtggagggtgggaggagggagaggatcaggagaaataactaatgagtactaggtactgggtgatgaaatagtcaaacacccgtgacacaagtttacctatgtaacaaacctgcacttatacccctgaatttaaagtaaaagttaaaaaaattcattacctcacatacttagttttggagggttgaagacatttaaaatctactcttttagcaattaataataaaggttttttttttgtttttgtttttgtttttttttttttttttgagagggagtctcacactgttgcctgggctgaagtgcaatagtgtgatcttggctcgctacaacctctgccttctgggttcacgcgattctcctgcctcagcctcccgagtagctgggattacagtcccacaccaccacacctggctaattttttgtatttttagtagagatggggtttcactatgttggccagactggtcttgaactcctgacctcatgatccgcctgcctcggcctcctaaagtgctgggattacaggtgtgtgccaccatgcctggctatttttttcgtgtttttagtagagacggggtttcaccatgttggccaggctagtctcgaacacctgacctcaaatgatctgcctgctttggcctctcaaagtactgggattacaggtgtgagccatcgtgcccagcctaatattaaagttttctttggttttagtaaatgaaaaaaataaaaataaaataaaacctgtcttctgccacctaaaaacagcccaggaagtaccagcagtgtgcatgtcatattttggaaatattggcatgagttgaggggtaactgaggatgccacctgccatgtgtgcatgcatgtgtatgtatataaccacctgaaagtagattacatggtacttcactcttaaataatagtgtgcgttgtctaagaacaggaacttctactacataatcataataccatttcacacctgagaaaatgaacaatagagcctgatattatttaatatatagtccatattcatgctttcctcattggcccaaaaatatttttatagctttcttcttgaacccagatataatcaaggcttacacactgcatttggtcactaggtgtttttagtctaaatctataacaaagtttggtaatcattttctagaaagggccgggtagcaaatatttttggctttgcaggccatatcatctctgttgcagtcacttaactctgctcttttcatacaaaagcagccatggacagtaagtaaacaagtgaacatggctgtattccaataaaacattatttacaaaaacaggtagtgggccagatttggtccacaggataacaccaaactcacttccccttttaaatgaaattggcttaaaatccttccttttaaagttgcagcatgtggcattgacttttgaaaaatctcagccagatgtcttgtagaatgtcccacatttggatttgtccgaagtttcctctgggtgttattgaacttgttcctctctcccctatatttcttctgtcctgaagattagtttcagaggcttgatttgattggggtgaaacatttctggcaagaatccttcaaggtgatgccatatctttcacattgcatcatgccaggaaacatgtatttctttgctccccacttggtgatgccaagtttgagcccttggctagggacataacaccagacctctccattgcaaaggtacatttcccctctggaattagtgcataatatgcaggcttctccctctgtctggaacacgcctctctgtggtcttcctttgggtggctctttctcatcatttgagcccccactcaagcatcagctgccctgagagcaggacattatgcaactgctcttaggtgctctcaaggccctgcatgctgtggccctggccacctccctggagtcatcttggacattctcctctttcctgttgcaggtcagccatgctggccatctttcactgcatggagtgcaccgtgctccctctgtcctatccttgcctggagcacatcactctctgcctcacccggctaaccccttctcacacttctggtattcactagggggtcctatcctgaagggtgtcttcctagactgtcctccccatcccagtttgggcaaaatactgctgtcaaatgttctcaaagtaccacataagtttctttttgtaagggctcatcacaacggaaatttttcatttttaatgtggttattatattagtctcccctaccctccctagaagctgagctccataagggcaagaagcctgcctaattttgttcatccctgtaaatatccaaaacacctagcacagtgcccagcacatagtaggtgctcaataaatatctgttgaataaatgtatgaataatgacttgttgaatggctccaatgggaccctatgctaataggatcctgaagggtcagccctatttagcactcggaatgatctagaccaggaattggcaagctttttctggaaatggccagatagtaaatatttttagctttgtgggccatacattctctcacggaattattcaagttggttgtggtagtgaaagcagccaggggaaatacctaagtgaatggacagagctttgttccaataaaaatttatttacaacaggccaggtgcagtggctcatgcctgtaatcccagcactttgggaggctgaggagggcagatcagttgaggtcaggagttcaagaccagcctggccaacatggtgaaaccccatctctactaacaatacaaaaattagccgggcatggtagcatgcacctgtaatcccaactattcagaaggcggaggcaggagaatcgcttgaatccaggagatggaggttgcagtgaacttaggtcacaccactgcatcccagtctggatgacagagcgagacttcatctcaaaaaaaaaaaaaaaaattacaataggaggcgagccagattggggctgtgggatggagttggccagtccctgatctaggggcattattcctggtttcatcttaattttgcttcatatttattgaattcctgctctgtaacaggcatgattctggattctgggaatatcacagtgagtgagactgacaatatctttggccacatgaagcttactataaatgaatgaatatttgactagagacagacaataaagaagtaaatgaataatatcatttcacacatgatgatgtgttccatgaaaaataattaaactgggtgctggaatgctgaatgactgagttgaagcctaggggctgctcttttaaatagaatggtcaggttaaattaggggcaatttgagcattggtaaaaaggatgtaactgaatgtcgcacactggagaaataaaaacccatgagtcaatagtgtgtctaaagagaaagggagaagtgaaggaggaaagctcttagttagggagctaactaatccttgtaaaaggatcggtagaattaaaaatcatggccaggagtggtggctcgtgcctgtaatcccagcactttgggagactgaagtggatggatcacttgatcctagaagttcaagaccagcctaggaaacatagtgagaccctcattactactactaataaaaaatattatccaggcatagtagcacacacctatagtcccagctatttgggaggctgaggagggaggatcgcttgaacctggggaggctgaggctgcagtgagctgtgatcgtgctactgcattctggcttgggcaacagagagagaccctgtctctaaaaaaaaataataaaataaaaatcatgtttcaagccccattgtaataattgattcatgaccagcctgggcaacatggtgaaacccgtctttactaaaaataaaaaaaattaggtaggcatggtggtgcacacctgtggttccagctactcaggaggctgaggcagaaggatcgctcaagcccaggtggtggaggttgcagtgatccaagatcgtgctgctgtactccagcctgggtgacagggtaagactttgtttcaaatgatactaatactaataataattgattcatgtaagaatcatcttccccaagaaagtacaattgagcaagagaagaatgatgagatgaagccaccaggaagaaagcgtggggaagggtgttgcaggcagagggaggggacagtgcagtccctgtggcttgcttcagagacagcaagaagatctcggttgctggacagaggaggagaatggtcagagatgacagacccagggcatgttgggctttgtaggtcctaaggaggagctaggattttatcctaagtgtggggggaaaccatgacagtctttggaatggaaaggaggtaagatggtttctattttaacatgattctgcctgctactgtggcaggagtaggttggcaatggggtggtcacagtggaagagggagaccagcaaggggacttccaaagtcatctgatgcaagaaatgatgtggtgtcagcagaaggggtgagaagtggttgcagctggcatatacatttgaaggtagaactcccagggtttgaattatatgtggatgggaaggaaagagaggagttgaggatgactccaaggtctcgaggctgaataatctgtgggtgggagccatgttgggggaagaccctcagaggcctcggtttatgaaagaagcctcaacaactgtattatgatggatacatgccctgtgtgagatgcctgttagacatctcagtgacatggagtaggcaggtgtaggaggtacgagcctggagatagttgagagttattggtctatagctgattaaatcacaagaggggataagatcccttagatagaggagacctaggattgggaaaggcattaggggacacagaaggggcagctggttaggtaggaaaaccaggaggatgggaaccctagcaccagttcagaaagaatttcaagaacttagttcccttatttccccttattgtattttttcacccctttaaaactcattttggcctgtagcagtggtaaacaatagctctgacagtagtaacagtaaaggcagccagcatttatacctgttctgtgccacacagatgctaaacaccttacctgctctatctcattgaatcctcactccagctccttgatgtgggctttattattatccctggtctaaactgagcaaagtgaggcccagagaggttgagtgacttgcccaaagtcacacagctcataagtgacagagccagaattagaaccctacatgcctcaaatcttttcccaaaataggttagctataaataaatgtcctgagaagctcctgggaaaagggtagtggttgatgggaggacattcactctggtatttaaggaactgctattcatcagtccagaaacagaatagaggcagacaatacaaaattcctgctcttctgggggagcctcagtatcctcatctgtgaaatggggataataaatatatctacctcatcaactttttgagaggattcaatgtgttaatgcaacaaatctctcagaacagggcctaacatgtagttgacatacgagacatagtcattattgagagactctatggcttcatggttaaggattgggcctcctagtgccaggatgtctgggttcaaatcccaactttgctactccctagctgtgtggcactgggcaaattccttaccctctctgtggcttaatttccccatctgtaaaatgggataatgatagtttgtagctcatatcattatgatgaaggtttactaagctaatattttgaaagggcttgaagtagctggtacatagttctcgtgttttagctgttatcatggggttgggatacagtggggacacaggcaacaagcacgcctgtcagtaaagaaacatgttatcatctgtgagaagaaagcatggtaaataaaaaccctgctggatttccacgtgcgtttccgtgacaggcggcctggattaaagagtcgagaagtcacagcgggaagagctgtcctgttcccagaggcaaatgacagcccacggaaagaaatagcacaaagcttcaggacggggagacggtgtcccgaggaaagagaggaggagcagaggatgctgcgaatcactgtaatattttccctaggaaagtcccaggggttcttgtagaggccttaatctcctattctgggcttcggatgccggtagctccttgctctttgagagctgcgttccctctggcctctgtctgtctctgttagagcctaatcatatttgaaagtagtttttatctgtgattattcatctgtatatgaggagcttatgtgtctaagctgccacttccatcaaatccaagcgcacggccccgttaatacgcacaggcctgacgttggcagggaaagtggtccccacccctagtccaaggagggagattttagagagttacagggggccagctttgggagtggggaggtggaggtagacagtgctggcatcaagacagggagcaaaacaaatatgagagacctaatagcaggaattccagccaggcccgtaaatcgataggtgggcttaccctcaaggcatggcttctcaaactttaataagatggtgtctatgaagattacatattagcttagagaacaatatttcatttttgctggctctttttaatctgcgggagatgatgtgctgggctaggtttaatgctcacacacatatttcagtttaattttctgttaaattgtggtgaggttagagtggagttttttcccctcttcccagggtggggagttctgacatcaggaggcagacagccagcggggaatcaggccaaggacaaagttgggcggccccccgacctacgacaaagacaaaatcatttgattatccttgcttctcctgcggatgtttgtttctttctctctctctcttttttcctacagcattgcgatgtaattcacataccatgcaatttactcatttaaagtgtacaatctgtccaggcacggtgtctcatgcccgtaatcccagcactttgggaggttgaggtgggaggattgcttgagcccaggagttcaagaccagcctgggcaacaaagtgagaccttggctctacaaaaaataaacaaaattagctgggcgttgtggcacatgcccgtggtcccagctacttgggaggttgaggtgggaagatctcttgagcctgggaggttgaggctacactgagccgaattgcaccactgcactccagcctatacgacagagcgggaccctatctcaaacaaacaaacaaagaaacaaacaacaacaacaacaaaaaaaatggaggcttgtgtactgtatgtttacacatttaagcataaaccaatatatgtcatatcctcttaccttggcaaaactccataatgataagattaaaacatacaatagagctaaggtttagctctaatgttactggaagttgacacaatatcaaacatcactcaattaaacccctgttatttttggatattctgttggtggactggctggcaatgtttggatgaataaaagaaaaaagacacatataattcacaaattagatatttcataaaatttctttctctggctttaattttatcaaagtcactaataatgttgcttttgagaccgagtcttactctgtcgcccaggctggcatgatctcggctcactgcaacctctgcctcttgcgttcaagtgattctcctgcctcagccttcagagtagctggaattacaggtgcaagccaccatgcctggctagtttttgtattttgagtagatacggcatttcgccatgttggccaggctggtctcaaactcctgacctccagtgatccacccgccttggcctcccaagttgctgggactacaggcatgagccactgtgcccagccaataatgtttttataatcaagagttctaccaatttgcttctattgacagcaatgatttagtcattacaaaataaaatattattggattaaaactatttggatatattttcaccaagaaagtatatcatagtaaagataaaatggaaaaattaaagttatttttcgtatatgttttcaaaacattattttttctttaggtatttgaaattatttattacaattaaaaggtacaatgaaaattatgttagtattaacaattaaatattaaacaattaaaaaaatgaaagttgaaatttaatttttgaaatttgatttagatcttattacatatttttatttaaaaactattcataattctagttttctatgtctgttcagttgtcagtttcaagagtcattcagtattatggccagatttatgaatatacataattaagagtacattttttttgaaacagggcatcattctgttgccaaggctgaagtgcagtggcacaatcatggctcgttgcagccttgaccctctgagctctatcaatccttctgccttagcctcctgagtagctgagactacaggtgtgcaccaccacgcctggttaatttttgcatttttgtagagatggaatttcatcatgttgcccaaactgttcttgaactcctgggctcaaacaatcctccagcctcggcctcccaaattgctgggattacaggtgtgagccaccgcacctggccatgaattctttctactgcaacattttccgtggccgtaatatgcaactgtcaaaaatgccatactgattctagaaccacaaattagaacacaaagagaagcaagaaacaggcagtcagcactatggggaaatgatgttctgctctgcaagaatctattacccactctatttgagaggaaatatttgacaagttaatttgtccttttctttcctaagtgcttttgtgacccctgcacaccagagcagtacccatctctcctttaggctgtagtactgcacatgaaccttcaaggtgtttgggcacagttgccttttgttttgaggacagagatcaagatctgggaggcagtgcttctctggggcctgaatggtgttatgtattagggtgggtgtttggagtaatcaatgcgttttgtcagggctaggtccaggtcccaggtgactgagtggcccaggacaggagcccctgttgctcaggtctaagggtggccttgcagatgtatgtggggagacagaggttcagagaagaacttcaggactgaaacacctggatagcatctcggaatgcataaaccatccctttggatgcctgtggaaacttctctccatatttcttatctaaatggtgttttctcaacttctgatttgaccattctgtgaataatcctaagggttgaaacttttatgagttaagtggtgataggcttttccattttatttgaggatgcaagcattattttcctaacagacagttttcatctgtgggccaaaagcattgtcacaggtacatattctgaaatattcttatctacagataaagaactcagcacacacggtggtgtttgaataggaaaagtgaaaaacaaaccattcacctcacgtgatcaattttatttgggccattagcagagaatattttgcactagagacttcttacatcaagtaataactgaatgttaagcaaacagatcatcaattattaagatgcagctgctattaacataatcatttacatttcagtaatatcagcatttggagggggttgtaaagctacttaaaagcatctgatgtacaaaataggaatttaaccatgttccctttgctaaaattttttagaggatctagctctaattttccacttaagaatgggtgttgtgattgggagaggtgtaaaatctgatgtagaaatatctgatctctggatacctttttttaattggtgaaactcaggatgacttccttttgtgaacacattttcattcattcattcattcattcattcattcattcattcattcatttaaaagagccagggtcttgctcgtgatccaggcaggagtttagtggtgcaattatcacttactgcagcctcgaactcttgagctcaagcaattctcccacctcagcctcctgagtagctaggacgacagacacataccaccatgactggctagtttttaattttttttgtagagatggggtcttgctctattgcccaggctggtctcaaactcctggcctgaagcaaccctcctgccttggcctcctaaagtgttgggattacaaggcatgagccactgcacctggtctatatttttggaatatagataatacattcatatggctcaaaaagtaaaaagtaaaaaaaaaaaaatacagcgaaaacccttccttctttctctgtcttttttggcctacagtgctccgtccccagaagtaatcactgacgtcatgatcatttttatgtacctgttcagggtttctttgtatatatcagcaaatactaattttgactcatttcacacagttttgagccgtgggtcttttgcttttgtttcttattttccaatatatcctggagattattccaaatcagcacatagagagctccctcattctttatttccagccccatactacctgttgtaggttgtaccatactttatttaaccaatctgctatagagggacattggattttttccaactatttcttaggccaaacacattgtaaggaataaacttgtacttgcatgaggcacgtgcatatacttttacatatatttaggataaatttctagaaatggaatttctgggtcaacttttcatgcatatgtaattctgatagatgttgccaaattatcctccatggtgatagtagccttttgcgattccactagcaataaacgagagtgcctgtttccccaaggctggctcatgttttgaagacctgctcaagtagaggctatctgctcagcaccgacttgcaggggagaatagcattgttttattcgtattctccaattactctgctacttttcactccttgccttttgcttgctgtatgactgtgccttagtttcctcacctgtaagatggggctctaagaatacctacagcctacagtagttgggagagttccaggtgctaatgccaacaaagcactaagcacagttcagacacagtaactgcttaaaaatgctgttattaagagggtcaactacatgacaccacccagagattattgcaactctgcttctcttaggccacagcagacatgaatgtccatgttgtaaaataacaaaggcactgaacattttcttggaagaagaggaattttggttctaggtaaatgtgagccccctctgttgggtgtaattggagaagaggaaattggaggttttgagtggaaaagagtggtaaggaggatagtgaagcagaagcagatatttctgcaatgagccttggaggcggaaaacaaactgatgcctgagagagctttggcactgaaacccctgtctataggaggaggttcctgaactctgtgtgtcacaggtgctgagtgccccaggtattaaccggcctgaagttatcacctggacagctaaggctctagaatctgagtattgaggagactggagacagagctactcacccgggccaagtggaattggcagcatagctttatggttggaggctttttgtctggaatcaggcagccctgagttcaaatgctgcctccatcacttgctagtgggctggcctaggataagttcatgtttctgatcctcactttcctcatcggtcatctgaaggtaaatgccagagtagggggcattcttaagatgcttgtattttcacagggaggctcggggattacaggctggaagagttctaagacacttagcactatgcctggcacatcttaaacacttaataaatgtcagcagctattaaggatatcacatgaataaggttttacaagcgtgctgtttctgggatacaagggggaccctgaggggtgcatgttaacatattcaagttgtaaaaccagaaaagacccatttagatggctgtacagttatagagaggaaaaatgcctctcagcatacatgttatttgcaacaaagcaaaacaaatttgtgagcttcttattgcagatgaagcagagggagagcctgaaaaatttcctgccgtcttgaggcagtaaatagaaaatgggttgtatagtactgattgctgctaatttaagacatataaaaatcactgatggcctctttttgttctccacttttttctctgttatttactaaaggtaaaatagtcacacatttacatacattatctttgtccttgtaactcatttttatgttaaggatatatattccttattctatctctttcacttatttttgttccaacctaccattccctgtaagaatttaatccttgtgcttgggaatgaagtgtacaattctccttgcctagaatgctctaatctgcctgctgctatgcttggcaagctcttagtcctcaaccagctattacctttgcgaagtatttctcaagatcaccagcctcgatggccctttcttctttgattctgtgaggctctttttaatgtttcttttatagcatttttcatactgggctctcattctttgtgtacatatccgtctttccctttatactgggaaaactttgagtcaagagtagcatctctccctctcttccttcatcaaacatgtattaagcgtcagaccctgtgataggatctgtggatacagaaatgaattagacacagcccctggtctggaagggagatctcaagacaatgtgggagcaattaaagaacgaggcactgaggtaaaaccttacataatgctttcgtttagtcttccaaatgaccttagatgcatctgtgaggattcccattttaccattgaaaagcctgagctaaggagaaactataactcatgaaagaacataaggctaccaagtgttcacaattccagcctcaacgtggcccccctggaggaggcaaggcccagcaatgtcatgactgtgaggatttggccagatgaaggagtcaggggaaggaactccaggaagagagacaaggctatgcaaaggcttaggggtgagggagcattgctatttagggaattataaaagtattagtcatctcaggatttccggtgttcacacagtgctcagtacacagtagatgctcactgaatattgtaagaatgcattcctgccgctaaagtccccaaaacttgtaattcaactcaggacccgagtttcttgtgttcctcagtattcttcagtaaattctcatttttgctgaggttctggcttgcatagacccgtggcccaacttggaagagtgtgccctcaaactgtctccattcagcctttcagaaatacagttcagaggcttcctcccccacttctaccctttaaatgtccagggactgtttctacatttggttcagacagactgagcaaaattttggacatagatggacaattgctggatagacagctgatggagtgtcttgactgagaccgtctgtaggctacacagctctggggtatgtgaaaactgcccccagcagatggaagtctgagctcaagaaacaaaaatctaagggaagttgcttttagttcagccataattcctaactcttggatctctttctcatctgctctcctgcccatagacctggggaatactgttttagactggaaggggtggggcagatggagaaactgttctctttcttttgcttttgctgaagacatgttgtcaaggctaggaatgttctttcttttatatgggatgtcagttaatagaaaggactctggagccagactgcatggggtttgaatcccggctctgctacttaccagcttcttgaccttggataagttacttaacatctctgtacctcagcttccctatctgtaaaatgggattaataatagtacctatttcataaggtttttgtgagagtataaaggaattaaaatatttaaagcacttagaacagtacctggaacatcttacgtgcaatatatgtgacgatgatgattgtgataattaaagttactctacacaaactccctcctttcttctggttcatttgtactaaatggtaatgtcccatttagtctcaaagcccaatcaaataggaattagttcttattttctttgaagacatggtgaatttagactctaagttggtaatatcatgtttaagctgtctagcacggtaaaccaagaaaagaaaaacaaaataataagatttcagatgaaaatagttgggctattcacatgaacaaaataccccaggttgtttgagttgatatattactcaaaaccagaagaaacttgatctagtccacttactgaaattttgatgggtaaacggaagcacagagaactgactaatgcagggttatatagggctagacctagaatatacttctcctgatccctgttcatgttccttgcaatgccctgtagccaaaggatgttcactctctgaagcttctcaaatttttttttaatgataagggtcagcaaatgctttctgcaaaaggcctgatagtaaattattctgggttttgttggccatctgtctgttaccaccactcaactctcccattacagtctgaaagcagccatagacagcgtgcaaatgaatggatgtgactgtgttttaataaaattttatttataaaatatgtggtgggccagatttggcccatgggttgtggttgcaaatctctgctctatgatatccccagctgaagtgttaaagggaaataccagagcaataaatgctcttctacatgaaacagaagccattagccaaatgcttaatgtgaagaagtagccagaggaaagagctgtggtgtgtgaagtaatgaggatgattaggcaaaaaccagctttacttttccatcccagctaactcagtttctttttatttataattttctaaaagagggaaaatagagatggaaatttttctacctaaacagtgggattaagagaaaaaattctgtaatgtagttttggttaccatggcattcctggtacaacttgccagaacatccaaataaaaggacaagcttttatctctccctgcaactcaattaattttaatctataagatgagaattatccacttagcttccaagattagcttgctttattagggtatcaaaaaataagcagaaagaaaagaaaatgtgcttgaagatgacttgctttcatttgagaaaatcagtccacagttaattagggcaaaacttagaggctgcagggaggttagcagagtgagatttaatcattgtcagataagtgtacagtcaagaaaacaccatgaaacattctctctgtgaggtgcatagttacctacatcttttggaattgtttatgatggggatgtgtattagttatctgttgctacacgataatcacacccaaacttatcagcttaacacaaaacacatttgttgtctcacaatttccatgatcaaaaatgtaggcacaatttagttaggtgttctgtgtcaagagtctttggataaggctgcaattaaggttgtcaacctggctgaggtttaatttgaaggttctactggggatgaactcccttccaagttcccatggctgttagtagggttcagttcctcaagggttgttgtactgaggccctcagttcttagctggctgttgtctggaggctaccctcagttccttggcatggaggcctctctagtatgtcagcttgcttcatcaaaccatgcaagccaagaagacaatagagtctgctagcaagatggaagttacaatctttttttttttttttttttttttcctctggagacggagtcttgctctgtcgcccaggctggagtgcagtggcccaatctcggcaagtggagtgcaagctccacttcctgggttcacgccattctcctgcctcagcctcccgagtagctgggaatacaggggcccgccaccacgcccagctaattttatttttgtatttttagtagagacagggtttcatcgtgttagccaggatggtctccatctcctgacctcatgatccacccgccctggcctcccaaagtgctgggattacaagcgtgaggcactgtgcccggctggaagttacaatcttacataacttaattatagaagtgacagcccatcattgttgacatattctattgattagaagtaggtcacaggtcctgtccataccaaaaaaaaaaggaaccatgcaaagatacgaaggtgaagaggagaggatgatcgggggacatcttagagtctacctgctacaggaagagagaagtaatgatttcagtgaagtagtaatgagagaaagtacactgtcttgataagaagatctctgaagctgaatttactctgaaggatgttgtgatcattgagtatcatgggccaaagaggagggataacgtgtgcatatatcataccgttgctattcctaactacaaactctggtttctgagaagtttaaactgtagggagaccatttatcctcattaaatctagatgctgggctataacattgggtaaaccgagcccgtgtaacagttgggtctcttttagtgacaagcaacagaaaatccaactcaagtggttaaggaaagagagaatgtattagcttatacagctgaaaactccaagagtaaatttcacttcaggtgtagctgggttcagggcttcagcaaaatattttatttgtttacttttttggttaaggttattgagacgtaacttgggtatggtacccttttcgtacacagtttagtgagttttgataaacgtgcagttgtgtactcaccaacataatcgggatatagaacatttccacaatcccccctccctaatttttttcttgtccctttgtagtcaacttctcctgctaccctcagcccctgacaaccactcatctcttttcagtacctatagttttgcctttttcagaatatcttttaaatggaattaagtagtctagatgtactcataagattatgtgtctggcctctgttactcactatcctgcctttgtgtaggagtcatctgtgtaatcacacctctgatttctttttatcactgagtagcccattgtacagatgtacagtgatttttaaaacctattaaccaattgcaggacatttgatttgttaccatttttggcaactgtgaataaaactactagaaacgtttgtgcatatgttttttatttgtgtgtgtgtgaatgtaagttttcattgttctggtaaacacctagtagggaagttgcttagtgatacagtaaatctgtatttaattttataagaaactaccaatttgttttccaaaatgggttgtaccagtgctgggcacagtggctcacccctgtaatcccagcactttgggaggtagaggtgggtggatcacctgtggccaggagtttgagactagcctggtcaaaacagtgaaaccccatctctactaaaaataataaaataaaataaaataaaataaaagttacttcctattctcaccagtacttgttctcactcaccttttaaggtttattttagctattctaataggtgtgcggtgctatctcaaggtacttttaagttacattttcctgataactaatgatgtcagtcatccttatgtgtttatgtgctatctgtatgtcctccttggggaagtgtccatgcaaatcttttcccattttaataattgtgtacttacctattttgaggataaatgttattcttttttaaaattattattatactttaagttctagggtacatgtgcacaatgtgcaggtttgatacataggtatatatgtgccatgttggtttgctgcacccatgaactcatcatttacattaggtatttctcctaatgctatccctcccccagtcccccaccccccgacaggtcccggtgtgtgatgttcctcgccctgtgtccaagtgttctcattgtctggttcccacctatgagtgagaacatgcagtgtttggttttctgtctttgtgatagtttgctgagaatgatggtttccagcttcatccatgtccctgcaaaggacatgaactcatccttttttatggctgcaaagtgttccatggtgtatatgtgccacattttcttaatccagtcaagactgatggacatttgggttggttccaagtctttgctattgtgagtagtgccgcaataaacatacgtgtgcatgtgtctttatagcagcatgatttatagtcctttgggtatataccctgtaatgggattgctgggtcaaatggtatttctagttctagatccttgaggaatcgccacactgtcttccacaatggttgaactagtttgcactcccaccaacagtgtaaaagcattcctatttttccacatcctctccagcatctgttgtttcctgactttttaatgatcaccattttaactggcatgagatggtatttcattgtggttttgatttacatttctctgatggccagtgaagatgagcattttttcatgtgtctgttggctgcataaatgttttcctttgagaagtgtctgttcatatcctttgcctactttttgatagggttgtttgtttttttcttgtaaatttgtgtgagttctttgtagattctggatattagccctttgtcagatgggtagattgcaaaaattttctcccattctgtaggttgtctgttcactctgatggtagtttcttttgctgtgcagaagctctttaattagatcccatttgtctattttggcttttgttgccactgcttttggtgttttagtcataaagtccttgcccatgcctatgtcctgaatggtattgtctaggttttcttctagggttttcatggttttaggtctaacatttaagtctttaatccatcttgaattaatttttgtataaggcgtaaggaagggatccagtttcagctttccgaacatggctagccagttttcccagaaccatgtattaaatagggaatcctttccccatttcttgtttttgtcaggtttgtcaaagatcagatggttatagatgtgtggtgttatttctgaggactctgttctgttccattggtctatatctctgttttggtaccagtaccatgttttggttactataaccttgtagtgtaaagtcaggtgtgtgatgccttcagctttgttctttttgcttaggattgtcttggctctaaaggctcttttttggttccatatgaactttaaagtagttttttccacttctatgaagaaagtcatttgtagcttgatggggatggcattgaatctataaattaccttgggcagtatggccattttcacgatattgattcttcctatccatgagcatggaatgttctttcatttgtttgtgtcctcttttatttcgttgagcagtggtttgtagttctccttgaagaggtccttcacatcccttgtaagttggattcctaggtattttattctctttgaagcaattgtgaatgggagttcactcatgatttggctctctttctgttcttggtgtacaggaatgcttgtgatttttgcacattgactttgtatcctgagattttgctgaagttgcttatcagcttaaggagattttgggctgagacgatggggttttttaaatatacaatcatgtcatctgcaaacagggtcaatttgacttcctcttttcctaattgaataccctttatttctttctcttgcctgattgccctggccagaacttccaatactgtgttgaataggagtggtgagagagggcatccctgtcttgtgccagttttcaaagggaatgcttccagtttttgcccattcattatgatattggctgtgggtttgtcataaatagctcttattattttgagatatgtcccatcaacacctagtttattgagaggttttagcatgaagggctgttgaattttgtcaaaggccttttctgcatctattgagataatcatgtggtttttgtcattggttctgtttatgtgatggattacgtttattgatttgcgtatgttgaaccagccttgcgtcccagggttgaagccgacttgatcatggtggataagctttttgatgtgctgctggattcggtttgccagtattttattgaggattttcgcatcaatgttcatcagggatattggtctaaaattctcttttttttgttgtgtctctgccaggctttggtatcaggttgatgctggcttcataaaatgagttagggaggattccctctttttctattgattggaatagtttcagaaggaatggtaccagttcctctttgtacctctggtagaaattggctgtgaatctgtctggtcctggactgtttttggttggtaagctattaattattgcctcaatttcagaacctgttattggtctattcagatattcagcttcttcctggtttagccttggaagggtgtatgtgtccaggaatttatccatttcttctagattttctagtttatttgcgtgggggtgtttatagtattctctgatggtaatttgtatttctgtgggatcggtggtgatatcccctttatcattttttattgtgtctatttgattcttctctcttttcttctttattagtcttgctagtggtctatcaattttgttgatcttttcaaaaaaccagctcctggaatcattgatttttttgaagggtttttttgtgtctctatctctttcagttctgctctgatcttagttatttcttgccttctgctagcttttgaatttgtttgctcttgcttctctagttcttttagttgtgatgttagggtgtcatgggagactttaacaccccgctgtcactattagacacatcaacgagacagaaggttaacaaggatatccaggactttaactcagctctgcaccaagcagacctaatagacatctccagaactctccaccccaaatcaacagaatatacatccttctcagtatcacatcccacttattctaaaattgaccacataattggaagtaaagcactcctcagcaaatgtaaaagaacagaaatcaccacaaactatctctcagacacagtgcaatcaaattagaacttaggattaagaaactcactcagaaccgcacaactacctggaaactgaacaacctgctcctgaatgactactgggtaaataactaaatgaaggcagaaataaagatgttctttgaaaccaatgagaacaaagacacaatgtaccagaatctctgggacacattaaaagcagcgtgtagagggaaatttataccactaaatgcccgcaagagaaagcaggaaaaatctaacaggggataaatgttattcttagatagaaccctcataagttgtttgagcaagtagaaacaacaataactagaaactgaggcttattttaaaaaaacctacacagccataaaaaagaatgaaatcatgtcctttgcaacaacatggatgtggctgaaggccattactctaagcaaattaatgcaggaacagaagaccaaataccacatgttctcactcatatgtaagaactaaacattgggtagtcatggacataaagatggcaacaataaacactggggactactgggtgggggagggaggaaggtgagtgttgaaaaactattgggtactatgcttactaccttggtgacgggatcagctgtaccctaaacctcagcattaaacaagatacccatgtaacaaacttgcacatataccccctgaatctaaaataaaagtcgaacttgttaaaaaaaatctaaaacatgtaaatgaacatagagctgcagagacataaaataacataacattagataaaaattgtattattgtttcattattgggctttgagagttttaaaaatatattccagatgtaaatcctttatcagatatgtattttgcaaatacttttatcccagtggcttgcatttttgaaacgtggcttgccttttaatatgttaacagtgtcttttgaggagcagaagtgtaaaatgttgatgaagtccaacttatccattctctcttttatggatgatgcttttcatgttctaactaataaatctttgcctaaatcatggtcataaaaattttattctatgttttcttctagaaattttatagatttagattttacatttagctttttaatccacttagagtttaatttttatataaggtgtttgttgaggtttagttctttattttttttttgcaaatagttatccaattcatcaccatttttgaaaagacaatcctttctctactaaattgcctcacacatttgtttttgttttgagacagagtcttgctctgtcacccaggctggagtgcagtggcattgtttcagttcactgcaacctccgcctcccaggttcaagcaatcctcccacctcagcctcccaaatagctgggactacaggtgcctaccaccacatctggctgatttttgtatttttagtagagatggggttttgccttgttggtcaggctggtatcgaactcctggcctcaagtgatctgcctgccttggcctcccaaagtgctgggattacaggtgtgaaccactgcgtctggccacctcacacatttctgaaacacggttgaccaaacaagcatgggtttccttcggggctttctatcctgacttttcctcagtgttggctccattttcaggaagactctttctcatggtttcaaggtgtctgacagtagctcctgaaacctcatttttcagtttcatgctcagtaaaagatgagcatctgtggcttggtattttccacaaaaatcctgaaattgattctaatccagaatgaatttcagtctgattagatcagtttaggtcatgtgatatggtttggatctgtgcgccacccaaatctcatgttcaattgtaatcccaatgttggaggtggggccaagtgtaaggggatgggatcatggggatggtccttcataatcatttagtaccatctccttggtgcttctctcatgagagtgagtgagttattatgagatctggtcatttaaaattgtgtggcaccttcccatcttttctctatatctagccacataagacataccagcttccccttccccttccgccatgattgaatgtttcctgaggtttcccaagaagcagaagctgctatgcttcctgtacagcctgcagaactgtgagccaattaaacttcttttctttataaattagctagtctcaggtattcatttgtagcagtgtgagaatagactaatatatcatgtgatacacagtgattgtcttggacctgggtcacctcctctacctgtgtgactaggaatggagcctcactcaaatcacacagaccttatatgtagaagaatgaattctcaaagaaaaactagggctctgttagaatgggaaaacatatgatgctgtgggcaaaaaacaatgcaaacaaacaatggcaaccaaacatcccaataaatatccatattgctcttaactcaagaatttcatgtgtaacagggaagaactgcatggaagaacacaaattataatagactgttcgaagtataacaacctaaataagtccaagatatcaatgagggagtaattaaatctatctgcatgttctgggaaggcttcccagatatggcctttgaaatgggtttaaaaatctttttaaaaaatacttaagtaaaatataatctatttaaagaaaagtgcacaagctataaggatatggctcaatatattatcacaatgtgaacatgcttgcataaccagcatctcaaaaatgccagtgtcctcttttctcaaaaagtaacttctatgctgagttttaacacagatactagtttttaccactttaaaaacaatataaatggaatcaagaaatatgaatcaacttgtctttgcttattttgtacgtggttatgagattcatccaggtatttgcatgtagccatagtcagttttcattgctgtgtactattccatcatgtgactatactaccatttatttattcattttattgttgtatatttatgttatttccagtgttttgactattatttaaagtgttgctatgaaaaaatttatatttaatttttggctatatgtaaatatagttggacatacatctagaatataaatttctgagtcatagaattagcatatgttcgaatgtagtagatgctgctaaacagttttctaaagtgcttgtgttaatttaaactcccactagaagcataatgggagttctagttcctctacattgctctcagtgcttgatagtgttagtctttttaaaattttagccattctagtgggtatgtagtggcatctgataatgattttatcttgcatttgccaaagactaatgaggttgaacacctttttatctgcctattggcaatttaggtatccttgttttgtgaagtatctgttgtttgttcaagtctttttttcatttttctgtagttttttgttttgatttagaaattattttgtaatctggtatgaatcccttttcatttacatgttgcaattatctcttcccactataaggcttaccttttcactttttttttttttttaaataagagaagggggtcttgctttgtcatctaggccagaatgcagtggtgtgattatagcttactgcaaccttgaactcctgggctcaagcaatcctcccaactcagcctcctgagtagctgggactacaggcatgtgccaccgcacctggctagtttttaatttttatttttgtagagatgggggtcttgctatgtttcctaggctggccttaaactcctggcctcaaacaatactcttgcttcagcctcccaagtagctgggattacaggcgtgagtcaccatgcccggcccttttcacttttgtaatagtgtggtttttttttttaatacacaagtgttcttaatttcaaaagtttaattttaaaattaaaagtttatcagttgtttgctttatgattagtactctgtgtggcttgtccaagaaatcttttcctccttaaagtaatgaagatagatacactccgatgttatcatctggaagcttgttttaccttctgcatctaaacctacataccatttgggatttggttttaggtatgatgtgaagaagggctcaagttttgtttttttaccatgttttatccagttgacccagcaccattttattgaaaagacttatttcttcactgttctgccattttatcataaatcacatgttaatagatgcaaaggtctatttctggactcaattatcttccattgtttgttttcaagccaacaccactttctttttcttttctttctttcttttttttgagtcggaatctcgccctgttgcccaggttagagtgcagtggcacgatctccgctcactgcaacctccgccttttgggttcaagtgattcccctgcttcagcctcccgagtagctgggattacaggcgcacgccaccacgcccagctaatttttgcatttttagtagagacagggtctcaccatgttggccaggctggtctcgaactcctggcctcaggtgatctgcctgcctcggcttcccaaagtgctgggattacaggcatgagccaccatgcccagccaccagtaccactttcttaatgtctatcattgtaataagtcttaatacctggtagagcgtttccttctactttgtcattctctaagattgtcttggctagtcttgactctgcctttacatataaatttaaaaatcggcttctaatttccaaaacaaacaaacagcacaggctgggaatttgactggagttgtattaaatctgtagatcagtttgcagacaattaatattactacagtgctactacagcatggagtcggagtcccccagtccaggaccttcgtttatcccttcatttacttaggtgtttaaacatttttatcaaaaatatcttagagttttccatgaagcagtcttgcacatattttgctagatttactcctggatatttgatttaaaaatatgattatagatggactttttgtttgctaaacatttattgatatatcaaaatacatttgatgattttgtatttattttgatcaactgggttttgaaatcttgctttctcttgggaagtaggttcatccatgtaccctaatatactctgtaggcctcccccgatgcactgcctatgggactcaaggttgccatattgcacaactccgggggcagcaatgacattgtaatccatgtagtcaggagaggcattatttatatacagtagaatatgatttgtgctctatgcattgtgtaaccttgactgccatgtaagaagtatatgagctgggcacggtggctcatgccttcaatcccaggactttgggaggctgaggcaggcggatcacccaaggtcagaagtttgagaccaacctggctaacatggtgaaaccccgtctctactaaaaatacaaaaattagccgggtatggtggtgcacgcctgtaatcccagctacttgggaggctgaggcaggagaatcacttgaactcaggaggcagaggttgcagtgagccaagattgtgccagtgcactccagcctgggaaacagagcgagactccatgtatattaaaaaaaaagaagtatatgaaaggtggcagatattgatagaattatcattcccatgcttggaaaattgtatttctttagtgactagtctatacctcactagaaggaaagactttttcctcttctagcctgttgtctttgagaaacaaaatagcattgccatatgtgagagctcctcctccttctccatagtctaactcctcctatgaatccaattacacttaaatcacctttggggtccaaagccaatgtagttgattcctgacttagcagggaagaatggaaaaccaatattatccaagaaacagggaagtgggaattgatctggatagcgatgttacacacagctgttcagtttgcacgctgcacgaaggctgctggccataagaataaatttggaggaagaaggctgaaatccagtagcactctgcccaccaagctgtgtgccttggcgtggggctgcatctatactcagggagcactttctcctaattcagctacccagatggggtatcgtttcccattttacacaaaggcaccctttaggccagtggatgccctggcccaggcctcgaagtttgactcatctccaagtcgatcatcagtagctgcatttatcagtttctcttggcacagatttgcagcattgccaggatgctgacaaaatgtttctagagaactccacgccctcttctaccctttctgttagtcttttattgattcttctctcttgtgtttctaagcctgagccaggaaccctcctgttattaaaagcagtcccagttgcccacacctttcatttcctttgaattacattaattgcctgacagctaaaaagtgagctggtattttcagatttcagcggctggtcggcaagaaatatttaccagctcctgcagatttataaagatgccatggagatgcctggagactaacaatcagaaaatacagcagcaaaacaacactatttttcaaggttaaatgctcagaatgctaaaaagaaattgtccataaagcaaaatagggattcagaagcaggcagcctctactctggacaaagaaaggagccagaggtttaaaataagatttcacagcttcacaataattatgaatttaataaggggagctttatttttaatttagtttcagtctggcagccagtctcctccctccaaccccctctctgcggcatggtagtgctctttaatgtggtcctaaggctaggtcacagtgagagctgggaagcgcccccagccataagactttctgatgaagaagaatttagacagataatgtttctgactctctgcaggcagatgggactaactcccactggctttactccctcctggcagccagaaatgtcttttgctatgtaggaagacactaggttctgaaaattccaagacaggaagatttttttcctcctggatagaaccctaggctctgattcctgttctccatgaacagaataataaaaccgagccaaggccactaagaatcattttagactctgctggtcaacaccatctccacttacaaagtctcgtttcatagaccacctttcagtatgagccgtttgccaagaccacatacattcctttgtttattgttcattcattctacaaacatttattgaaggtctattttttgaagtaccctgtgttatagaggttaaattcacatgacaaaattgatcattttaaggtgaacaaattagtggcatttagtaccttcacagtgttatatgaccacctctgcctttttccaaaatagcttcatcacccccaaataaaaacctgtacccattaaacagttactcttcatttttctctttccccagaaaggggtactaccaacctgctttctgcatttgtggatatacctattctggatatttcatatacatggaattatacaccttttatgtcttcttacacttataatacttttgaggttcatccccattgtagcatatattagtttcttatggctaagtaatagttaattgtatgtatgtattataccacaatgtatttatccagtcttccatttatggacatttgagctctttccatcttttggctattgtgaatagagctaccaggatcattcatgtacaagtatttgtttgagtactttttaaaaaatttctctgggatatatgcttaggtcatatagtaagatcaaaaatatttcctgatcttattccctttgttaatggaaatagtctcttcatacatctatggtttcttcaagactgtttctccaaggcagggagctagcttcttccttgaataactttgtcttcagctagataggaggagctcaaaagcaaaatgatagttcctagtggtatatatgctagaccaaaagaggagaaattcagtcactgagggttgccacagaatggtaacaatgagattaataataatggtttgcaggaaagacaccatcttgaaaggatgctgtgaggaattcattagataacacctgatagaaatacacaagatgcactttcctctatctccctttccattcttctgtctgcataaatgactgccctgaattcctttgtagagctatgatttaattattcagagtttggtatccacctaatctgtaaaccctactcgagatatttattttcagcacctgggacagagcccagcatatgacagtcactcaggaagcaattgttgaaagaatgaacaaatgttcatctgcttatgttcattgccagacaaaagaatctgcattttacatcatgtctattgtttactggggaggggcctatgtgacattgcctgtgtgaatttgggaaatgctaagacattttatttttggtgtttaatcttatactcccacatgggccacaggactggtccatcttatggaatatgaaaaaaaatgttcacatttcaggttgttcataaatctgcctcctgcattaccatttcttatctgcctacttctgcttcccctgagttcagaggaagtgctttaccttagaaatgattcactactcctgggccatcgtgggctttgaaagccacacaatagaagttccatttcaaatccccccatttataatcatgggagaaagctgggtgttgtcttgggggttatcaatgatttcagaaaactcaacctttgttcctcatgtgtccatttttcaaaaacttacgactccaaatctctggaagtcattgcatctgaggaaacatttatcttgggtttgacatcttttgcactgtatcccttttcaactctcctttctcatgtaggacaaacggcactgtggggtttgaaatgaagagttatgtcttgcagcaagtgcgtgtgtggagatcctgggctcctccctgccccctcccctgtgcccctgggttggaagatgaaggaataatcagcagagacaaatgcttatgagtgaggttatgggttgaattatatctacccaaatttgtatgtggaaattctatcccccagtacctcagaatgtgaccttctttgaaaataggtttcttggggatataattagtgaagatgaggttgtactggagtaggctggggccctaattcaatatgattgttgtcttcattaaaagagggaatttggagacagacgcacacaaaagaactccacatggagattaaggcagaggtctagaagccaagaaatgccccaaattgccaacaaaccaccaaagctatgagagaggcacgggacggattctttctcacagcccacagaaggaaactatccggccgggcgctgtggctcgcgcctgtaatctcagcactttgcgaggccaaggcgggcggatcacctgaggtcagctcaagaccagcctggccaacatggtgaaaccatgtctctactaaaaatacaaaattagccgggcatggtggcacgcacctgtaatcccagctacttgggaggctgaggcaggagaatcgcttgaacctgggaggtggaggttgcagtgagatcacaccattgcactccagcctgggtgacagaatgagactccgtctcaaaaaaaaaaaaaaaaaaaaaaaaaaaggaacctaccctgccagtactttgatctcagactcctagcctctagaactgtgaaacaatacatttctgttgttcaagtcacctaatttgtggtctttgtttttatagaagtcctaggaaactaatataggtgatactctcacgatgtttgtctaaaggtctctatttacttgagaggtgatatagcatagtggttaaatacttgggtttttagaaccagacacccaggcggataatctgggaaaattactcatcatctctaggcttccaatttccttaaaataagatagagaatataataaatctagacctgatagtactgtcatgacgattaaatgagataatgtatttaaagcactaagccaaagaaatacctggcacatagtaaacacgtgatgggtggtggttattataatggttattattagtaatgaatggcaacatttactgttgccctaaagccccaaagaatcctttactatctatattttaaactttcttcccagagcacacttaagaaatgattgacattttcccttccctctgacccctgctctctaggttaatggtctgaggctctgttccatctttgtccctttccagagatttaatctctctctctctctccctctctctctctctctctctctgtgacatgggacttatatgattgacacacaggaccacccacttatcatttacactagtggaagtaagatggttccaaaagctgggtgaggatttgaagtgaccagaatagttgccaggatcatgtattctttcatatacaaaaaacacatttgttgaaagccagtggtctaggtgtaggatctgatttagtgtgggttatttgtcaatgtgggcaggggaagggatgcagcataataattccataataactaccacttactgaaatgtatgtcaagtgccaggctaaattgtctcagcacaattatcctttaaaattctacaaggttagatagtcctgtcatacccattttatagatgaggaaatggaagcatggagcgattaaggccatagctggttaaagagcagaatcagaagttgaacacattccacagactctagagctcacacttttaactcctgtgagtcactgcctcagcggcaccaggaatccgctgctctcaggtgtatatttgaaaaagattgtgaacaagacagaggaaacctggttacagaattaaatgccagcatgtaaagcaaacatacaatcaaaaccaagctaatgaaaaaacaaaacaaaaccgaatccccaaaacccagaatacaaaaacctgccatgtgttggttactggaggaaaataagtgttttcctaatgtttaaactcagcaactgaccctaagacttgttttaattttgcgattgttttgaagctgctagtctgccaggcatatggtgcaggtaagctttgccaagtcgttcctccgaagcattttattacgataataatcacaaatgtgacctcagtccttttatcctgtttattctctaccgtttcctgtgataagtgctacttctgtactttgccaacctcctccacccgcatttgtttagggaaagaatattaattagtgatattaaggaggctatgggctgaaaatgaaattttcataatggaattccttagactatctttgccctccgaggcatcctctgtttaagcagttcaattgaatatcattattaacatacataataataataattagcattattgcctgcatcagttgttgttcatggaaaactgcaagctcttttctatctattggcctcagttaaaagtgcgaaatagattctcattttatgttttatttccctgtcatttttgctctgctcaactcctatgcttggcagctggaccccttatgaggtccttattggattttttttttttttggaaaaataaagaagtttctttattctcctgtttgaaagaggagtctgtcagaggtggaaaaccttcaataggccaacttttttaatttttaatttttaaagtttttttagaggcagcgtcttgctctgacatccaggctggagtgcattggtactatcatggctcactgctgcctcagacttctgggttcaagcgagcctcctgccttaggccaactttcctgagttgtcttgaagctttatttgtgcaccgtaagccactcaagattttctgcaaaacctctcctggtttctagcatctctctctcccaatccattatctggatacactgagaatcatgtttctaaaaagcaagtctggctttccacctcctttgctgaaaaaccttgataggcttcccattgcgctcaggataaaatccagatttcttatcatgtcttaatgccatgacccttatttcctcatctggctttatctctcctcactccatctccttctgcagtctgatcgtattaaacttgttttggttttgcagagagactgtgccacctcacctcaagctatagcatgtgctgtaaatgaaatgccctctcctccctgattcaggcttcagtgtgggcaccgagtcctaggagctttcctatcttctcaggtccaagggtggtgcctaatgttaatttcagggaggtataagactgcatacgatacgcgcttcttccccaagcactggtaaatgaatggctttgaatattttacatataggtcatagtatgcttctgtttctccccttcttggctgtttggcttagaatagggggcaacaaactttggtctgtgtgccaaaagcaatcagccacctgtttttttaaaacattttttaaaattgagagaaaattcacacaacgtaaagttaaccatttaaaaacatacaattcagtggcatttaggacattcacttttttttttttgagacaattcgactctgtcgcccagattggaatgcagtaatgtgatctcggctcactacagcctcgacatcctgggctcaagcgatcctcccaccttagcctcctgagtagctgggcctataggcatgtgtcaccactcccaactaatttttgtattattaatttatattttattttattttattttattttgaacaaaggtggattgtctccaccttttagtagagtattttgtagagtcagggttttaccatgtggcccaggctggtcttgaactcctgggctcaagcaatccacctgcttcggcctcccaaaatgctgggattgtaggtgtgcgccaccatgcctggccacatttccaatattctgtaaccatcacatctgcttagttccagaacattttcatcactccaaaaagaaagcccataactgttgagcaggtgttctcaattttcttctcctcagtcctcggcaaccaccaagctaccttctgtgtctgtggatttgcctattctggacaatttatatcaatggagagtcatgcattgcatggtcttttattcatttatttattttttgagacggagtctcgctccgtcgcccaggctggagtgcagtggtgcgatctcggctcactgcaacctctgcctcctgggttaagtgattctcctgccttagcctccccagtagtggggattacaggcatgcgccaccacacctagctaatttttgtatttttagtagaggcagggttttgccatgttggtcaggctggtcttgaactcctgacctcaggtgatccacccgactcaacctcccaaagggctgggatcacaggcgtgagccaccatgcccggcctacgttgccttttgtgtctgcttctttcatttagcatattgttctccaggtttatccacctggcagtatgcgtccatacttcctattcatggctgattactattccattggatgcatatgccacattttgtgcatccatttttcagttgattgatctttggattgtctgcaccttttagctactataaatagggctgctgtgaacatttgtgtacaagtttttgtttgaactcctatttgtaattattttcggcccatgcctaagaggggagttgccgggtcatatggcaattctgtgtttaacccttttaggagccaccaaacccagtgcctgttgttgtaaataaagttttattggcacacggtcaaggccattcatttacttctcgtctatgactgcttctgtgcgacaacggcagagtcaagtagttgcaacatacgccatctgcccctaaagcctcaaagattaatttttatggagttttacagaagtttgctgaactttaacttagtacacctgtgttaagcaatgtagcctgcaggccttgaagccagtaacagcactttttcaacaaagatggggtgaatacagaaaaaaaagtttattctccttaacctgacttatacattcctgatactttagaatattttatgtagatctgaggagcctattttgaatatcaaagggtgaggtcaagtcttgtgggaaaagtggtctggaaaattgcctagactctggagtcagactttgtaggttaagtcacgaaacctctctgggcctctgttttctcatcctttaaatggagatgattaggctccccatcttgtaggacggtagagaggattaaatgaaggaaacactggcgaactgcttataatggtgcctggcataaatattaactcttactaggtgaggctcagagatcgcccaggacaaagaaagaaaatggatcaatgagctagtttatctcatgcctttggataaaatactctacacccctcctcttaaaattgtttttgtactgcgatttttatttttgaggtaggatctcactctgtcgcccaggctggagtgcagaggtacttggctcactgccacctctgcctcccatgctccagcaatcctctcacttcaaactcctgagtagctgagagtagcatacatttagcgaattgttttatttttctgtagagacaggtctcactgtgttgcctgggctgggtagcatgattaaaaaaatttttttttgagacagagtctctcgctgtgttgtcccggttggagtgcagtggtacaatctcagctcactgtaacctctgcctcctaggttcaagcaattctcgtgcttcatcctcctgaatagctgggactacaggtgtgcaccaccacatctgactagctttttaaaagatttttagtagagatggggttttgttatgttggtcaggctggtcttgaactcctggccttaaatgacccatctgtcttgacctcccaaacctcccaaagtgctgggattacaggcatgagccactgtgtccagcctgggatagtgtgatttttttttttaatcgtgataaaaatatagggtaatataaaacttaccattttaacctttttttttttttttttttttgagatggagtctcactctgttgccaggctggagtgcagtggtgccatcttgactcactgcaaactccacctcccggtttcaagcgattctcctgcctcagcctcctgagtagcttggattacaggcatgcgccaccatgcccagctaatttttgtatttttagtagagacggggtttcagcatgttggccaggatggtcacaatctcctgacctcatgatccgtccacctcggcctcccaaagtgctggcattacaggcgtgagccactgcgccaggcccattttaaccattttgaagtgtacaattttaagtgtacaattaagtggcattaagtacattcacattgttgggcaaccatcaccaccatccatcttcagacgcttctcatcatctcaaactgaaactctgtccttattaaacaccaattccctatgcctccatttccccatccctgggcaaccactgttctattctctttctctatgaattcagctgctctagatacctcatataagtggaatcatatgatatttgtctttttgtaactggcttatttcactcagcataatatctttaagtttcatccatgttgtaacatgtttcagaatttcttccttttttaaaacacatttttattgtggtaaaacacaaataatataatatttaccattggaaccacttttaagcgtacagttcagtggtattaagtgcattcatattgttgggcaaccatcaccaccatccatctccagaatatttttgtcttagaaaaatgaaatgcaggctgggcatggcggctcatgcctataatctcagcattttgggaggccgaggtgggcagatcacctgagattggaagtttgagaccagcctgaccaacatggagaaaccctgtctctattaaaaataaaaaattagccggctgtggtggcgcatgcctgtaatcccagctactcaggaggctgaggcaggagaatcacttgaactcgggaggtggaggttgtggtgagccgagattgtaccacagcatgggcaacaagagtgaaactccatctcaaaaataataataataataaaatcaaataaaataaaatgcagctgggcacagtggctcatgcctttaatccttgcactttgggaggctgaggcaggaggatcacttgagaccaggaatttgagatcagcctgagcagcatgttgagaatctgtttccaccaagaaaaaaaaaaaaaaattagccaggtgtggtggcacgtgcctgggaacacagagatgaatgcagttggagtggagcaagacaggagaatggtctgagatggtgaagagacacgtgaggccaggctgtgctgacctggtgagatcctgggagaagagtttgcacttcattcctagtgcgatcagaagccaggggagggttggccacaggagagtgacatgatcatcttcactgattgctgttgaaaaagacggttctactctttgaccactggctttgtaaagaggttttcaaggctcagagatggcttgtattgttatattaggagaggtttgatggtagccgacctggtagtggatgttctgtttcaggtgccataaatggggccatacatcaaacccattgattttctacttcagagaccccaagagccatacaaccctaaccctcagtgcccctgcgtaaagttagacagacatcgtttattggggttacagagcagctgtctaaatcctgcctggactcatttaaagcagtgtgcctcgggggcaccttgctcctgcaaacatttcagagccaggaaagactgactggggatgaaggatgcacctgacttcttggcacctgctgctgcatttttgttttgattgtttgcatgatgcttggaggagaagcagggaaaaaagaggccgataggcgtttttctctcacttattgttcttttttctggccttggaaggatggaaggaaggaaggaaggagggaaggaaggaagctaatatctattgaacagcaatgcagggactggatagttatggtcccaagttacctaatttcattcattcattcattcattcattcattccacaagaaatattcattgagtgtctttatatgccagacattgttctgggccccaggaataagcattgaacacaatggacaaagcctcttctctcttggggctgactttctgacaaggaagacaagacagacattaaacaggtaagtacaaatcaggcggatatgtcctaggaggaaaaaccaagctgagtaatgagatggagagagtgtggactattttatgtgggagggggacactggtcagggaagctctctttgcaaaagtggtatctgagcagagaactaaagaaaataagggagagaagcaccagactttctgtggatctaggacattgttatttcttcttagagaagagtctactgagaattggaggaattaagtgactcttccaagatcagaagatagtggtagcagtagcagcagcagtagtagtaatagataaattttattacatttgctctatgccaggcactagatgaaatatttatttctatcatctcatttaattttcacaacaaatctacaaggtagatatcattattgttattcccattatataaatgccaccgaggatcatagaagtgatatcacttagctaaggtcacacagctaataaaggagaagcagagattcaaatccacgttcattagtctccaggacactataaccattttccagcccatagctgatgaagctgaaatacagagtgaagcctctatctgaaaacccttcttttccaatagaccagtccaaatcccaactttcaatgcagtacccggttctttgattagaccctggcatagggtttgttaggtgggtattgagggcctcctaaataatggagtagtgcatttggatctgtgaccacagacattttgagtcccaccatctctgatttgcacagagaccttcttgtgaccaattattgtgagtcaagagctcaggtgtccaatgaaagttcgcagggagctactcttctcttgaaagaaatgggctatagagctctattggcctgggatgtgcagctccattggtccatgatttgatgagaaagactgcaaacgtgtgatccagatatatggatgtgtatatgcctcttagcaagaatgcagttgattttctaggtctatggagctatgcacacagctatagcattcatttactcactcattctgtgctgtgcctgctagtgtgttacattctgagtctgcagcaatgaacaggcaaggtccctgtcttcctgttgaatacattataaggggagaatgagggagtgttgtgtgaagaaggagaaaataaagcggatgaataaatgaacaagatcatctcagatgctgagagtgccctgaggcattgccacagagagacactgggatgtctgcttatattgagtggtcagtggaggcccctctgagcagggccaattgaacagaaggggagggaggagctgccatgagcagttctgcagaaaagcatttcaggtgccagaaacatcccggtaacagacagaagactgggtcaaggggtacgtgccttaaggactgtgataattaggtgggtacacaaagtattttgctgagacttgcaaaaaggaaaccagagggaatgccagcatgaaaaacatgagatttcaagtctgtaactgctaaaagtcacagactctttataacttatgagctctttataacttatgggccgcaggagaacctttgaagaatgtggttcaagagaaggattagctagcagagaagattttaagaaatatgtcttaaaaataattttatgatgggaaattccaaaggtatatgaaagtagaagaatagcacaatgaattctcaggactcactacctggcttcaacaatggacaactcatgcccagttttgcttatacctctacctgttttccccacatacattattttgaagccaattccagtcactaccatttcatctgtaaatattacaatgtgtatcttgaaaagataaactcttaaaaacataggcacaataccatcagtgcacccaaaacattaacaatgattccttagaacatcaactatccagtcaccgttcaggttacttactgcctaatacaattttttctttcttttttatttttattttactttaagttcttgggtacatgtgcagaatgtgcgggtttgttacgtaggtatgcaagtgtcgtggtggtttgctgcacctatcaacccgtcatctaggttttaagcccagcatgcattagatatttgtcctaatgctctccctccccttgacccccaccccccaacaggccccggtatgtgatgttcccctccctgcgtccatgtgttttcattgttcaactcccacttatgagtgagaatatgtggtgtttggttttctgttcctgtgttagtttgctgagaatgatggtttccagcttcatccatgtccctgcaaaggacacgaactcattcttttttatgtctgcatagtatttcatagtgtatatgtgccacattttctttaactagtctatcattgatgggcatttaggttggttccaagtctttgctattgtaaatagtgctgcagtaagctctctcacccaggctgaagtgcagtggcacaatctcggctcactgcaacctctttcccctgggttcaagtcattctcgtgcctcagcctccccagtagctgggattacaggtgcatgccgccacacctggctagtctagtttttgtatttttagtaaagacaaggttttgccatatggtcaggatggtcttgaactcttggcctcaagtgatctgccgcccgccttggcctcccaaagtgctgggattacaggcataagccaccactcccggctctgcctaatacattttaataataatttctttgaatcagaatccaactaaagtcctacacatagtgattggctcatgtgtcttttaatctataggtttccccttcagttcttttattgctggaaaaataggttattcatcttgtgtaattcaaaatgtggtcagtgaaccaggatcatcagcatcacctgggaactcggtagaaatgcagcatctcagatcccatcccagacctcctgggttagaaactacattttcacaaggtccctgggtgttttgtatgcacaattaagtttgagaagcactgctgtagagtcccccgcagtctagacattgccagttgcatctctgtggtgtcctttagtgcattccttcatcttccacttttctttcttttctttctttctttttctttctttctttctttttctcttccttcctttctgtctttctttctttcattcctccctccctccctcccttccttccttccctccttccttctttcttttccttccttccttccttccctccctccctcccctaccctccctccctccctccctccctcccttccttccttccttccttccttccttccttccttccttccttccttccttccttttttcctctctctttctttcttttttgtttgagttggagtctcactctgtcacccatgctggagtgcaatggtgtgatcttcggctcactgcaaccgctgcctcccgggttcaagcaattctcctgcctcagcctcccaagtagctgggattacaggcacccaccaccacgccccgctaatttttgtatttttagtagagacggggtttcaccttattggccaggctggtctcttagccaagctggtttcaaactcctgaccttgtgatccacccacctcagcctcccgaagtgctgggattacaggtgggagccaccgtgcctggcccattgtccacatttctgtaagttgataagttgtatctatacatttttatcagatttaggtctgattttttcttttttttttttttttttttttagcaagaccactttttagattgttatgtttttccatgaggaggtaactgatgtctggttatctcccattgtgtttttattttttaaaattatttttattatttatttatttaatttttgagatggtgtcttgctcagttgcccaggctggagtgcagtggcatgatcatggctcactgcagctttgaccttgcaggctcaagtagtcatcttacctcagcctcctgagtagctggcaccacaggcatgcactaacatacccggttagttttttacaaaactaatttgtagtgatggggtctcactgtgttgcctaggctggtctggaactcctgggctcaagtgatcctcccactttggcctcctaatttgctgggactacaggcatgagctaccatgcccagcctcatttgtgatgttatctatctgctgtatgataatgcctagatccatgaattcattaagggttgcaaaacagagcaaggctttgacttgagtggatccagtttattttggaagtgattaattctctaatttttattcaccatttctataaaattaatggtatattgcaccaattatgtgccaggaactgttctaagggctttacataaatgaatgcatttattgatcctcacaaaaatctttaaaactgtgtattcatttcctattgctgctgtaacaaattgccacaaacttagtggcttggaacaatccaaattattatcttacagtgttggaggtcagaagtcccaaagaggtctcacttggttaatatcaaggcattgacagggctgcattatttctggaggctctggggagaacctttgcctcttccaaattctagagaccacctgcagtccttggcttgtggcctctttctccatattcagagctactagcataacatctttaaatctctctctgattctcttcttcctccctcttccacacttaaggacccttttgattacatcggttctacctgcacaacctcctggttttaaggtcaacattgattccatctgcaactttgattcccttttgctgtagaatctaacatattcataggttccaggaattaggacacagacatctctgaagggacattattctgccagccaccactaggctctttggttcctgttttacagacaaggaaactgagatacatcgaggggaaataactcatccaaattcacacaggtcctaactggtggagcttggatacaaacagagagagtctggctccagagtccatgctttgaacccagcagatgtgagatcacttagtgctcaacactgaatttcctctgagacctcgatcttgccaatgaacatatgtttttaggaacattgaatcctgcggttgtcaggggatttctgcacacaaatgttagccggtgaattcaccgttctttccgatggtaagttagtgtttccctcctaaaaggtggtaacagtgggcttgtccttggttcagtctgtttcttcttaggcccagtcagttacccactgaattaaccccacgctggaccctgacctctttttggtaccatgtacccttttggcatctggcggagtctatgacctccttctgagaacaatatccttttttttttttttttttttttggagaagatatgtttattaatggatgattacattagctttctgggcaacaaacctaaatatgcctactaatattgatcttctattcaactcaaactgaataacataacttgttctcaatataacttactttttttaaagtattattgcatgcccttattttatttaaactgagatcttcttggtgtcagacgtttatctcaacctataggtaaatatgtttacaattataaatctgctagtaaacatattatataacttcttctacttagtaatcttcatattagacaactatagcttaagtatcatcatactagttatactcaaattttccctattgccttaaagattccctttggcagtttgtttgtttaaattaaggcccaaaattcacatatttccttttttatatatataaatctttctaactccaaaacaatatttaaccattagcactttttatttttggtccattcagttttgggaaaatgttatttaggctatgaaatattctatactagatttgattgattgttctttgtaatattgtttaaattatttatctatgcaaaaaataaagtgcatggaattacaaaggaaaccaattatactaaaatatggttatcaaaatataaaaaaactcaccaaatttgtgtcatagtaatatgtgaatctttactaatgcatcaaataacaagatttagtggtgagtctaataactatgtaattccaattagtgatgcacacgtacaatataatgagatgtctgctatgattgtaatgagatatgaaaatatcgtgatttatatcggtgacaaaaatcacagatattgcaaatactactgtggtttgttgcttccatttataatagaaggaaatgctaaattttagttagcaatcagagaaaatgaggcaggtttatggaccctctgaattctacccacaaacctcaagttgggagccctggcctagtaccccattggtttgtgctgcttatttagtatttctctctctctctctctctcttttttttttttttttttggagacaaagtctcactctgtcacccaggctgaagtgcagtggcacgatcagagctggctgcaacctctgcttcccgggctcaagcaatcctcccacctcagcccactaagtggcagggactacaggcatgagtcaccacgcccaactaatttttgtaattttttgtagagatggggtttcaccatgttgcccaggctagtctcaaactcctgagctcaagcagtccacccgcctcagcctctcaaagtgctaggattccaggtgtgagccactgcaccgggcctgtttcgtgtttctcttaatttgatagactctagcaaatacctgttgagaccccactgtgggcaaggcatgtgctagggacttgggagagagcactgaacacacagagctggccttcaaggaacagatagatttcttttaagattttcccgccttccttctggggggagagtgtcttcacccttcagtgtaattgcaaactccttgaaggctgggagtggttctaagtcccttctcttgtcaggcctcagatgataggcattgaagaaacaggaggttcaaagatcaatgtttacacaaaacgattttcggtcgttcatggaaaaaaacattttattatttaacagttaaacatttatgttaatgcagataagaaaatatatagaactcagctgggtgtgatggctcacacctgtaatcttagcactttgggaggccgaggtgggagaattgcttgagtccaggtgttccggaccagcctgggcaatatagcaagaccctatctcttaaaaaaataaaagaaaacatatagaactagccatcttaatacataatatgggttattattgcctaggatgaggacttttcttctttttataactgtgctgaaaaggacatgacattgtacttaccatcttcaccattttataatgtacagttcagttgtgttaagtgtattcacgttgtgcaatagatctgtagaagtatttcatcttgcaaaacggaaactctagacccattaaacactaaatacctccagcccttggcaaccgtgattctactttctgtttctaggagtttgactacttgagatacctcattggagtggaattgttcggtatttgtccttttgtgactggcttatcacataaagtcgtcgaggtttgtctatggtgcagcaccccacaagatttccctctctctctcttttttttttttttttttttaaagacagggtctcacgctgtcacccaggctggagtgcagtggcatcatctcggttcactgcaacttctgctccctcgactcaagtgatactcccacctcagcctcctgagtagctggtactataggcacacaccaccatgcctggctttttttttttttttggcatttggcagtttgtttgtacattgaaatacaagatctctgaagcttttgtagctataaatgtttctaaatgatgcaacacatggtctcgccatgttgcccaggctggtctcaaactcctgagctccagcaattggcccgcctcagcctcccaaagtgctgggattacaggcgtgagccactgtgcctggccaaatatccctctttttaaaggctgaataacattccatcgtacgtagatatcagattttcgttatcccttcatttgccaatgggcatttgggttgctttcacctcttgattattgtgaataaccctgcaatgaacatgggtgtgcaaatatttctttgaaatcctgctttcaaatttttgggatatatacccagaaatggaatttctggatcatatggtatttctatttttaactttttgaggagtttccataccgttttcctgtagcaactgcaccattttcattcccaccaactgtgcacaaaagttccaattcttcacgtcctcgccaacacttgttattttctgtttttttttttaattgtggccatcataatgggtgtgaggtgatatgagatgaggatatttcaagataatattaagtaaataatagtagaggtgttcaatagaaatggcaaaaatgaagatgtaccaatgcatgaagtttggaaacctcttttttttttttttttggacagtctctgtcactcaggctggagtgcagtggcacgatcttggctcactgcaacctctgcctcccaggttcaagcgattctccagcctcccaagtagctgggattacggacacctgccaccatgtccagctaatttttgcatttttagtagagatgtggtttcacattgttggccaggctggtctcgaactcctgacctcaagtgatctgcccgcctcggcctcccaaaagtgatgggattagaggtgtgagctatcatgcccaacctggaaaactcttgatcagacaacttctaaagctgcccaaagtgtggtctgtggtcagtaatggcctgagaactgttccttgtctgagaccagataagacagaacttgagggtacctgtttagaaggatagcaatttaacattcctaaaacatctgaatgcatgatcgttattctagtaatttgcttttattgtattttatgaacgtattggcccacgatggattggcaaacaaaagaagacaaagcaaagctggccctgcagccctgacagtctgagaagctctacagttccgcccaggcttggcaacataactactgaacttattttggcctcagattttccatctataaaatgaggataagaaaaggaaagctcagtcttcattttattttatttttgagacagagtctggctctgttgctcagggtggatcatgcagtggcgcgatcttggctcactaccacctccacctcctgggttcaagcgattctcgtgcctcagcctcctgagtagctgggattacagtcttgtgccaccatgcccggctaatttttgcacttttagtagagatgtggtttcaccatgttggccaggctggtcttgaactcctgacctcaagtgatccgcccacctggagctcccaaagtgctgggattacaggcgtgagccactgtgcccggccgggagcccagtcttgatcgttgtcagctagtagctggcctggtactactgctaggctgtggtgttccctacttaagcaatttcataggatggtcacactggaagatgtcatgctgaccatgatgaaacaagacaaaaacaagacagtctgtaatgaatcctatctgagcatgaaagtatgagcagtgggcaaaccacaaaaaaatggccaaacgcatcctctccttctgactgacacatgcagttactgctggttttccaatgacagctttagccccactctattcctcctgcctcctacataaaaattatgatgatgcccagccatggaattaacactgctttctgccagctaaccagaagcgccccaacacactcttactgggacacagctcccactccccatggtgtgtggtcttccttgttgcaacaggttactaaacccatttctgttcaactacaggtgtgtttctggtggcttctggctgatgagcatgacaggaataataatagatggctataggtttaaatgagttcatgcatgcaatatgcttagaatgatgcctggctccaagtaaggtctattaaaatgttagatattattattattgttattattattcggaatagcgtcttgctgtgttgcccaggctggagtgcagtggtgtgatcatggctcactgtagcctcaacctcctggggtcaagcaatcctcccactttagcctcctgagtaggtgggagtacaggtgtgaggcaccattacaggcctattattattaataatattatctttgtccctcacagtgatgggcaccacatcttgccatagaaagaccccatacttgctgggcacattggctcatgcctgtaattccagcgtgtttagaggcctaggcgggagtattacttgagcccaggaggttgagaccaacctgggcaacacaatgagatctagtctctacaaaaattaaaaaatcagccagctgcggtggtgcaaatctgtggtcccagctactggggagggtgaggtgggaagattgcttgagcccaggaagttgaggtttcagtgagctgtaactgtgccactacactccagtctgtgtgacagagcgagaccctgtctcaaaaaattgaaagacacaccccacacttgtggggacaccaaatttgtggattgatttgggatagtgtattcatcatctattgttgtgtaaaaagttaccccaaatgcagtagctgaaaacaataaatacctattatctcacagcttctacgggtcaggaacccaggagcagcttagctgggtggttctgactcaggatctctcatgaggctgcaagtcaggctgttggctagagctgctgtcacactgggactcaaccagaggagactctgctccgaagttccttcacatgggggctgtgcctccccatgcgaacctcgccattgatggcctgaatgtctctgcaacatggcagctggttcccgagagagagagagagagagagagagagagagagggagagagcaagcacaaccctattctattcatgatgcagactagccctggtctgtgcatggtgggggatgccacacaaggggatgaatacctggaggcaagaataattgggaccatcttgcaggttgggccatagagggcctccctgttcctccaagtgccctccaacttttccctcttggcttcaacttttttttttgtttgtttgtttgtttttgagacagagtctcactctgtcacccaggctgcagtgcagtggtgtgatctcggctcactgcaacttccacctcccgagatcaagggattctcctgcctcagcctcccgagtagctgggactacaggcgcccgccacaccatgttgggctaattttttgtatttttaatagagatggggtttcaccgtgttagccaggatggtctcgatctcctgaccttgtgatctgcccacctcagcctcccaaagttttgagattacaggcatgagccaccgcacccagccgggcttcaactttaatttagaccaagaagacatctccattctctctgaatggagcttgaagacaaacaaacaagaaatgagtgtgagtatagctggggtgggatggggcctacaggtattggagaggcagaaatctcgtcctgtctgttgacatttgtcaaggcctctgcagggacaggctcctgggagactctgcagtcagctgcacttccagagggagaagaggcatacgctttctctctctctctctcctcttttcttcctctctccctcctccctgcagcaagagtcttgaatccctctgactgacagtgtcagattgtcttatcaaaacacgggtccgggactacactgtgattggctgtgcagaaccattgtggggctggagaattcttctccgagggaaatgattataaggcattttaagaacagcaagctgaatgctacgcacagctggcagttcttgtttttgacaagtaataattgcctcaggtgcaatggaaagtgggggtggggggctctgtgagtttattttgagaggaggctcagtgcacaggggttgggcattggacaaggaggggtgagtgggagcaacttggctcagggggtctcagactgactcgatctgaggctgagggagcatctggggtggccctgagtgacagtatgtttccttctgtgcccctgggaacacctcttgccatctgagtggggagacagggggtgacttgtgattgtaggaaggcccagatgttctgagcaaactgacccaaagcagcatctgtcctgcatgggggcctggccctgtgagggtgatgcacgagcggcttttgtgcttagagagccctggaaccactgtatgccttgctagacacttgctactcaaagtgtagtgcctgggccagcagcatcagcaccagcctgggagctcataagaaaagcagaggctcaggtccccctcagggacctacagaatccaaatctgcattttgatttttgtttttgtcttttgttttgaatttttttttttttgaggcagggtttcactctgtcatccaggctggaattctggggtgcaatcatggcgcactgcaacctcgaactcctgggctcaagcaatcctcccacgtcagcctcccgagctgacatgcctagctaattttttttttttgagacgaagtttcactcttgttggccgggctggagtgcaatggcatgatcttggctcactgcaacctctgcctcccaggttcaagctattctcatgcctcagcctccagagtagctgggattacaggcctgtgccactgtgcccggcgaattgttgtatttttagtagagagggggtttcaccatgttggccaggctggtctcgaactcctacctcacgtgatccactcgcctctgcctcccaaagtgttgggattacaggcatgagccactgcacccattatatatttttttaagcttcaaaaaagaaaatgggcactgccatggaaaggagaagctggattgtatgccaggcagtcaaaaagccaactgtttttgatgattggagtgctggttacagagggagctcattttcttttttaaaaatatatttaaaaatgttttataaggccgagatgggcagatcacctgaggtcaggagttttagaccattctggccaacatagtgaaaccctgtctctgccaaaaatacaaaaattagctgggcgtggtggcaggtgcctgtaatcccagctactcgggaggctgagccaggagaatcgctggaacccgggaggcagaggttgcagtgagccgaggtcgtaccactgcactccagcctgggcaacagagtgagactgtctcaaaaaaaaaaaaaattatagatttagggggtacaagcgaagatttcttacatgcctattctgggattttagggtaaacatcacccgaatagtgaacattgtatccaataggtaatttttcacttctcattcccctcccgctctcctaccttttggagtctccagtgtctagtctattattccgctctatatgtccatgtgtaccctttgtttggggctcattttcttttctttttaaataaccttcatttaaaaaaagttaatatgtgcattatcggaaactgaaaaacacaagaagcaaagaacaaaatcatctacaatcacaagcagtggaactcatctttttttttgtttttttttttttgttttttttttttgagatggagtctcactctgttgcccaggctggagtgcagtggtgtgatcttggctcactgcaacctctgcctccctggttcatgccattctcctggctcagcctcccgagtagctgggattacaagtgcccaccactatgcccaactaatttttgtatttttagtagacactgggtttcaccatgttggccaggctggtctcaaactcctgacctcaagtgatccgcctgcctcggccttccaaagtgccagattacaggcgcaagccaccgtgcctggcccagaacacattctctttatgtgattttgtgtcaatgtggagagatattcaacaaggacatggagtctgtcagactttgcattgccccatttcctgtatactagtttgatgcttgctctatgcagatgtcttggctcatgaaggcccatgtacattctggaagacggtcatggagccagggaccaagtcctgtggctgagaggataaaggactctgtcccagtctggaactgatcacctcagagtaacatgatggggtagtccatggactttcacgtcagaccaagctgggtgtaaagccaggagctgccactcagcagctgtgtcacctcagggaggatgctgtgccctccccttcccccagagaatggcctctgcccggcctgccttggtgagcacaggagctcatggattaagatgtgtaacatgctcagcatggggcttggcacattacagtcagtgctgaataaaggctaggcattaatatgatgttgataaattgttttattttatatgatttaaagataagctttgaggtgatgccgggggagagcgtggatgggaaatttgatagtttcaggagtttgaagaaggcacttctagaagagattggtgatgaaaacagcaaggtctacagagctcttatggaggtttctttttctttctttcttctttttttttaactgagatggagtctcgctgtgtcgcccaggctggagtgcagtggcgtgatctcggctcactgcaacctttgccacccaggttcaagcgattctcgtgccactgcctcccaagtagctgggactacaggcgcacgccatcatgccggctaatttttttgtatttttagtagagacggggtttcgccatgttggccaggctagtctcgagctcctgacctcatgtgatccacctgcctcagcctcctaaagtgctgggattacaggcgtgagccaccatgccccacctccttatgaggtttctatgtggttcttcactgagttccaggacactcttccctggccagcagtaaatcaggaagacagcagtccttagagctgaggtggtaacacaggatgtttgcaaaagggttgaatatttcaggagaaaatagctaatcttgtctttaaaaaaatcagccaattaaccaacaaaccatgtgacctcagataaatattgtttcctatccagctcaatttcctcatctctaaaatgagagagtgtatcctttattccctccatgccaggaactaactgagaagtagagctagctatttgataatcatcaaactaagagctttcttctggtgcacctgcgctggagaacacccacataaaacgatagtaactgtgacgtgccgtgaagaaaatgtgctgtgacaaccagagcagatctgagtgggacagggagctcaagatataacatttaagctctgatctgaagaagtagctggaggtgagtgcattcagcatatgcaaagatcctgtggcaggctggaggaactgaaagaaagtcaatgtggctggagggagagcaggtgcaaaccctcctacatcaaaccttgtgagccctatgaaagattgcacatgttgtccaaagattgaagggttttaaacaggatgttaatattagcatattagcaggagctcactctggcagcagggtggagaggggatggatctctccttttttggaaaggatcacattgtaacccttctcttgccaaattctctttccctcatatgggctgcttttgtttgtgagatgaagagcaagaacagagtagtggtagatgagggctgctagcagctctaccagaatggcaggacatttgagagctgaatggagaatgggtgtaattaaaagaaaaaaggtggaaagacctggcttgatttctcttgccaggaatgattgtactacacattcccgctttaacaccgattttctgtgaaaggtatattagtccctaggctgagttctccgcccaggggcggtacaagaatgtgagaagcaaatactctctccaggagataaaattctaggggactttttatgttatgtctcaggtcccttgacatgaattggctttgtccagccgtcagacaaaaacccaatgcaactgttaatttgtggtggccttggatgatgggtgaaagtattagtctgtagcttaaaacctcaacagcgtgtccttcctcctccaaagtggtaattaaacacggtcagatgtgactcttgccaggctgtttagttgtgctgggcaaggtctctgaattagagatgatgactgtaaaatgtttgtgggttgaaagtcctctcttgggtatacagaaaagatatagagagagtagagaattgtgttctagttatgagtcattcatccaacaaatatttattgagcattgtcccggatacgattggtttcccacctggatcccacttaggagtctaaggcagctgccagggaattgtgctcagctgatggtgctgaggaatgcctgggaggttacattttgcaccctccccaggggcagccccctgccaatggagaggccatatgtaaagctggccccttgatacaggctggataattctgtgatggcttcatgccccagagctccttgtggagttggtctgagaataggctcctgctgaatctatatactttccttttctatctcacttccctcactccctttctcctgagggtgtcagaagtattcaaacgagagtgactccatcttaatatgagctgggtgaaatgaagctgagatttgctgggccgcattcccaggaagttaggtatccttagtcacaggaagaggttggaggtcagcaggacaagatacaagtcataaagaccctgccgatggccgggcgctgcggcttccacctgtaatcccagcactttgggaggctgaggtgggtgtatcacctgaggtcagcaggtcaagaccagctagttcaatactagcgtgaccaacatggtgaaaccccatctctactaaaaatacaaaaatcagctgggcgtggtggcgagcgcctgtaatcccagctctttgggaggctgaggcaagagaatcacttgaacgagggaggcggaggttgcagtgagcagagatcatgccactgcactccagcccgggcgacagagtgagactctgtctcaaaaataaataaataaaagaccctgctgataaaacgggattcaataaagaagccagtcaaaacccacccaaaccaacatggtgacgatagtgacctcttgttatccttgctgctaattatatgctaattataatgcattagcatgctaaaagacactcccactagtgccatgacagtttacaaatgccatggcaacgtccagaaattaccctatatgctctaagaggaagaggaaccctcagttccaggaattcctggcccctttcctagcaaactcatgaataatccatccctggtttagcatatgattaagaaataaccataaaaatagccaactagcagcccttggggctgctctgcccatggagcagccattcttttattccttttctttttaaataaacttgcttttactttactctgtggactcgccctgaattctttcttgcatgagatccaagaatgctctcttggggtctagattgggacccctttccggtaacaagaacactccctcaataaagcagggcataagtccctgtttcaggctttgctcctgcagaacctgcctaagacctgctgtgtgttgggcactgtgtctatgccttggagatagagtgttaaacccttcgagcaaagtctctgccccaaggcagctcagtgccttctagggggtctgattttccatatcctagtcttgtaatttgttttttcttttttctttttctgagacggagtcttgctctgccacccaggctggagtgcagtggcgtgatctcaactcactgcaacctctgcctcccgggttcaagcgattctcctgtctcagcctcccgagtagctgggactacagctgcatgccaccatgcccggctaattttttgtattttttttagcagagacggggtttcactgtgttagccaggatggtcttgatctcctgaccttgtgatccacctgccttggcctcctaaagtgctgggattacaagcatgagccaccacacccggcccctagtcttgtaattttgagaagtcgctggagctatgcgagcctcaaatttcttatcaatcgaatggtggtaacagtgcttgtctttacttttttccttctattttttagtcttgcactgtcacccaggctggagtgcactggcatgattccaccatactgcagccttgaactcctaggctcaagtgatcctctgacctcagcctctggagtagctgggactataggtacattctaccatacctggctaatttaagaaaaaaaaaatttttttttagacccaaggttttactattttgctcaggctgatctcgaactctggcctcagtggatcctcctgcctcggcctcttgaagtgttgggattacaaatgtaagccagggcacccaaccaatgctttccttttctgaaaagaccaagcaacagcagcagcaggatggtttaagccttcttaagcatctgtcagctgcccttccccatcaccacttccagatgacagccttgtcttctatttctagctaggttgctgctgctatacatggaaattctggatcctccattttaggaccatgaattgatagaaaactggctctcatgctgctacctaggtgtttgttgaatgaatgaatgttgaatatgattaacaacagtgctatcattcaagcagcccaggtactggaataagcactttattgcttcttttttaaaatttttttatagagaaggaaatggaggcattgaaataccaagacatactgaatatgagagcaattcaacaactatgtaaagcacatatacagatgtaaaatgttagaagacaggactttggatggaaggattaatttgcagcactgatgtttcctaagaaaatggtcagaagaaatttcttttggaatgttctttgttttttcttttttgttgtttgtttttgtttttttctgagacagagtttccctcttgtcacccaggccggagggcaatggtgcgatctcagctcactgcaacctccgcctcccgggttcaagtgattcccctgtctcagccctcctagtagctaggattacaggcacccaccaccatgtccagctaattttttgtatttttagtagaggcgggggtttcaccacgttggccaggctggtctcgaactcctgacctcgggtgatccacccgcctcagcctcccaaagtgctgggattacaggcgtgagccaccatgcccggcctggaatgtttttctataacttgttcctttttcagttcacatgtggacaacccttttaacccattgttcaaggtcatggagattgtttttgaaacttgaaaccaaacacttacagatggctcccccaaaggatagagaaaaggaaacgagaaacaagaaaatcacaaccacctgctattataaaaggagcccgcatgatgaagtttttagaattgtggatctgtacttctgctactgcttaggttttagtggaggcaaaataatgccaatagctaatttgtttggtcattaagctttgatagaacttcagtctaagggacatacaattatattaatgtacatgctccagagtccctggttttatgatctgtggattatttatcattgtttcaggatagcagtagtttactttggtttcatgatttttttaacattggttctggaatccaagagacttggtaggattctttgtttttgtctttccttaatattattatcatcatttttttctttttttttcttcatttgagacagtgtcccgctctgttgcccaggctggagtgcaagtggcataatcatagctcattgcaaccttgacctcccaggctcaagcgatcctcccacttcagcctcccaagtagccgggactacaggtgcatgccaccatgccttgctaatttttaaaattttttgtagacatggagatctccctatgttgcccaggttggtctcgaacttttgggcacaagagatcctccttccttggcctcccgaagtactggagctacaggcgagagccaacatgcctgacctgttatcatttttttattttatttttcttggctctgccatttactgtgtgaatttgggcgaattactcactttttaaaattttttctccccttcccttcccttcccttcccttcccttccctcccctcccctcccctccctttgtgcctccctgcctacctttcctctctctttcttttcaatagagatggggtctcactttgctgtccaggcttaccctgaactcctggactcaagtgattctccttcctcagcttcccaaatagctgggactacaggtgcatgccaccatgtctagctaatgtatttgtttttgattatggcataacaaagcacccaaaaacttagtagcttaaaacaacacgcagtttctaggggtcaggcatccaggtacagcttaactgggacctctactcagaggctctcacaggctgcaatcacggtgcccacaaggctgcagttatctcaagattcaacttggagaggctctgcttccaggctcatgtggtcattggcagaattcagttccttgagagttgttgggctgagggcctcctttcattgctggctgctggccagaagctgccctgtttcctgctagatggttctccctgacaacagggaagcttgttccatcaaagcaagcttgtgagaaaatatctctatctctgcctttatctatctatatgtctatatctacatagagaaagaagacagaactcacaggttttttttttttttttttttaacggttatggacagaattgcagccatctcccaatctcccaaatccacatgttgaagttctcactcccaatgtgcctgtatttggagacagggccctttcagagatacttaaaataagccaggttataagggtggggccctaatctgataggacctgtgtccttacaagaagaggaagaaacatgataggaaagaccatgtgagaacacagtgagaaggtggccgtctgcaaggcaggaagagagccctcaccagaaaccaaccctgctgtcctaccttgatcttggacttctaccctccagaactgtgagaaaataagtgcctgttgtttaatctcccagtctgtgatattttgttttggcagcctgagctgcctaatatgataacctgatcttggaagtgacatctcaccacttttgccagttctattccttagaagcaagtcatcaggttcagcccacactctagggaggaggttccacaagggcataaatacgagaatgagagggttggaagccacttagaggctgcctatcacgggcactgctgtctcttcctaagatggctaaaatataataatatttaacatttatctagcatttgcagttagtatatactaaacacggatgattcattaattctctcaacaaatgtgtgtgtgaggtattataattattccaattttacagacggggagaccgagtctcagaaaggtcaagtaatgtgcccagggtcacataacaagtaaaggacaggactgctatctgaacataagtaactcgctcagaggtctcaccctcccactcttgttttcctccaatctgctaccaacacaatagccagagcatttgctctgtcacccaggctggagtgcagtggtgtgatctcagcccactgcaacctccgcctcccaggttcaaactattctcatgccccagcctccttagtagctgggattacaggtgtgtgccaccacacccagctaatttttgtatatttagtggagacagggtttcaccatgttggttaggctggtctcgaactcctggcctcaagtgatccacccaccttggcctcccaaagtgctggggttacaggcatgagccactgcacctggcccagagcattcatttaaatcagacatgccatctcatttaaaaccctccaatcctattccactttaaataagttccaaatccccctactatgatgctgtgggctgaattatgtatccctcaccctaaccccctccaaattctaagtcctaaccctcattgtttccttccaaatcctaccttctttagagttagggcctctgtggaggtacttatgttaaaatgatttcatttgactgggccttaatccgatatgactggcatccttataagaaaggcatacaccgacacaagcagaaggcagaccacgtgaagacatagggaaaagtcagcattctacaaaccaaagagagcagcccagaacagatccttgtctcacagccctcagaaggaaccaaccctgctgacaccttgatcttcaacttctagcctttgaactgcaagaaaatacatttcagtcactttaagccaccctgccagcggcactttgtgtggcagctcgaggaagcagatgcctgccacttgctcctggctcacctaagccatggcagcctcctttcacttctttgcaaatactcttccatcttagggcctttgcatgtgtgttttttttctgcctagaacatttttttcttcttgttttgagacagagtcttactctgtcactcacgctggagtgcagtgacgtgatcatagctcactgcagcctcaacctccctgggctcaagtgattctcctacctcagcctcctgacgagctaggactacaggcatgtgccaccactcccagctaatttttttttttttttttttgagacggagtcttgctttgttgcccaggctggagtgcagtggcgtgatctctgctcactgtaacctctgcctcctgggttcaagctattctcctgcgtcagcctcctgagtagctgggactacaggcatgtgccactacgcctggctaattttttgtatttttagtagagatgggtttcaccatattagccaggatggtatccatctcctgacctcgtgatccacctgcctcggcctcccagctaactttttttgtagagacagggtcttgctatgttgctcgggctggtctcaaattcctgggctcaggagatcctcctaccttggcttcccaaagtgctgggattacaggcatgagccaccacaaccagcctctagaacagtcttacttcccttcctcaatgctcattccctcttattcctccactctcagcctcatttcacccctttagtgaagcttttaattcctttcttacctaaagagttctgcctgttgttctctaccctaacacactgtaaattttctttattgcacttaccacaatgtataattagacgtttctttgtttatttgttgcttttctctccccctagagtgtagagtctcaaggacaggaattgcatctgtgttatttgccagagcgtctccagcatacaacacagttcatggaacccagtgcgtgcccagcaacgatcagttgaatgactagagtagtgattctcaaccctggctgcacaggagagtcactcgggggtgctttaagaaacaatgatccttgattttcacccccgtgagatgctgagtcagtcccatgcaactagattgaggacaagaggataagggaaaccatttccttttcaatctgtgaaggtttgttacatttatggaaaacttgaacttcaccacagtcttacaggaagcatgaaattgagccttgagtttttttctcagctgtccaactgttatgggcctacaattgtatagctcagagtgacagagaagaactttggggttgggaaagaattggagcaacttcaagcaggaacgcggtgtggcaccttgggtgcatctcactgggttccatccattctatggtgttggggtcactctgctgtagagcaagatgcagaaatggccctctctactttccttatgtgtgtatgtgtggaggggaggtttagtggatgtctctggttactggaattctgtttgcattgcgctgccttctaggaccaaggactggttttcaagctctttggtcaagggagagagagcagtcttgagtctgtcagaacaggcccctgacaagtgaacagtattgatgccctccagccaaagacctccaggaacacacccatattgaacaagttgtgtttcatgttcattgcagcaagagaggacacacacatggggaaccatggaaggtgttggaaaggactcattatggaattggactttggttgtgtgattttggggagagtccaagcaagctgggatgtgcactggcatgggtgcagcctgaaagaggcaatgttaccattgactctctcaataaattttatctataaggaagggagggaaagcagactagagcgaggctaaaactatgattggtgaagaacactagttactcgcattcaccaggagaaggtcatgtttggcattttgtggcttgaacaatgttcctgttttgtctgtgttcacgtgtgattacggagtcttctttctgtcctgattcatcatgactacagagtggctttgtctaacattgatgctctgtgaaattgtttatgtttaggaaaacaccgagattgacctgtcagtaccaggccagttccctgctgtcaggggctgctttcctctttatcactagctttggatttgctccttccagtacttttctcatgtaaagtaaggtagtccagtgtgttcacacaattgagagcatttattacattagcctcctatcttttgcggggataatcacagcaccatggtgtggtaagtggcagtagagtatggtggttaagaacaaatgatcttgaggtcaggcgtggtggctcacgccagtaaacccagcactttgggaagccgaggcaggagtattgcttgagtccgagagttcgagaccagcctgggcaacatagcgagaccctgtctcttaaaaaaaagaacaagtgctctttattcagaaaatcattttagttgtgtgaccttgagcaagttcacttgaccaccctagcctcgactccctcatctgtaaaatgggggtaataatagtgcctaacttatagggcaattatgatgcaccaatgaaataatgcatgaggccgggtgcggtggctcacacctgtaatcccagcactttgggaggccgaggtgggtggattatctgaggtcaggagtttgagaccagcctgaccaacatggttaaaccccatctctactaaaaataaaaaaattagccaggtgtggtggtgcatgcctgtaatcccagctactcaggaggctgaggcaggagaatcgcttgaacctgggaggcggagattgcagtgagccgagatcgcgccactgcactctagcctgagcgacagagcaagactctgtctcaaaaaaaaaaaaaaaaaaaaaaaagcatgaaaaaacttttagcctggtatctggccagcagttggtatgctattgactaccaatgattcaatagaactatatgtttctctgcttagtttatcagagtttgcctttgtacctgtgatgaaaaaaacggtggaccgtaagaccttgggaccttggttccctgaaccaagccaggacaattgtattatttctcctggaattttgaaattggacaccaatatttgtcattcagggttggatatgtagactgggaagtgatgtcaagcgtccttgagtgaccactttctgctctgttgacttagaaccttgaggttaaaaaaatgttataggaaaccatatttgtttgaatgtttgttggaaagaaaagcagaaaagtagagaaaggtgatcttttttaattcttaattttttattattaaattttttttttattttaggtttgaggatacatgtgaaagtttgttacataaagatttgtcacagaggtttgttgtacatatcattacatcacccaggtattaagctcagtccccaatagttatcttttctgctcctcttcctcctcccaccctccccactcaagtagactccagtgtctgttatttccttctttctgttcgtaagctcttatcatttagctcccacttatatgtaagaacatgtggtgtttggttttctgttcctgcgttagtttgctgaggatgataggctccagctccatccatgttcccacaaaagccatgatcttgttcttttttatggctgcataatattccatggtgtatatgtaccacattttctttatccagtctgtcattgacaggcatttaggttgattccatgtctttgctatcgtgaacagtgctgcagtgaccattcacgtgtatgtgtctttatggtaaaatgctttatattcgtctgggtatacacccagtaatgggattgctgggttgatggtagttcttcttttagctcagaaaggcaatattcaaagacaggagaataaactggggtgagagagagaaggagtgaagaaaggagaaaagaagagagaagagagaggaagagaaggttctatggagctctaagtgttctatctggtctgcccgagttagtagagggataagaataaagaaaaaaaatgttactattcctctacggcccatcacacacatgggtgaatcaaatgggcaaagcaagagtagaattttacaccaccatgccgtaaacctggattgttttgactgttgagcatctcctctctcttttctattctttttctttctctttctttctttctttccttctttctttctttctttctttctttctttctttctttctttctctctctctctctctctttctttctcgctttctctttctttctctctttctttctctctctctctctctctccctctctctcttcttttcttttcttttgagacggagtttcactcttgttgcccaggctggagtgcagtggcgcaatctcggcttactgaaacctccacctcccgggttcaagcgattatcctgccttagcctcccaagtagctgggactacaggtgtgtgctaccacacccagctaattttgtatttttagcagagatggggtttcaccatgttggtcaggctggtctcgaacccctgacctcagataatccacccacctcagccttccaaaatgctgggattacagacgtaagccactgcacccggcctcactttcttttacccacatcagtcctgataatttccagtcccagcatcctgccttctccctcactcccgtagaaggactgggcaagtgaccaggccaatcagagttccccaatatcctggccatgtggattggtccagctatgggcacgtgaccttagctaagccaatcacctattcagaatgttttttgttctttaatacagagctgtgagagacagggtcttggcttttgaataatggggctgaaagaagtgagtcagggactgccaggggctgtctcctataccatgaggagaaatctcgtctatagggagaacgagccaaaagatggaaagtcattgagagggagagggagagggacattgaagtgggggagagaaagagagagacataatataatgttgagctttaaatcagctctatctagacttagaaaagccaataacttcccacttttcttggactgatttgagttggttttttgctactttagccaagtggtccccgtgatggctccccatttctttagatgaaaatcccaagccctcacgttggcatgccaggacacacctgccctagcctcaatggcctcatctcccgtccctctcgccattgcttactccgctgcagccattcctgcctccttgcttgttcgtcaaacgtgccaggccctacttcatacggattaaatcagactttttgagtgggatcaggacattagtattttatttgtttttaatttaattttatgttttgagacagggtcactctgttgcccaggctggagtgcagtggcacgaacacggctcgctgcagcctcgacctcccaggctcatgcgatccttctaatactcaccgttagctgggacctcagccagccagttaaccaaaatgtatgcgtgtggcctccccaggtgttctcttcacatgggctagttggacttcctcactacatggtggctggtgtgcaagagtgagtggctccagaaagcaaggaggacatgcctatgattttttatgctctagccctggaagtcaaatagcatcttttctgctgtaatcttaatcttaatgattgaggcagttgctaaggttcaagtggaagggatcatagacttcatcactcaacatgagaaatagaagcttacaaccacctgtcctcagcctcccaagtagctgggactacaagcatgtgccaccatgcctggctaattttttgaattttttggagagacagagtctcactatgttgcccaggttggtcttgaattcctgggctcaagtgatccacccgccttggcctcccaaagtgctgggattgcagatgtgagccactgggcccggccggtgacattggtatttttaaaaaggtactcagtgatttcaatgtgtagctagagctgagaatcactccttcagactaataaagaaggtcaatggctattaaggcaactaccctaaagaattaacttaaagtctatgtgtaagtttgtctcttgtcaacatagagtctagtttccttctaattttgattataaaataggaaagcattttcctatactataaaaaagtttgctttaagagtcccaggactgatttattatgaccttgagatttaaaaacatttattattggaaaccatgtttgtttgaaccatgtttgtttgaatgtttattgtagaaaagtccatttttccttttaaagtcataaactaaatttgttacaggaggttgattttgtgttccaagcctgtgatcattaactgttttccagctctaccaggtagggtattgaaccttttcttatttgagattcaaataaattctcctttaccaaaatgttattttgcaaataactaagtgactctaatggattaactttaaaatgcaatgccaaatcttgattttccacgaatgaataatttgaaagaaatttctctgttcactacatatacgccagaaagaatatcaaccttggcttttgatatattttaaattcctggttcaagtttcttatgtggccaaattgttcttagtgacctgggcttctgtaaaatgtccctgattcctttcataaaatgcttattttggcttatgctgctcgagtgagtttctgttaccatctttgataaagacaatcattaatcctgacagcagccttgcaaagtgagtcttactattcccatttcacagatggataatctgagcccttgggtactgagaaacttgctcaagtccatacaattaggcactggtagtccctggacaacaacccagatctacttgaccccaaagctgatgagtttccaccctcacagaaggtcctaatatggcacattgcttttttttacattgggatataattcatgtcttataaaactcaccatttaaaagtgtataatttagtggtcttagtgtattctcaagatttttcaactatcaccactgtctaattctaggatgttttcatcaccctccaaccccagacctctaccattaagcagccactctttcactcctgtcccccagcctctggcaaccactaatttactttctgtctctatggatttgcccattctgggtatttgatacacatggagtcatacaatatgtggccttttgtgtcttggttctttcacgaaacacagtgttttctaatttctaatttctacatttctgtcgtagaatatatcagtacttcatttctttttatggctaaataacattccattgtatggatagaccccattttgtttatttatctgtttacagacatttggattatttccaccttttggctattataagatacattttgtaaataacattgttatagaagtcttgttttccaaattaaacagaagggcaggtcctgtttcacacactttttttttgtattaaaaatatatgagggctcttccagttgctattactgggtaacaaatcacaccaatttttagtgctataagccacaattttattacactcacagatcctgtaggtcaagaatcagaccagagagggtggcttgctctgcctcatgatgtctggggactcagctgggaaaactcaaaagttgagggtgacttgatggctggggactaaaggcatctagaggaatcttctgtcacatgcctgtatttcatactcactgttagctgagacctcagctagccagttagccaaaacgtctgcatgtggcctccctaggtggtctcttcaggtgggctaattggacttcctcacaacatagtagctggggtccaacagtgagtagctcaagaaaaaaaggaggaagtgcatatgctttttatgttctagccctggaaatcaaatagcatattttctgctgtaatcttaatgattgaggcagtttctaaggttaaaaggggagggatcatggacttcatcactcaacacgagaaataaaaggtcacattatgacagcatgtggtatgggagatatcactatggccacctttggaaaaaaaccatctgccacaaggaccttgcactgggcttgtgacaggtatccagtagatccttatttaattaaatatattcatgcttatcaacaaattacatattggcctgcctgcttgtttgttcatgaatccatctcctccttcagaaatgaccccttcttgggtattattctaatgctttcatttcttaacttctgcattttcctagcttaggcaaatcactttacttctcagagcctcagttgtcttacccataaaatgggcaaacacatttgttcccactctacaaaattagtttgggaattcagtgggctaaggtataaatagtgcttactttagatgctgtttggaggtaaaggttcaataaatgataactattattattgctgttgtgattacctgaatgtaatccccattctcttatacttttcagcatcctgtccaagcctttaagatgaggaacaaattctatgtgaggagaaatggcaaaaattggtatgcctctgcttttctgatttcccattcccttccatttctcttattaacaagtaaaagtaaggaaatcctgtcctgtggataacttcccattgacttgcagagagctcagacatgctatggtagatatggatactattttgtttttgttttttgagatggagtcttgctcagtcacccaggctggagtgcagtggcatgatctcagcccactgcaaactccgcctcccaggttcaagtgattctcctgactcagcctcccgagtagctgggattacaagcagatgccaccacacccagctaatttttgtatttttagtagagacaaggtttaaccatctttactaaacagactaggcccgtcttgaactcctgacttcaagtgatctgcccgcctcagcctcccaacgtgctgggattataggtgtgagacactgcaccttgccaatggtgaatattgttgatttaaaataatagatataataaatctccaatctcagggaagtttccaagtcctaaagtcaaaacttccgatcttgccgtgtgcttgaattatcctcaattagagtccctgctgctgttgcatgtcgctgtaattattctgtcatcgttaattcaatgaagcctattaacccacatcagatagtgtatttatctacaatgcatgttacctgctcctctagataagacagctgtcatacttcaagtctgctgtctctttgttgaggtccagtagtgtcagtctgcaagtgtttcatgtttcatatacattacagaatccccattaatggttgatatgattaggctttgtgtccccacccaaatctcatcttgaattacattccctataatccccacatgtcaagggagagaccaggtggagataattaaataatgggggcagtttcccccacgctgttttcatgacagtgagttctcacgagatctgatggttttataaggaacgcttccctctttgctcggcatttctccttcctgctgccttgtgaagaagatgcattgttttcctcttcactttctgccacaattgtaagtttcctgaggcctccccagccatgctgaactgtaagtcaattaaacctctttcctttataaattacacagtctcaggcagttctttacagcagtatgaaaatggagtaatacaatgatgttcttataacttcccagactggaaggcttgctggtcttgtgagatactgaactggagacagcagaaaaatgcatcctcctgatattgtgagcaacctcctctcttcttccctctctcctcttcttccctttcttctgttttcccttctaggagccaagagcataggctctggaaccagcctgcctggtttgaatcatgcctctgcctggggatcttgggcaggttgcttggtctctctgagcctgtttttttcatctgtgcaagaatcacaactctcttgtgagaatttaatgtgctaatctgcataaagcacatagacaactgtctggctcatgatgggagtgtaactgtggttatttcttcctattttcttccctcccttccaacagaagaaagtctctgagatgcgtgtcttatgtggcatatgctggacttggtgcctggggttcattggcagactagtccctctggtacctccagcaaggaagatagatgttaattattaattgatacccattgtgataaatctcacaaggtaccatgaatgggtataacagctccctttctgtggaggaggtggaggtgataggtaagacttcctggaggaagtaacatttgaacagagatctgaaagataaaatacttccaggaggagtgtgtgtgtgtgtaagtcagtcaacatcagaacacctccagcagtggaaacagtgtataggaagctctgaagtaggaaggatcctctgttaatggtttttttgttgttgttttccctcttcgagacagagtctcagtctgttgcccaggctggaatgcagtggcacagtctcagctcactgcaacctctgcctcccaggttcaagcgattctcgtacttcagcctcctgagtagctgggattacaggtatgcaccaccatgccccaatcattttgtattcttaatagagatagggtttctcaaactcctggcctcaagtgatccgcctgcctcagcctcccaaagtgctgggattacaagtgtgagccaccatgcctgacccattaatgttttgaataggtaatactttcgcatggtccaaattccaaaaaatacaaaaggataaacagtgaaatgtctccctttttccatttaccaccttccccctacctctatccctgaagcaacaaatgaaccaatttctttggtattcttctagaaatatcctgtgcatacataagcaaaatgtatgtgtgtatggtgtatatacatatatacacacactatatatagtgtgtatatgtgtatatatatactatatatagtgtgtatatatatacactatagtgtgtatatgtatatatactatatatagtgtgtatatgtgtatatatatactacatatagtgtgtatatgtatatgtgtatatatacacatatatatactatatatagtgtgtatatgtatatgtgtatatatagtgtgtatagtttatgtatatacatatccacactatatatagtatatatatgatattcacatatcatcttttattttttaatatgaaaaatgcttctccgttatttgcttttttcacctttctcttaaatacgtatcttggagatccttccttatgagtacacagttaactttcttattttcttttctgagtggcagagtacaccatgtagtaccctataatttgtttaagcaacctcctactgatggatgtttgggttatttctactcttctgctattatttaaaaaaactataatcgataatctgataccggtgcaatttgctcctgtgcaactgtctgtgggataaatttctaaaagtgtaatagttgggtcaaatgacacacttttctccacagaggttgtaaaaaatttacacccacccctcaaggaatgtttgagttcccatagtggcatcaagcaccatgtattattgagttctttttaattttgccaatctgataggtgaaaattcatatctcagcatagttttaatttgcatttatcttactctgaataacacagagcgtgttttcatttgcccaagaatcacttgtgtttcttttcttacgaactgttcttatcttttgtccatttttctgtgatgaatctgctcttttgcttattgattttatacattaggggaattagccattttccacgccatgcttcacaaacattatttcctgggttttcttttgtatttagactttgcttagggtggttttggttctgcagctctgttttttaaaaaacttttatgtagtcaaatttttttttttggggggggggtctcctggatttgtgacatacttggtctcctgcatttgtgacatgctaagaaaaacctttgtcatttcaagatcataagataattctattctttaaaaaaacaccttcagaaaaggggattccagatgcgactttaatgatcctttcctgtgtttgccaagcatcatggtagaaataccttccttatagccacatgaaacccctgatgctggagtgttgtgttcaccttatcggcaaatatttccccagcacctcctatgtgtcagtgtagaactgaacagcacagaagctacaaagactaagaagccagcaaaagttcaaattccaccacccagaagtaaccaccataaacacttggtattatcatgaattttttttataaaaaactccataagcacatatttttaagataaaaataagattattgtacacataatttttctgacctgatttcaaaatatatccaagacttctttctctgttactaactgtaaatgtagatttaacatttaacatttaactacggcaatgatttacatgtagcagggtttgtgaaatgactccttgtggatggacagtgagactatcctccctcttccaccattctaagcaatgctaccaagaacatctttacatgtctatctttgccctcttgtcttagacctagaatttctgggtcacattgttaaactgtttttaggaagattgtgctgacttatattcccacgagcaatgtaaggtatgccagaaagagggcaggaggttgggagtgggaggagaagggggcggaggaggaaactgggtaaatgctattggtgataaaaaggagacagtctcactgtctatcaatagggaggtcattcagcaaatcctgctacatgcaaatcgttgcctagtcatgaaatattaaatgttaaatctacatttacagttggtgacagagaaagcagtcttggatttattttgaaattaggtcataaaaattatgtatgcaatcatcttatttttgtcttgaaaatatatgttcatagagtttaaaaaaatcattcatgataaataccaaatgtttatagtggttatttctgggtggtggcatttgaactgttttatttttattggcttttttttttttttaattgagatggagtcttgctctgtcaccccggctggagtgcagtggtgtgatctaggctcactgcaacttctgtctcctgggttcaagcgattctcctgcctcagcctcctgagtagctgggattacaggcacccgccaccatgcctggctgatttttgtaattttagtagagatggggtttcactgcattggacaggctggtctcgaactcctgacctcaggtgatccactgccttggtctcccaaagtgctgggattacaggagtgagccactgcacctggaattttattggcttctttattcatctttgtagtttctgggctgttcagttgtatattgacatatagtaggtgcttgggaaatatttgctgatgaaggctattttgggaattaaaaaaatgtatttcagggggcagcaaactatagctctagggccaaatctggtctctgcctatttttgtaaataaagttttattggaacagcctcatacacctgttcatttacatagcatcagtgattgctttggccctacaagggcagagttaagtgattgcaacagagcccacatggtcaaaagagcctcaaatatttactaactgatggtttacagaaaacgtttgctgcctcctggtttatttcattaaagaagttatattacacctctttggtgtctccattccctttaccacttatgttaacgtgggaatgatgacaccaacctggaagagtcacatacgtaaggcatacagcccagtgtttgtcttttggtgcatgtataatcaatactaattcaccttcccttcctaaagacttttactcccaggaagtggaagcagaaaatgggcaggtatgaggcaccgggttggtgatagttcttctctgcttttacttcccattttctgtcccaaagtttgaggagttcattttttcccttctgagtaaaaaaaattttttttttttttgagacagagtcttgctctgttgcccaggctggagtgcagtggcatggtctaggctcactgcaagctccgcctcccaggttcaagctagtctcctgcctcagcctccctagcagctgggactacaggcgtgcaccaccactcccagctgatttttgtattttttgagtagagacagggtttcaacatgttggtcaggctggtatcgaactcctgacctcaagtgatccgcccaccttggcctcccaaagtgctgggattacaggtgtgagccaccgtgcctggcttctgagtaactttcaaacacctgaagccccaaacttagaagtcacaagaatcatgtcaagcctaataaatgactgttttttcctgttatcaaactttttagggaaacaggatttctgtcacttacttggactgaataacactcacacatatttaaaaaacattgtagggagtgttttggatggatggtatcaaggaatagggggtctgcagttgtcatgcacattaagcagtggcattgaattagggtctgtgggaaatctggtagtatcagagcatgcaggcttctcaacctctgtactcctgacattttaagctggatgatcctttgttgtgcgggctgcaggatgtctacctggtgtggtagacagaacaatgccccctctcctcaaagatgttcatatctcaactcctagaatctgtgaatatattacattaagatggcaaaatccaaacgaaaacaaagcaagagaaaactctcgcagatgtgattggaatgaaagatcttgagatgaggagattattctgagttattcaggtgagactcaggtaattgcaagggtccttagaagatgatgtgacatgatgatagaataagagtgggaagagaagatgttaccctgttgctttgaagatggaggaaggagccatgagccaaggaatgcaggcaacctctagaagctgggaaaggtggggaatagattctcccctagagcctccagaagacatgcagccctgtggactcatttttgtcttctgacctctagaattataagaataaatttgagttgtttaaaaccacttaattggctgggtgtggtggctcatgcctgtgatcccagtgctttgggaggctgaggcaggagtattgcatgagcctaggagttagagactagcctgggccccatctctccaaaaaataacaattagctgggtatggtggcatgccctgtagttgtagcaactcaggaggctaagatgggaggatggcttgagcctaggaggtcatggctacagtgagctatgatggtgccactgcactacagcctgggtgacagggcaagaccctgtctcaaaataaaaaaataaaaatgaaaccactaaattcatggcaagtttttacagttacaataagaaatggttacacctggtctctacctactggatgccagtaacaccgcattcccctcaccccactctttttttcttttcttttctttttttttttttgagatggagtctccctctgtcacccaggctggagtgcagtggcgtggtctcggcccattgcaacttctgcttcccgagttcaagcaattctcctgcctcaatctcccaagtagctgggattacaggtgcccgccaccacgcctggctaatttttgtatttttttaatttttattttttattttattattattatactttaagttttagggtacatgtgcacaatgtgcaggttagttacatatgtatacatgtgccatgctggtatgctgcacccattaactcgtcatttagcattaggtatatctcctaatgctatccctcccccctccccccaccccacaacagtccccagagtgtgatgttccctttcctgtgtccatgtgttcttattgttcaattcccacctataagtgagaatatgtggtgtttggttttttgttcttgcgatagtttactgagaatgatgatttccaatttcatccatgtccctacaaaggatatgaactcatcattttttatggctgcatagtattccatggtgtatatgtgccacattttcttaatccagtctatcattattggacatttgggttggttccaagtctttgctattgtgaatagtgccgcaataaacatacgtgtgcatgtgtctttataacagcatgatttatagtcccttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttcaatgatggccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctagatattagccctttgtcagatgagtaggttgcaaaaattttctcccatgttgtaggttgcctgttcattctgatggtagtttcttttgctgtgcagaagctctttagtttaattagatcccatttgtcaattttggcttttgttgccattgcttttggtgttttagacatgaagtcctttcccatgcctatgtcctgaatggtaatgcctaggtttccttctagggtttttatggttttaggtctaacgttgaagtctttaatccatcttgaattaatttttgtagaaggtgtaaggaagggatccagtttcagctttctacatatggctagccagttttcccagcaccatgtattaaatagggaatcctttccccattgcttgtttttctcaggtttgtcaaagatcagatggttgtagatatgcggcattatttctgagggctctgttctgttccattgatctatatctctgttttggtaccagtaccatgctgttttggttactgtagccttgtagtatagtttgaagtcaggtagcatgatgcctccagctttgttttggcttaggattgacttggtaatgcaggctcttttttggttccatatgaactttaaagtagttttttccaattctttgaagaaagtcatttgtagcttgatgggtatggcattgaatctacaaattaccttgggcagtatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgtacattgattttgtatcccgagactttgctgaagttgcttatcagcttaaggagattttgggctgagacaatggggttttctagatacacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgcccgttttcaaagggaatgcttccagtttttgaccattcagtatgatactggctgtgggtttgtcatagatagctcttattattttgagatacgtcccatcaatacctaatttattgagagtttttagcatgaagggttgttgaattttgtcaaaggctttttctgcatctgttgagataatcatgtggtttttgtctttggttctgtttatatgctggattccatttattgatttgcgtatattgaaccagccttgcatcccagggatgaagcccacttgatcatggtggataagctttttgatgtgctgctggattctgtttgccagtattttattgagaatttttgcatcaatgttcatcaaggatattggtctaaaattctcttttttggttgtgtctctgccaggttttggtatcaggatgatgctggcctcataaaatgagttagggaggattccttctttttctattgattggaatagtttcagaaggaatggtaccagttcctccttgtacctctggtagaatttggctgtgaatccatctggtcctggactctttttggttggtaaggtattgattattgccacaatttcagagcctgttattggtctattcagatattcaacttcttcctggtttagtctttggagggtgtatgtgtcgaggaatttatccatttcttctagattttctagtttatttgtgtagaggtgtttgtagtgttctctgatggtagtttgtatttctgtgggatcggtggtgatattccctttatcattttttattgcatctatttgattcttctctcttttcttctttattagtcttgctagtggtctatcaattttgttgatcctttcaaaaaaccagctcctggattcattaattttttgaagggttttttgtgtctctatttccttcagttctgctctgattttagttatttcttgtcttctgctagcttttgaatgtgtttgctcttgcttttctagttcttttaattgtgatgttaggatgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcattttgttatgtacccagtagtcattcaggagcaggttgttcagtttccatgtagttgagcggttttgagtgagtttcttaatcttcagttctagtttgatcgcactgtggtctgagagacagtttgttataatttctgttcttttacatttgctgaggagagctttacttccaactatgtggtcaattttggactaggtgtggtgtggtgctgaaaaaaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggagtctaagtctctttgtagatcactcaggacttgctttatgaatctgggtgctcctgtattgggtgcatatatatttaggatagttagctgttcttgttgaattgatcccttgaccattatgtaatggccttctttgtctcttttgatctttgttggtttaaagtctgttttatcagagactaggattgcaacccctgcctttttttgttttccatttgcttgttagatcttcctccatccttttattttgagcctatgtgtgtctctgcatgtgagatggtttcctgaatacagcacactgatgggtcttgactctttatccaatttgccagtctgtgtcttttacttggagcatttagtccatttacatttaaagttaatattgttatgtgtgaatttaatcctatcattatgatgttagctggttattttgctcattagttgatgcagtttcttcctagcctcgatggtctttacagtttggcatgattttgcagtggctggtaccggttattcctttccatgtttagtgcttcaggagctcttttagggcaggcctggtggtgacaaaatctctcagcatttgcttgtctgtaaagtattttatttctccttcacttatgaagcgtagtttggctggatatgaaattctgggttgaaagttcttttctttaagaatgttgaatattggcccccactctcttctggcttgtagagtttctgccaagagatcggctgttagtctgatgggcttccctttgtgggtaactcgacctttctctctggctgcccttaacattttttccttcatttcaactttggtgtatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccctatcactttcaggtacaccaatcagatgtagatttggtcttttcacatagtcccatatttcttggaggctttgttcgtttctttttattcctttttctctaaacttcccttcttgcttcatttcattcatttcatcttccatcactgataccctttcttccagtcgatcgcattggctcctgaggcttctgcattcttcacgtagttctcgagccttggctttcagctccgtcagctcctttaagcacttctctctattggtgattctagttatacatttgtctaaatttttttcaaagtttttaacttctttgcctttgctttgaatttcctcgtgtagctcggagtagtttgatcgtctgaagccttctctcaactcgtcaaagtcattctccgtcaagctttgttctgttgctggtgaggaactgcattcctttggaggaggagaggtgctctgtatttagagtttccagtttttctgctctgttttttccccatctttgtgattttatctacttttggtctttgatgatggtgatgtacagatgggtttttggtgtggatgtcctttctgtttgttagctttccttctaacagacaggaccctcagctgcaggtctgttggagtttgctagaggtccactccagaccctgtttgcctgggtatcagcagcggtggctgcagaacagcggattttcgtgaactgcgaatgctgctgtctgattgttcctctggaagttttgtctcagaggagtacctggctgtgtgaggtgtcagtctggccctattggggggtgcctcccagttagggtgctcgggggtcaggggtcagggacctacttgaggaggcagtctgcccattctcagatctccagctgcgtgctggaagaaccactgctctcttcaaagctgtcagacagggacatttaagtctgcagaggttactgctgtctttttgtttgtctgtgccctgcccccagaggtggagcctagagaggcaggcaggcctccttgagctgtggtgggctccacccagttggagcttcccagctgctttgtttacctaagcaagcctgggcaatggtgggtgcccctcccccagcctcactgccgccttgcagtttgatctcagactgctgtgctagcaatcagcaagagtccgtgggcgtaggaccctccgagccatgtgtgggatataatctcctggtgcgccgttttttaagcccgttggaaaagcgcagtattagggtgggagtgacccgattttccaggtgccgtgtgtcacccctttctttgactaggaaagggaactccatgatcccttgcacttcccgtgtgaggcaatgcctcaccccgctttgggtcacacacggtgtgctgcatccactgtcgtgcgtccactgtctggcactccctagtgagatgaacccagtacctcagatggaaatgcagaaatcacctatcttctgcatcactcatgctgggagctgtagaccagagctgttcctatttggccatcttggctgccaaactaatttttgtattttttgtagagatgcaatttcgccatgttggccaggctggtctcaaactcctgacctcaagtgatccacctgccttggcctcccaaagtgctgggattacaggcatgaaccaccctgtccagcccccattcccaatttgtgatcaccaaaaatgtccacagacattgtcagatgctccttggggagcaaaatggttcccagttgagaagctctgtgttagagagattccaacagcagctgcaaaaactcagatgcaagaagttggtgcctgcactcagctgagtgcagtcagtgggctgtggggagctgggagaataggtaacccatcatgctcactgttgctcctctctgctgccttgccctgtggggattcatgcctggatgcttggagagcatggttgggctgaccaagaatccttattgaatgtgacaagttgccccattgggcccctgcttcttagcccaaggatgaaagtcactctttgtggcagcttttccctttgggtcagactcctttgcctgactgaccaattcctttcatgctggcaggaaggacttccttctatctaagccacagtagctaagtgttgcctggttccatgcaatagaaactgactctgattaagtaaggaaaataaattcgtgattgttaggataacaggtgctctcactgaatgagagaggagtttgcataggaaggaaaatactaatagagttttggaagcttagcagcagatggaattcatgatctacctctcttaaaaaaattttttttagagacacggttttactccatcacccagaccagaatctagtggcaccatcatagctctctgtatccttgacctcctgggctcaagcaatcccgctgcctcagccttccaagtagctaatgccaccatgccaccatgcctggctaatttttaatttgctttttgtagagacagggtctcgctctgttgcccaagctggtcttgaactcttggcctcaagcaatcctcctacctcggcctcccgaagttctgggattagaggcgtgagccacggcccccagcccctacctttcttgagttctaccattaatgtgtctcactttccaatctcggattccaagtttcaaattcctgggggagagaatcctattgcttgggctccatagatcaacccactgagaccatggggagagacttgcccaaggtcacacagcctgaatagcagagctgggctgcctctctcgactttcaggactgttctttttccatgatagtttttggggagatggaattgtctagttagagagttacctgagagccaatatagtaagaaaagttcctcgccaggcaactgaaatgacacaggaactgaaaactgtggacaaactcgggctgttttttctagtaggtatcaggcatcaagatgtttttagataactagagatgacatttactttgacatattgaaaaatagttatgacagagttttgagaggcattattgtgaaccatagtagtgtgaggtcttaaaaagccccttcttcattttttagctgtttctaatttccacctaaattgtctcagatcctttgctaattgccaagcctgattgaatttccagttccttattcctttcctgggaccactttaggctctgactgacttctccttaggtctctgtttaaacaccaccattacaacaggttttatttagttttttttttttttctttttaagacggagtctcactctttcgccaggttggagtgcagtggtgcgatctccactcactgcaacctctgcctcctgggttccagcgattatcctgcctcagccttccaagaagctgggactacgtgtgcacgccaccacgcctggctaatttttgtatttttagtagagatgggttttcaccatgttggccaggatggtcttgatctcttgaccttgtagatccatccacctcggcctcccaaagtgctagaattacaggcatgagccactgtgcccggcccttatttagtttaaattcagcaatcaattcacatttactatataaaaattcaaaacacagatatgccaattaaaatttaaaaaatcacccataagctgaccatctagaaaaaactgtacatttctctattccgcatccttctagattatttttcttatcagtttatacttatgcaaagtggtattatacttcatcttctgttttgttactgactttattcatttagttattaaaactccttaaatatgtgttgattacattgtttacttaatttttttctttttattttttttagacaaggtcttgctctgttgcccaggctggagtgcggtggtgcaatctcgctgactgcaacctccgcctctcaggttcaagtgatcttcctgtttcagcctcctgagtagctgagaccataggcatgtaccaccatgcccgctaactttttgtatttttagtagagacagagttttgccatgttggccaggctggtctcgaactcctaggcacaagtgatccacgtgcctcagcctcccatgttgctgggattataggcgtgagccattgcgcctggccaattacactttttaatagcttcaaagcattccattccctggttatgccatgattgattgaacatatccattattcatttttgagagaacttttttgtttctgtgttgttgatggagtgatgttatatagctgcagaataaatcaaaccatgactaatatttcataatttcatgaatttatttcattttggatagttacccaattttttttggtcctttctgattttagaatattttgttatgacattcctttgtgacactggggagaaaatgtacttttttcccaggtcagaggtgtccagtcttttggctttcctgggccacattggaagaagaagaattgtcttgggccacacatagaatacgctaacaccgacgacagctgatgagctaagaaagttgatgaatttatgttgagccccattcaaagctgtcttgggccacaggttggataaccttgccctagtttctctctatgcctttgagctgccattcagactcctttgaaagatggattatcttatatatacctatgtattttctgatgcccactctccccatttgactacctgtggagttgaaaacaagtccgcctactctaatcaaatcatgatgctctgtccggggtcacattttgtaaccgacaaaacagtgcatgaggagttccggttttctcgtatcacaagattttattgagcagctactatgtgccaggcagtgtgctaggctttggagacttgtacaaattatcctggggtatctcagcagggaagtccttatttgtttattaatttttcctgacggtcaggtccagttagtctcactctaaacctggggcttggaatagagggacctgagacaccacattagctgcatgacattgggtgactagattacattctttgtatccattttcatattgataaagttaaatcggctcagagtgagggttataactctagcatatatagaggccacagcatatagtgttatatgctgtacaaaagacacaacacacagtaaatgattcaataagcaatggccatctttattatttacgttgttatcatattctgctgaaaggcttatgtatcaagtacaagaaaatgtataacccagtcatttgttttttatccaaggcagctgatgaagaagacacttattagcccaaagagtgaacagggtgagaggaggaggttattggctgcttctctgcggttaatttagccatcatttcagaatggagctggtatgctttgagtgtgaaagaaacctgctgcttgttgatgattagtctggttttaatgagttatcaggtgtcaataacagcagaagtgcactaacttttcacagccatcagaggatgttcaggatgttcactgggttctcacttttcagggttttctgtgggtgttagaggttgggctgaggagggcctgataggacatatctatctctgcaagtcttaggcaaagaagctttcgtgatgatgtattaggctgttcttgcattgctgtaatgaaatagctgagactgggtaatttataagagaagaggtttatttggcttacggttctgcaggctgtactggaagcatagctccagcatcagcttctagggaggcctcaagcttgtaatcatggtggaaggcaagggggaggaggcatatcagtaggtggggaggtgccacatacttgtaaatgatcatgtgtcgtgtaaactcactcactatcacaagaacagcaccaaagggatagtgctaaaccattcatgagagatccgcccccatgatcccaatacctcccaggaggccccacctccaacagtggggattaagtgagagttgggtggggctccttgctcctcttcccagttaatccttaatctccaccccaactccaggcaaccactgaacttaacctccccttccccttcctctccttcttccccttccccttcccctccctgaggtgtctgtcagttacccagactagagtgcagtggcatggtctttgctcactgcagcctctgcctcctgggctcgagcaattctcccacctcagcctcctgagcagctgggactacaggcacataccaccatgcctggctaatttgttgtatttttcaaagagatggggtttctccatgttgtccaggctggtctcgaactcctggggtcaagcaatccacccggctcaacctcccaaagttctgggattacaggcatgagtcaccaggcctggcccactgaactactttctatcccaatacattagatttttctttctaggagtttcatatgaatgaaatcatacagtatgtgctcctggcttcttttgcttagaataatgctttggttattcatctgtgctatttattgtgtgtatcagtcatgtttttctattttctcaccttgagaagtattctgttttatagtacaaaacaatgagtatgtccattcaccttgaggaagattttatttgaagaaatctttgtcatcaaaaagcttgaaaaccagggctctaccttgatttcatagtcttgagaatgatggagaactcaatttataccatgattttcattgagaaagcaggttgcatgttaagagattaggtgataggatgactgaaaggtatttgtgatcttatgaaaggtacaatgtggcaggcagcctctatgagggaccccagtgatccctgtctcctggtattcatgcctttgtgtaataccctccccttagcatgggctggacttactgactcacttgtagtgaatgcaatatggctgtcctgatgggctgtcacttctgaaattagcttatgaaaaaaccgattacaggtatatctcattttattgcacttagctttattgtgctttgcagttattacattttttacaaataaaaggtttgtgtccctcagtcaaacaaaaatgcaatgggtttctttctagtcccccacctcaattttagaaattaaaaaattttccaaacacagtgagtagtagtctatatctgaagggtgaatgaagcaatgagtgaccaagttgcccacttaaggaggcacttcacaacaataaacaaagagcctgctctttggtctcagacctgggtttgagttctaactctgctactccttgactgtgagatcctggccatgtgacttaccttctctgagcttctattttctcatctgtgaaatggggacaataattcttacatcagtgcattaagtgagagaatctagacagcacagtacctaacacaacacaatgactcaatttattattgttgttgttgcttcattcttatttgtaaacactcaactgtcttcacaaacttcaggagctcttcaatgagacactgtgtccattaacagtctcatccaatgggtaatcttgaagatagatgattctatggtaggttctgaaacatctcctcttttactctatcatggtgtcaaagaccaggatggtacagaggtccaggagtctggcctatgcagtcagagaaactgatttgaactctacctcttccacttattaaccaaggggctttgggaaaattgtgagcatcaccaggctcatggtgaagatggggttaataatagctccaaccttatggccttaattgagataattaatgcatataaaaatgaaaccatgtcttttgcagcaacatggatagaactgaaggccattatcctatgtgaaataactcagaaacaggaagtcaaatactgcatgtggtcatttataagtgggagctaaacaatgggtacacacagacatacagagtaaaataacagacactggagtctacaaaaggtgggaaggtaggaggggagtgagggttgaaaaattatctcttgggtacaatgttcgctgtttgggtgatggatacagtagaaacctagatctcatcataatgaaatgtatgcggttaagaaatctgcacctatatcccctaaatatatacaacttttaaaaaattaaaaaaatgattaatgtgggccagcacacagtgatcactcaacaaatgcaaactcttattcttgtaggagttgagggaagatgccaagaccaccccttctccaacttttaatgtcctggtattttgtcttaaacatttggaagcatctgcaggcagggattttgtcctcctgtctcccttccgatggcactggcctgtttggatcagtggaaggctctcctgcccctcctcctttcttcccagaggttttcttttgcactttggacttctattcatggatccttctgccagggacgtggaccaagaattcttcctcttttgcagatttcttcccctaattgtcctgttttgtgctgtcacccctgtgctctccctcctccccagttatcagcagctggcaggaaatgtttatagaagaagcctttctttctgtttttaatagcctcctaggctgcaacctcccaaatgagaaccttgttaaccagaaggactctaggctactgatttatatttcagtcataccgagaggaggaaaaattacaaagggagaaagaaaaatgccaatgtacacatggactagttccgacatcttctctgatgaagaatgtatatatctattcaggctctggatgctaagggattccttccagatctcagtatttgacctcttacttttgggtcacgtggattcttcgtgcctcttgtgggcttgctgaaagcaaaagtaacaatttcatactcttgccattgaaacaaggggtctattacttttaaatcataagggcacttgtttcaacagaaatgttagtatcttggtgaagatggggtctaagttcttggtggcttctgaggatggcgaagggctcaccttctgtcatcccgaaccatcactgatgggacagtgtctctccatgtgtagctatgcaaaggccacagaacaaatgggtaaaaatatttggtggtcagaattctagctcaatagtcaaggaaggcttcctggaggagaaagttcattttgaactgggctttaaaagttggtgtcacagaaaatgcaagctgtccctcagaattaagactagagttctgtgaaatagtgattgcaaaaatggccacaattattctcctctctataggcacacccctttgcaatgtgacattgtagcttctcctattagagtctatttccccacccttgaatccaggccagtcttgtgacttgctttggctaatacagtgtgatggaggtgacagtgtgccagttctgagcctaaatctcaagataacttgcacacttccactcaatctcttggaatcctgcccaaccaccatgtgaaccagccccagctagcctttgggaggatgggatgccacatggagaggagacagcccaggtaaggaccagtcagcacccgaccaaccaggcagctaactgctggtacctgagatgggcccaatcaagagcactacatttgcccagatagacccagcgcacattgccagcctgcagaatcatgtgctaaatgaatgcttattgtttaaagctgccgaatagtggtttgtgatttagcaaaactaactagtacagtttcctatgcagctgagtgtatccatgtgactaagtttctacatacaaaaacggtgtgtgtaatttctggggaatttccttccagggagaaggtatgctcttcttccactttttttcctttatattgcctggaatgggtatgtaatagctggagctccagcagccatcttggatcatgaagtaagtttaggaatggaagacactcctggcagagcaataagctgggagggtcttgttcctgtaaaaccactgattacctttccagttctattctggtacttctaaatttactaaacagaagttaataaacttttgtttaggtcattgttttgagttttgcagttactcatagctgaacctattgcaaaagaatacagatggtcaggatttaaacaagcagggatggcagagaagggcatccatgacatagggaatataacactaatgttgcagagaaagaaaaagtgtgggtaatgggtgggcaatggtgaataactacatatgcctaaggggagcagtgggtgatcaaattgggaaccatttgggaccagcttttgaaaggcagactgagaagtttggagagggtggtagacaaaaatgtgtgagtacttatgcaaatcagagtaagaaagtcatatattcatttttcccccactcattgattcatttcttctaggaagtttacactgtgtatgagggaaacatagcaaaatagaaagatgattattgattgttatgcatggtctgaactaaataaactctgtgatgtggcagagattaactgttgggcggagatggctactttaggcacagtagtcagaattttttgttttctagaaattctgttaggccctgtgcagaagtctaggaacacagggatgaataacacacacttcctgtcattgaagagatcacaatctggtgtggaatgaggttaatcaggaatattttcctagtggaggtagaatagagccaaaggaaataatgtagttttcccatatgtatctgtcagatattgctacaacaaggttgcataacaagcatccccccaaatcttgcttacaacaaaaaaatattttttccttcacaggtctgtgcataggctgtggttctgctgggctctgttggctcggcttgactccacgctgtgggttggtctgggtctgctctatatatctttttattctgggaccaatggatcccaaagatttgtacttctcagggtggatggcagaagtgcaaggggccaaaccagaccacagaggcacatataatgctttgacttgcatcacatgtactaacacaattggcattagcaagactgatatcagtgggtcaggatgtatgttccactcacagtgggaagattgcaaaggtgcaaagatgtataattctgttaagagagggaatgaagagtcgggaacaatatccagcttaccataccacccagcttacttaccattccttaccatacaaggaaataatgtatttctccatttttcaagaacactcatgtctgaatagttttattattttcttcaacaaatcttttatcttgttagatttattgcaacgagccatatttctcttttttacaaaatttatttagaaagttacatatgcacatatggtaaaaagttcaaaaagtggtaccaaaagatataacagtgaaaataaggctggttcttgtttttatccactgaggcaaatactgagtttattttcaaaggtattctgtgtgggcacaatcacgcttgcatatgttaaaaaatacaaaatggtatcatacttgttcctctgcactttcttttttttctatttaacaacatatcttagaggtagtcctatttcaatttagctagacccatttcattctgtttaatggctacatttgtttttcattgtgagactgtgccgtaatttatttaatcagtgccatattgaaagacatttggatcgtttcccagcatttgcaactataatcaaggttacattaaatatcctgttacatgcaggaagatactttattcacatgcatgggtatatcagtaggttaaaactcaaatacagaaactgccaggtcaagagatacacatcttaaagtttaatagatattgaccctgtttctaaaaagaaagattccttccagcgtgtctacacacatttgtctgctcctctgtcttctgattcttgtcccatggtgttattttaggctgaaataatggaatatggtggctcaaaaaacttattcccataggatctctgggaaagctttgggtcttgccacatggtccccagttgaacacaggaagtacttggcactgttgttgcaacccaaatcatcactttaatgagcgtgctggaggagcgtggaatgtttccacaagcatgtgtactgaagaattccatgctgcaggcgaaatgatttatatccctgggagttcccagtaaaaaaatgtgcacagtaccctttaatttgatctgctttccctgtagcacctaaatatttagggcaaatagaaaatagttctgatttacatctctataaaaattttaaacaacctaacaagacatttgatcatgaaattgcctgaaataatgttggcactagtcagccatatttcttcaaaatggcctgtaacttcagtgcaaactcccaaacatggatttttttttcctgctaataacagtcttattaataaaagaatgattttctttactgatcctcagcagctgtgttccgggtgtctttgttcaataaaggtagagataataactgtcagtggaaagaaaatgtgctgaggttcccaggagaagtggtggaaacaaatcttttattaaatcatatcaaattgtgtttctcgtttactttttccattttgtaagtcacagtcatatctgctagtttttcggaaaccttggctcacatttgtcaaaaaaacttggcttggcattcttgaggttaatgctgcgtgatcaatcggtgataaatttgacataattaactgttgtaatggcatttctgagtctgtttctcttctttactcctgctgaaatcatctgagattagttaacttctgaatatttcttcagatgtgctgtggatgcctagaaaaagagtggtaaggaagtgtcgttgatatctggagttcttatctgtccacaggttaatgatctctctgaataataacacccctatttccctaggaggatcccttcccctactctcaaggcaggtggctcagatgggcctgatttattcctggtgctaggggtgggcaaaagacccagacctgaccaatcaaaaacatcaaattgggccaaccagaacgaattagaattctgggacctttgctacaactattggaaaagataattttttttttgattggaattcctgaaagaacaagacataaacctgcttctggttatctttgctttccggggaaaggttttttttaatgtttatttttattttttctgagacagggtctcactctgtcacccaggctggagtgctgtagtgcaatcatggctcacggcaacctcggactcctaggctgcagagatcctcctgccttagccccctgagtgctggagctacaggtatgtgctaccatgcctggctaactaaatttttttttccttttttgagacagggtcttgctctgtcacctaggctggagtacaggggtatgatcgtagctcactgctccctcaacctcccatactcaagctatcctccctcgtcagcctctcaagcagttgggaccacaggcatgtgacaccatgcccagctatttttttttttaattttctctagagatggggtctcactatgttagccagtctaatctcaaacttttgggctcaactgatcctcccacttaagcctcccaaagtgttggcattacaggcgtgagccaccatgcctggccaaaaaagggcattcttgaagtcaaacaagggaaaacactgagaaatgaagggaggttcctgatcatgtcacttggataccagtgtttagccatgcctgaagtcttacccttcaattaggcaggctaatacattttcattttttgcctgagtccgtttaacttgggtttctggcacttacctcgaagaaagtcctaaatacttatgttttccaagtttcagtaaagtctcatgtatgggagagtgtggtcagcgccagcaatacccatgtccataataaaatatcagtcctctccccgtctgttattgctggtcaccactgtataatagactgtgttcaggctggagtgacagctccagtccacagttcatcagagggtctcagcccagtctcgtcaaggattctcatttctagcattcatcatggttgccctatatccatgctctgaggatatggcatttacctctgctgtgccttgtcctccccctaccttgtaccagtagatcagtagatccttatgaatgcacaaatacctctctctgcaccagagagagtccagcctgaggtttgtaggcagctagctactggaattttctcccagctttgtatctctaagatctcaggtccatttctttttcttttcttttcttttctttttctttttttttcctttttcttttcttttctttctttcttcttttttttttttttttgagacagagtttcgctcttgttgcccagactggagtgagtgcaatggtgcgattgtggctcaccgcaacctctgcctccctggttcaagcaattctccttccgcagcctcccgagtagctgggattacaggcatgcgccaccacgcctggctaactgtatatttttagtggagacggggttactccatgttggtcaggctggtcttaaactcccaacctcaggtgatccccccacctcggtctcccaaagtgttgggattacaggtgtgagccaccgttcccggcatctcaggtccatttctaggtcttgccttgccttacttgaattaggtaatgaccttatatgtgggggaagagatgatgtggacagggatatatggtctaacattcacagtgctcctactgcttatcagatactgtgcttggttcatttgtgtcatattatgttgtgttttccataacacgtaaggcattccatgtgcaagacactgtgttaagtgccttatcaagcaacatctaatttaatccttataaaaacaatagaaaggcattattatctccatatagaagctgaggctctaggttattttctttgtatcatacaatgaggaaatggcaaaagcaagatttcaactagggtctcaatgactctgaacccagttttcttacctccgacattagcacttactgtattttttttttttccaacttttattttacattcaaagggtacatgtgcaggtttgttacatgggtaaattgcatgttgcagaggtttggtgcacagataattgtgccacacagataattggcataatacccgataggtagtttttcaagcttcacccttttcccaccctcctccctcaagcaggtcccagtgtctattgttcgtttctttatgttcacgtgtactcaatgtctggctctcacttattagttagaatatgcgatattaaggccaggtgcggtggctcatgcctgtaatcccggcactttgggaggccgaggcaggcagataacctgaggtcgggagttcgagaccagcctggccaacatggtgaaaccctgtctctacaaaatataaaaattagctgggcgtggtggcaggtgcctgtaatcccagctactccagaggctgaggcaggagaattgcttaaacccaggaggtggaggttgcagtgagccgagatcgtgccactgcactccagcctgggcatcagagcgagactctgtctcaaaaaaaaaaaaaaaaaaaaaaaaaaccaagcatgtagtatttcattttttgttcctgtgttaattggcttaggagaatggcctccagctccatctatgttgctgcaaaggatacgattttattctttttttattgctgtgtagtattccatggtgtatatgtgccacattttctttatccagtccactgttgatgggcatctaggctgattctatgtctctgctattgtgactagttcacttactgtattgtctcattgatgagcatctacgtgtctctgctattgtgagcagcgcacttgctggattgtcctgttgataggcatctaggttgagtctgtgtctctgctatggtgagtagtgtacttacagtattgtcttgttggtctgtgcatccctctcacctgtgagcttcctgatctcgtgcactctgtgttatgtctggatcccgatcttcactttagaaccttgcatagagcaggttctcaaaaactgtttacagaattaaagaatctttatagcaatgtcagaaggtgagtattttctttccgttttacacatgagcaaatttaggcttaagaaagttaagcaaattacccaaggccaggaagtagaattcatgaaatataatccagaaatttccaagagaattgagaaagatattctctaagctaaagaggagggtttttgttatttttcggcattctaatataggtagtttatgtggaaacatggaagtaatttaccacctttcttaatgaaggccctactaggctgggctatcatgaagaaaacagcacagacatttttatgaaagaaaactacatctatgttactgcatctgtatttgagctccttataacatgtaagcaggcagaacattgtttaatgttgctggacaaagctcaagtgaaaatgatccagtggggaaatcttttatggaaattaaactgattgttttggaatgtaagttgcaatttttcacttcttagtttctgctctcttgagtccttgtctatgtcatgaacacatttgatacggaatcctggggactttgcccattgtaaggagcactgtagtggaaggcagtcgagctcaatgtatagagagaggcagcaaggtgggtaagtagaggcagcacctgggacccagctagatggactggtatctctaaagagtgcctcaaggaaacacatttcctggagcacttcagaacatgagagctgaggccaggatctggtgcagctcactctatctgaaagcactgagattctgttaagctaatgatgagttttctcttcatctttcctcccaacaccaagaccaagcaaaaatgcaagggaacaaagaacaagaagcagtgtccaaagtcttcagagtctctaggatagttgttgacctaagtcacactgctgtcatcctctgggctgcttgtacttttggagtagtcactggcagattaataagtttcctgaaagttaacagaaaataccagcttaaagtagtactaaagttttcaaaaaatttttttggggggaggatgagagggtgaaatatgatagtcaccctgatgtactcatggaagcatctaggttgtgttattagttaaaattcccagccatgaagacaagaatacatggaattcacccatgtgttcacccaacctcccatccatccacctatccatccatttgtcatccatccattcatccattcttccatccatctatccattaatacatctgtccgtctacctactcatctgtccatccgtccatccatccacctactcatctatctattgtccatccattcatccatccacttacccatctatccaccatccatacacccacctatccatccacccatccatctactcaccaatctatctaccatccatctatcaattatccatccacccacccatccatctacttagcaatctatccaccatccatacacttcacccatccatcaattcacccatcaatccatttacccattcacccacccaccatccatccatctatccatctatccaccatccattcatcaatttaccctatatccaccattcatatacctactctttgatccatccacctaccaatctatccattcatccatccacacacccacctattcatctatccatccatctacccatctgcttaacattaaccaagcatacataatgtgccaggcattgtctagggctaccaacacttggttcttaggaaattccaagactgcatttttttgctataaaataattttggaagtcaaatttgcctgaggagttttgttaaagtgaagcaaaatgtaatatgagtttatatagattttggctcttacataactatacttggcattgaaaactacgcaacttattcaggaataggtggtgtatggtacaagttgctgtatcatgcaaaaagatgggctgcaagaaacagtttttgtttaggctttgtttttcattaaaatctgtgaaattgttgagctcaagttgttgttttgcttggtcaggtgttgctagtcagctaaaaataagtctgtatcagtgatcgtcttagattctaagaaaactcagatgtgagggaaattaatgtgcttgcactttttgttacatgacaccatgttgaacatgcgtagagttttgtgaacagaggtggtagagcgtgttggtaagagttgcatagttggtaaaagagttttaaaatgtgtttctgattaatttacataaataatttggggccaaaaaccttctttccctccactcaacaccatatttttgaaatcccttcatgttgctctatataaatctagttaatttctgattgtgtcctaaagtcaacgtatgcataaaacacaatttgcttatccattccttgagtggttattgtataggaacatcaaagtctgtgtcgtcacaagcaaaactatggtggacatcctaatgcatgtgttgttatggccttgtgcaaatttctctagtgcacgtatatatccagatatgggattgttgggtagatgaatagttaattgcactgagtactgagaaattgttacttagaatggctgcttggtttacactttttactagcacttgatgttctctggcgttgtaatttttaccaatctgatggctgtaaagtggcatatcattgttgttttgatttgcttttctctgattattactgatgttgagtatctcttcatatacttattagccattagtgtttcctcttctattaattttattttcgtaggctttgcccatttttttctattgggtttcctgaaattttcttgctattttcaggagtttctctcaatattaatgccagtttcattttacacactgaaaatatcttctcacagtctaccaacgtgttaaacgtgtagatgatgtccttttctgagtagaaacctcaattgtaatcttgtcaaacacttcatcttttcccgttatggcttgttcttttaagtcttgctcaagaacctgctcaattctaaagtcacaaagatatttcccacattttgtttgattacttttatgatttacctttcacattcagatgtaaaggaaaaaatccaatttaatccttgtcatacagtaaaccatcctcccccaaacctaccaagttatttattctttcccaactgggttaagacaccatgtctcctatgtatgtggggatgtttctggaatctctatactgcttcaatgatctatttagctgttcctaagactgtagcacagttttttattattatactttaagttctggggtatatgcgcagaatgtgcaggtttgttacataggtatacacgtgtcatggtggtttgctgcacccatcagcctgtcgtctaaattaggtatttctcctaatgctatccctcccctagccccactgacaggccctggtgtgtgatgttcccctccctgtgtccatgtgttctcattgttcaactcccacttatgagcgagaacatgcggtgtttggctttctgttcttgtgttagtttgcagagaatgatggtttccagcttcatccatgtccctgcaaaggacatgaactcatctttttttatggccacatagtattccatggtgtacatgtgccaaattttctttatccagtttatcattgatggcatttgggttggttccaagtctttgctattgtgaacagtgctgcaataaacatatgtgtgcgtgtgtctttatagtagaatgacttataattctttgggtatatccccagtaataggattgctgggtcaaatggtatttctagttctagatccttgaggagttgccacactgtcttccacaatggttgaactaatttacactcccaccaacagtgtaaaagtgttgctatttctccacatcctctctagcatctgttgtttgctgactttttaatcgccattctaactggcatgagatggtatctcattgtggttttgatttgcatttctctgatgaccagtgatgatgagcattttttcatatgtttcttggccacatacatgccttcttttgagaagagtctgttcatatccttcgcctactttttgatggggttgtttgtgtttttcttgtaaatttgtttaagttcttcctagattctggatattagcccttcatcagatggatagattgcaaaattgtctcccattctgtaggttgcctgttcactctgatgatagtttcttttgctgtgcataaactctttagtttaattagatcccatttgtcaattttggcttttttttgccattgcttttggtgttttagtcatgaagtctttgcccatgcctatgtcctgaatggtattgcttaggttttcttctagggtttttatggttttaggtcttatgttaaagtctctaatctatcttgagttaatttttgtataaggtgtaaggaagggatccagtttcagccttctgcgtacagtagccagttatctcaacgccatttataaaatagggaatcctttccccattgcttttgtcagatttgtcaaagatcagatggttgtagatgtgtggtgttatttctgaggcctctgttctgttccattggtctatatatctgttttggtaccagtaccatgctgttttggttactgtagcgttgtagtataatttgaagtcaggtagcatgatgcctccagctttgtacttttgcttaggattgtcttggctctgcaggctcttttttggttccatatgaaatttaaagtagtttttttccaattccgtgaagaaagtcaatggtagcttgatggggatagcaatgaatctatccattactttgggcagtatggccatttccacaatactgtttctttctatccatgagcatggaatgtttttccatttgtttgtgtcctgtcttatttcgttgagcagtggttagtagttctccttgaagaggtccttcatatcccttgtaagttggattcctaggtattttattctctttgtagcaattgtgaatgggagttcactcatgatttggctctctgtttgtctgtacttggtgtataggaatgcttgtgatttttgcacattggttttgtatcctaagactttgttgaagttgcttatcagcttaaggagattttgggctgagatgatggatggggttttctaaatatacaatcatgtcatttgcaaacagacaatttgacttcctcttttcctaattgaataccctttatttctttctcttgcctgattgccctggccagaactttcaacactatgttgaataggagtggtgagagaggacatccttgtcttgtgccggttttcaaagggaatgcttccagtttttgcccattcagtatgatagtggctgtgggcttgtcataaatagctcttatgattctgagatacgttccattagtacctagtttattgacagtttttagcatgaaggggtgttgaattttgtcaaaggccttttctgcatctattgagataatcatgggatttttgtcactggttctgcttatgtgatggattatgtttatcaatttgcctgtgttgaaccagctttgcatccccgggatgaagccagcttgatcatggtggataagctttttgatgtgctgctggatttggtttcccagtattttattgaggatctttgcatcgatgttcatcagggatattgacgtgaaattttctttccttgttgtctctgtcaggtttttatatcaggatgatgctggcctcataaacgagatgggaggattccctctttttctattgtttgcaatagtttcagaaggaatggtaccagctcctctttatacctctggtagaatttggctgtgaatccatctggtcctggacttttttttggttggtaggctagaaattactgtctcaattttggaacctgtgattggtctattcagagattcaacttcttcctggtttagtctttggagggtatatgtatccaggaatttatccattttgttctagattttctagtttatttgcgtagaggtgtttatagtattatctgatggtagtttgtatttctgttggagcggtggtgctatcccctttatcattttttattgtgtctatttgatttttctctcttttctgtattagtctggctaatggtctagtttgttgatcttttaaaaaatcccgctcctggattcattgattttttttttttttgaagggtttttcgtgtctctctctccttcaggtctgctctgatcttagttatttattgtcttctgctagcttttgaatgtgtttgcccttgcttctctagttcttttaatagtgacattagggtgttgattttagatctttcctgctttctcttgtgggcatttagtgctataaatttcgctttaaacactgctttaaatgtgtcccagagattctggtacgttatgtgtttgttctcattggtttcaaagaacatctttatttctgccttaatttcgttatttacccagtagtcatttaggagcaggttgttcagtttccatgtagttgcgtggttttgactgagtttcttaatcctgagatctaatttgattacactgtgatctgagagactgtttgttttctgttcttttgcatttgctgaggaatgttttacttccaattatgtggtcaatttgagaataaatgtgatgtggtgctgagaagaatttatattctgttgatttgtggtggagagttctctagatgtctattaggtctgcttggtccagagctgagctcaagtcctggatatccttgttaatcttctgtctcattgatctgtctaatattgacagtggggtgataaagtctcctactattattttgtgggagtctaagtctctttatagatctgtaagaacttgctttatgaatctgggtgctcctgtattgggtgcatatatatttaggatagttagcttttcttgttgcgttgatccctttaccattatgtaatggccttctttgtctcttttgatctctgttggtttaaagtctgttttatcagagacaaggattgtaactcctgctttttatttttgctttccatttgattggtaagtattcctccatccctttattttgagcctatgtgtgtctttgcacatgagatgggtctcctgaatacagcacaccaatgggttttgactctttatccaatttgccagtctgtgtcttttaattggggcattttgcccgttcacatttaaggttaatgttgttatatgtgaatttgatcccgcctttatgatgctagctggttattttgcccattaggtgatggagtttcttcatagtggcaatggtctttacaatttggtatgtttttgcagtggctggtaccggttgttcctttccatgtttactgcttctttcgggaggtgttgtaaggcaggcctggtggtgacaaaatctctcagcatttgcttgtctgtaaaggattttatttctcctttgcttacgaaacttagtttaactggatatgaaattctgggttgaaaattcttttctttaagaatgttgcatattggcccccactctcttctggcttgtagggtttctgccaagagatctgctgtttgtctgatgggcttccctttgtgggtaactcgacctttctgtctggctgcccttaacattttttccttcttttcaaccttggcgaatctgacaattatgtgtcttggggttgctcttctcgaggagtatctttgtggtgttctttgtatttcctgaattgaatgttggcctgtcctgctaggttggggaagttctcctggataatatcctgaagaatgttttccaagttggttccattctccccatcacttttaggtacaccaatcaaatgtagatttggtcttttcacatagtctcatatttctcggaggctttcttcatttcttttcattcctttttctctaatcttgccttctcgctttatctcattaagttgatcttcaatatctgatatcctttcttccacttgatcaactcagctattgatcctttgaggagaagagatgttctggtttttggaattttcggtctttttatgctggtttctccccattcatggatttatttacctttggtctttgatgttggtgactttcagatggggtctctgagtagacatcctttttgttgatgttgatactattcctttctgtttgttagttttccttctaacagtcaggaccctctgctgcaggtatactggagtttgctggaggtccactccaaaccctgtttgcctgggtatcagcagcagaggctgcagaacagcaaagattgttgcctattccttcctctggaaacttcctactagaggggcacccaccaggtggcagccagagctctcctgcatgaggtgtcttttggctcctactgggaggtgtctcccagtcaggatatgtgggtgtcagggaacaacttgagggggcagtctgacccttatcagagcccagatgctgtgctgggagatccactgctctcttcagagccatcaggccaggacgtttaagtctgctgaagctgtacccatagctgccccttctcccaggtgctctgtcccagggagatgggggttttatctgtaagtccttgactggggctgctgccttttttttcagagatgcccttcccagagaggaggaatctagagagagagtctggccacagtggccttgcttagctgcggtgggttctgcccagttcaagcttcccagcagctttgtttacactgtgagggtaaaaccgcctactcaatcctcagcaatggtggacgccccttcccccaccaagctcgagcattgcaccttgagctcagactgctgtgctggcagtgagaatttcaagccagtggaccttagcttcctgggctccgtgtaccagtttttgaaattattatggcttagtaataggtcatggtatttagtataatgaatccttctccaatttttcaaaactaccttagatattcatgctttttatatttttacatacattttaatatttgtcaaagtcctcaaattgtgctggaatcttcattttttattttttattatactttaagttctagggtacatgtgcacaacctcctggtgtgccgtttgctaaggccgttagaaaagcgcagtattagggtgggagtgtcccaaatttccaggtaccatctgtcacaacttccctttgctaggaaagggagttccccgaccccttgtgcttcccgggtgaggcgatgccccaccctgctccatgggctgcacccactgtctgacaagccccagtgagatgaacccggtaccccagttggaaatgcagaaatcacctgtcttctgcatcactcacgcggggagctgcagactggagctgttcgtatacggccatcttggaacctcccccactggaatctcgattggaactgcattaaatccatggattaatgttgggagaaattaatattcttacaatgttaagttatcctattcatgagtacggtgtttgtcttaacttattgaggttttttaaaatgttctttataagagctttacttttctccatgaagttctagtgcattcatttttaggttaatttcttgatatgttatatatataacagagtgtttaaaaaatgatctaactatatatatgtaaacatgatagcaactacatatagttatataactataactatatatagttacatgactataactatatatagttatataactataactagttacataactataactatataactgtatatagttatataactaactatatgtctgactatatgaatatgtaaaaataggtgtatatatatataatcctaacaatatagttatatctatatatctataactacatatctatatatctgtaactacatatctatctatagatatataactacatctaactatatatagttatgtaattatatatctaagtataaaatcatatatagttatataactacatgtaactatatagttttatatatatatagatatagcaactatatctatatataactacatatatagatatagttgttatcatgttttaagcactctgttccatgcctggtatgtagtgagtacttaataaatggtacttactcttatttttgtaactattataagtgggggaaaagcaaagagggatactctccaaatgtctttaggagtcgtcatgatatgctggaaataacatggttgtggaatcattctcatgtgggttctggtctgtctccaccattaactgtgtcactttgaacacatttctcaaacttatacaatgggaatgatgcttatcctactggtgttctaggtatggtgagaagataaaatgagatcacaaactagtaatgaatactatgattggcacacaaaagcactcagaatgcaggtccttttcttctctagtgaagatctgataagtttgtcaaacagcaacaccattcccccacaaaatactcttttcttcatttgaagtccatttccaaaatttgtcctttcagatggatacagagagcaggtacacagattaagaaaaattgaaaaatttatccttccaagcatccccttttcaaagacacctttggtttttcatctttagaatgtaaactccttgaggacaggaagtgccaggaactccacacatccattcctgtcctgtggtttacccatgccagtcatggtaagcccatcacccttgtcagtgattggctcagggatgggttaagcccatgccagtctgggccagtgagattctaggaggaacttgatgaccgcttctggagaaggacatccagttttcctctttgacatccagttttcctctttgactgtatgtgagttaaagaggcccatgccccagtttctgctggcagtcaccttatatcagtgagggaagccagccttaagatgaagcccacattgtggaaatagagacagggtgccatgagcagagaaattctgggtttctgatgtcagcattgagctgctgaatcaatcaatgaagacaccttcccctttcaatgctctattatcataaataatgctctttttgatttagtcagttgtttttttttgttgttgttgttttttgagacagagtcttgctctgtcacccaggcttgagtgcagtggtgtcatcatagctgactgcaactttcaactcttgggctcaagcgatcctcctgcctcagcctcctgagtgactgggactacaggcatgagtcaccatgcctgggcaatttttaatttttattttgtagagacaggagtctcattctgttgcccaggctggtctggcattactgatcttaagcaatcctcctgcctcagcctcctgaagcattgggattcctagcatgaaccactgtgcctagccagtttagttagttcgagtaagaatgtcttttatttgcactctaaaacatcatagtggattcagacctaaagtctttgtcctgagcctgcaaataattgaggcttaagaaatgtatgatagtgaacacgaacgtgggaattatactggctttgtagagtgtagtgcattgcataatactgtgttctgtagattctttgagcttcctaatggccttttaatacagaatgcaattccttttcctctttagtgaagatacggatttactctcatctgtctctttcaggtgaggtaactgaggatcaaagagggtttgtgatatgctgaaatttgaatagatagctaagcagtccagttgtgataagaacctaagtcttttcactccttctttggtacattttctcatatgctcaatccccactaggctgtgagagccttaagggtgaaagctacaatcttacatatttttgtcaccagaatgcctagcagacagcctgtttcttttgggtcacaagtaatagaagaataaacacataaatgacttgttatatcttgaaagcagctttcatgtaaaggcagagggaatgatacctccttccaaagtgttttaacaatgtccagtggtgacaatgtcccatttcaaaggcaatagtcctgggtgtgttttgtccttggtatatctgtagatccagccttttagcacaggtataacaggcaatgatgccattgcaaaggctgtactgactagtgaattctttcagacacagaggaggaaggagtcaaacagcaaagtcagaagaggtagtttagagctgtcatcccgggtgctcctgggaggaatttgcacttaacacgtaaatcaggttcagggtctgtctaattaatacaacgactttagtgccatttgcttccccgtcagaattcatactgaattctgacacatggtcattgggtttatcaataatgtgccccataaatccagttagcattttcttctgggtgccgcaccttgggaagctgcttaaataccttgaaggtccttatctagctctggccttgaatctcaagaagggtcagaggcccttcaagctcttcactgagtatgacattactgctgtgatttgagtcctttgtgcctggctggaagatgttctggtgaaagatcttaaagcttagatgaggaggttacctcccaccaggctttggcattcttagaaggagtcctggtgctggggggagtgtctagatttgtcactggttgtttctgtttgctcagcatcacttcctttggtgaactgcccctcacctgtgcaacatgactctataggcctgccatctatgaaactctaccccaggctgcagagctgggtctgtaactcaatctggtcaatccaagcgctctctctcctgggaatctgattcttgagctgagacacacaagggtggaggtgatttatgcaaagccacttacttctgaggctgttcatgagtctctactttcaaactccccttcatttctatgaccttccaaatatcccttcaataaatatttagttcttgtttgcatgtgttagggtaggtttctgttacttgcttttaaatacctttaagttatacagatgtagatagtacatgatagtttattatttttgtttcccaaaatgaaaatacgtttgttgaatgttctagtaatggtggtgctattatcttcttcttattaatatcttattaatatatatcatatattattatataatatatattatatataataatataatattaatatataatatataatgtataataatatataatatataatgtataataatatataatatataatgtataataatatataatatataatatataatatataataatatataatatataatatataataatatataatatataatatataataatatataatatataatatataataatatataatatataataatatataatatataatatataatatatatagtataatatataatatataataatatataatatataatatataataatatatatagtatatataatatataataatatataatatataatatataatatataatatataacaatatataatataatatataatatataataatatataatatataataatatataatatataatataataccataccaaatgtgtatggtaatacatacaccatacactaaatgtgtatttaccatacaccataatatataatatataatatatataatatataatatatattatataatatatataatttatatattatatattatataatatataaattatatatattatataatatataatatatgttatataatatatgttatataatatataatatatgttatataacatatatattatatattatatatattatatattatattaataagatatatattgtggttatatataatatatattatatataaccacatttggtgtatggtaaatactcaatacatgtcaggccctgattgttacatgttttggctaaaaaagaaatgtggtttcattgagctgatataacttgcttaagagaaaacagctggccaggtgtgatggctcacgcctgtaatcccagcactttgggaggccaaggtgggtggatcacttgaggtgaggattttgagaacagcctggccaacatggtgaaaccctgcctctactaaaaacacaaaaattagccaggcgtggtggtgtgcacctataatcccagctactcctgaggctacggcaggagaattgcttgaacccaggaagcggaggttgcagagagctgagatcacgtcactgtattccagtctgggtgacagagcgagattgtctcaaaaaacaacaacaaaaaaagcaaacagctatgatacaatgggagctggtattaaataaaataatgcttgtgaagtgcccagcactgagcctggcacatatagcattctattctttatttattttattgtattttattttattttttgagaccgagtcttgctctgtcacccaggctggagtgcagtggcgcgatctcggctcactgcaacctctgcctcccggagccattctcctgcctcagcttcctgagtggctgggattacaggtgcccgccaccacgcccggctaattttttgtatttttagtagagacggggtttcactatgttggccaggctggtctcgaactcctgacctcgtgatctgcccacctcagcctcccaaagtgttgggagtacaggtgtgagccaccgtgcctggtctagaatgatctttaaattgcagctgctgttattcttttaagcggctcattagcccacatttgggagggaggtgtgtagaaacaatgccgcaggaaaaactcagatcagttagtcagtctccccttcctctgctatcgcctcatatgtcttccttttcctcccccttccagagtccctatcaggccccattccagataatccctgctgctctgctaagtgataactgagctattagctggtgtttaagataaagcctttcctaaaccatttgcatttcagtggggaaattcctgagaacctagtggctccctcattcaaagcatttagggggcattgctttctcctctagggagaccgtgaagatgtctctttggaagagttactcatccgtgctgaggtctcactaattaacatcttgcctcaggagggccagtgtgcctgaacaatgctttctactgatcagttctatagtgggttaccacaggcactgtatgattgccacagtagggggaaccatcgtcaagggcagatccttatggaattggaatattgcaatataggggtatttgtgtatgtgtgtgtgtgtaataaataatttagtcccaggtagtgccattcagtatattaacacatattatttatttctgttttcacagcagtcctaaaagttccgtattatttccccactttgcagatgaagaaattgaggccctttagtgggtattggggctctgctgttttccctcatccaacattctccttcccccttcttttgttattagcatatagctcacagtatagttgggatttgtgttcctgcccaaatctcatattgaaacgtaatccccgatgttggaggtgggacctggtgggaggtgattggaacatgagggcaggtgtcacatgatggtttagcaccatcgcgttggtgctgtcctcacaatagtgagttcttgtgagatttagttgtttaagtgtgtagtacctcccccttcttctcttgctcctcctttccccatgtgaccttcaagatccctctctgccctccgccatgattggaagtttcctgaggcctctccagaagtagatgctggtgttatgcttcctgtactacctggagaactgtgagccaattaaacttctattcttataaattacacagtctcaggtatttttttttaaatatagcaatgtgaggatggactaatacagctgatgtgggaccgatcctccctgctcttgtgtctgagaactgactaatctaaataatctacaccactggccactgggattggttcaggagtagacatatgaggccactgagagccagacttgggacttttgtaggagatgtaggaatgtgccttttctgacttagtggggctaagaaagcagaatgagcctagaggagacaggggcagtctttgcctacgtgagaataaaaccaacaccaaggaaacagaggtggaaaaagaaagcgtggtttcagttgttacaacatgaacatctgaatccagacgtgcccaacgctagaatattcctgggcttttcggtttgttgatccacacatcctgtttcatgcttaatccaatctttgatctgggtattctgtcacttgtaactgaaagaatcttcatgaagacagactcggagtgttaaggaatcaatgttagtgtccctgaaaaactcatacgttgaagccctagcccccagtgtgatggtttttggaggtggggcttttcagcagtaattaggttaagatgatatcatgagggtaaggcccaaacaatgagattagtgtccttataggaagaggaagagaccagagctttctctctacaccacgtgaggacacagtgataaggcagctgtctgtaagacaggaagagagccctcactaggctcactttggcaccttgatctcagattgtcagcctccataactgagaaatcagtgtctaatgtttaagccatacagtttatggtattttgttatggcatcttgaattgactaagagaggataagtgcctcgtgtaatgtcacacaactaataagcagcagagctgggatttgaactcaggtgttgctgacttccaagtccatgaagtctccacggaaatatgagctctggtggcaaaagaacggatggagcagatgccaacattagtttcagcctggagaagaaaacctggtgatatggtttggctgtgcccccacccaaatctcaacttgaactgtatctcccagaattcctatgtgttgtgggagggacccagggaaaggtaattgaatcatggggacccatctttcccttgctattctcatgatagggaataagtctcacaagatctgatggttttatcaggggtttctgcttttgcatcttccccattttctcttgccaccatcatataagaagtacctttcacctcctgccatgattctgaggccttcccagccaggtgccactgtaagtccagttaaacctttttttcttaccagtcttgggtatgtctttatcagccgcatgaaaatggactaatacacctgggcttgcaaggggtttggtagtgggctcggggcagctaggttacctggaaaggaaagagacggcctttgaaatacaacctaattcacttcaccactttacttagttgagtgttgcttgaacttctgttgctaaactaactaaaaattgctgttttttagtgcttaccagatgggaagcactgtactaatatctttgcaaacatcatctcgttcagtcatccaaatcaccctaggaaagagataccattatctctttttgaatgactttgccagagttacacagacagtcagtggcggagctgggatgaaactgtttaggactgagtcgtgttcccccaaaattcatatgttaaaaccctaacccccaatgtaactgtatttgaagagattaccttcatagacttaatcaacgttaaatgatgccattatggtggggccctaatccagtaggactggtgactttccaagaagaggaggagacacccgagttctctctctttccttgcacacacaaagaaaaggtcatacactcagcaagaaggcagacatccgcaagggaggaagagagatcacattagaaacttaattttccagcaccttgatcttgcacttcttgcctctagaactgtgaaaaaattaatttctgttgtttaagccactcaagttgtggaattttattatggcattccaagtagactaacacagaacccaagcctacctgggttcaaatctcatcttcttaaccaccacatgggattgctaacatccacctacccatgcacaaaaatttaacatatgaaaagatctttacagagcgtggcctgggggtggggctgcttcttcaaaagggctagaattggtcctggagtcctaaagctagaaggataagtgcaaagtcatatctacttggcagaatgaatccaaacctttcagcaggtgcaaactaatgttttcagctctgccatcctttctgtcgtatgggctagaatataaaacagctcagcctcatcaagagagtacaatgaaactctttgctgggaaaaggatagctttatttctgttaaagggccacattgagagcctcagaagcaactctccttgcaggacaaaggaaaaatattagagtgatgaattagttccttacaacccaatgacagactggtggataaatgcagtgacagaccccaaattttatctttctgcaagtctgccccaaataaaaagcccttatccttatagacactctctgaaaatgggattaaaacatagcagaatgccccactgtctgggtgacatttgttattattattgctgttaagtaagagccagggtttaggtgttaaaacccaagtgtgcggtaattacggtaccactgaggctcagcacaatatgcttcctgtgtctctcttgttttgatagctggctatattggcaagaggcatataccactggggctcaataaggtttagggctgtcctgttctgactaactccctttgtggcccaaataacactataaaaatcaacatgggaaaccttccttttttttctcctaagaaacgcctgcacaaaagccttatttttctgccttgaaagtgtttttaacttaaacgccaatttaattctggaaattgtctgtggagggccaagtgcattattatactctctgttatgatgaggataggaggatgcaggaggtgccatcagtggttatgacatctacatctttgaatcaggggttgtcaacactggtcatacatcggaatcaacttgggagcattagaaaagtactgatgcttgggtcctaaccgagatattttgattttcttggtcctggggtgcaggctgaccaatgggattttatttaaagtgtcctgggttattctgatgtgcagccgtactggagatccacttctttaaaccagttttagagttcagcattttccccataaacagcttaaagtataggaagtaaatggtatatgctatggtttggatgtgtttgttgttgttgtttgtttgttttttgagacggggtctccatctgtcacctaggctggagtgcaatggcgcgatctcggctcactgcaacttcggcctgccgggttcaagtgattctccagcctcagcctcctgagtagctgggattacaggcatgcaacacacacctggacaatttttgtaattttagtagagacagagtttcaccatgttggccaggctagtctcgaactcctgacctcatgtgatccatcttcctcggcctcctaaagtgctgggattacagcggtaagccactgcacctagcctgggtgtattttttttccccctgaaactcatgttgaaatttgattcccagtgtagaggtattgggaggtggggcctagtggaaagcatttgggtcatggggtggatccttcatgcatggcttggtgctggtactgcgatagtgggtgggggctggctttggtgagactggattagttcccttgagtgtggattgttataaagcaaggacacccctcatgttttccctctttgcacgtgtctgtttcctttttcaccttctgccatattgtgttgtggtgcaaaagccctcaccagaaacagatgccggcaccatgcttctttaacttcccagcctgcagagctgtgagccaaaacaacctttttactttataaattccccagcttcaggtattctgttacagcaacaaaacatgaattaagacagtgtctgtgctgtgtagataaatgtactgtgtgacttttgacaaattacttgacctctttatgtttcctcaattttctcgcctatacaattttggtaaaagaaatgcctaattcataagtttgtggtgagggttattaaatgaagtaattaatgtgcctggcagagaatacacatttgataaatgttggctattattattactgctattgttactatcacctgttagatgataaaccagaaactagtaaactagaaactagttttatttaaaaaaaggagggggctatttactgattcatgtaaacaaatctacgaaggggtaagggtagatctggtctcaggacaactgggtccatggactcaaaaccatccattgtttcttgctgtttctcattttgcttccttctctcatgttagcttcaggcttggggaccagcttttctgcataggaagaagaggcattatatcagactgacctggcacacattttatgtccagaaaggaaaaagggattttctcaccaggttctgctggggaaaaagacctgaggaaagattgtccagaattgagtcatatactcattagtgatctgtccactgtggctatggaggtgggatcttctcccagagggaggaaaagtgaggtgcctagaagacaaaaataacaaccgctacaatgatgaaaaaccagttctaataagaatgactatcccttccacaaatatttattaagcatctaacaggagccagacatggttctatatactactttataagatgagaaatggacattccattaaaaaaataccgaagtatagtttcgtacagtaaacttcacccattttttgagatataattcacatacagtaaaattcgaccttttaaagacatgtaatattttatcctttttggtgctatagtagaggtagtaaattttggaattgggaagtgttaggccttcaactttctttttttttttttttttgtaaaatttgacaaataatcatgtttcactaccacaattaagatatagaatatttcaattatcccttaaattgtcttgtgtgtctttgaagtccacccctttgtcttctccctgcctatggcaaccattgatctgtttttttgccactctagtttgccttttgcagaatgtcatttaaaaggaatcatacagcatgtggcctcctttcacttagcatttgagattcatacaaatcgttgtgtatatggatagcttcttcctttttattactgagtagtagtccatggtataggtatgctgctgtttgtttatccattcaccagctaaaggatatttaggttgtttccaagtttggagtgattgtgaaaaagctgccagaagacttgcatacaaaattttgtgtaaacatacattttaatgtcatttggtaaatgtctgggagtgaggatgctgaatcatatggtaagtgtatgctaggctctataagaaattgccaaaatgttaaagtggctgtgacattttgcattcccattcacatgcatgagagttatggttactttaccttcttaacaacatacgatattgtcagtttttaaggagggcattctgataggtgagtagtggtgtttcattctggttttattaataactaatggtgctgagcttctttttgggtgctaatttgcaattcatctgctttcttcggtaatgtgtgtgttcaaattgtgtgtccattttttgagttgcttgtttcttattattgaaatttaagtgtcctttgtatattctgtatataagtccagatatcaggtatgtattttgaatacattttttcccagtctgtggcttgccttttcattctgttaacaatgtcttttgaagagcagaaattttacattttggcctagtcaaattgatcaatttttaaaaattcatgaattatgtgtcgtatctaaaacacctttgcttaatccaagattagagagattttctccacttttttctagaaatgttataattttaggtctatatttgggtctatgatcccttttgatgtaattattgcagattatgtgatgtataggttgaagctcattattttgcttatggatgctgctgtgatttgaatgtgtcccccagagttcatgtgttgaaagctaaatccctaatgcaacagtgttgagagatgggaacttaaaagatcattaagaggctaggtgtagtggctcacacctgtaatcccagtgctttgagaagcccaggtggtgaatagcttgaggctggaagttcaagatcccatctcgacaaagcaaagcaaaacaaaacaaaacaaaaattgccaggcagggtggtatactcctgcagtcttagctattcaggaagctgaagtaagaggatctcttgagcccaggaattttaggctgcagggagctgcaattgcatcaccacactccaaactgggtgacagagtgagaccctgtctctaaagaaaaaaaaaaaaacaaaaaacgtgatcaggtcatgtgggctctgctctcatgaatggactaatgctgtcattgtgagagtgggtttgttattgtgggagtgggttcctgataaaagggtgggtttagccccctttcctcccctttttgtgcctgctcttttgtccttctgccttcggccacaggatgatgcagcaggaaggcactgccagatgtaggccccttcatcttagacttcccagcttccagaactgtgagaaataagccttgtttttaaataaactactcagtctcaggtattctgttacagcagcataaaacagactatgaaagatgttcaataattatttcagtataattgaattgcttttgcacctttgtgaaaaataagctgaccatatttgtgtgggtctatttctgaactctattctgttccattgatctatgggtttttttcttcatctatactatgtagtcctaattacggtagctttatagccaatcctgaaatcatgtagtatgagttcttcaacgttgttcatctttttcagaattatttttgaattctatttctgttgcctttctatttaaaatttagaatcagattgttggtttctacaaaaaaaaacttactgagggtttgatggaattgcattgaattagggagaattggcaacttaacaatattgaatatttcagtccatgaacacataataggtttctatttaggtcatctttaatttcttttatcagtctttgtagttttcaccacacagatcttgcacatatttttttctaaacgtttcatgtcttttgatgctatggtaaatgtaaattcaaaattagaaatataggtcctccagctttctttttttcaaagccgttttgtctgtttctggattctttgcttttttacatacattttagtattagctttctggaaaaagcctgctgagatttttataggagtggtcttgaatctatagatcaacttgagaagaattgctaaaaataatattgagtctttcaatccatgaacatgggatatctatcaatttatttaggtccttttacatttttgtcagtaatttttgtagttttcagtgtacaagtcttgcacttcttttgttaaatttattcctattttattccttttgatgctgttgtgaacagaattgtcttcttaatttcattttcagattgttcattactgatatatagaatacaattgatttttgtgtattgattttctatttcttcttgagtgtgctttggaagcttatgtttttcaagtgatttgtctaagtggttgaatttattggcataaagtcgttcataatattctcttgttctatcttaatgtctgcattatctatagtggtgtcatctcttaaattcttgcttttgataatctgtttcctctcattaatcagtctggctaacggcttattaaaattattgattttttaaattatactttaagttctgggatacaagtgcagaatgtgcaggtttgttacaaaggtatacacatgccatggtggtttgctgcacccatcaacccatcatctacattaggtatttctcctaatgctatccctcccccagccccccaacccctgacaggccccattgtgtgatgttcccctccctgtgtccatgtgttccccttgttcaactcccacttacaagtgagaacatgcagtgtttggttttctgttcctgtgttagtttactgacaatgatggtttccattactgggtatatacccaaaggattataaatcattctgtaaagacacatgcacacatatgtttattgcagcacaattcacaatagcaaagacttggaaccaacccaaatgcccatcaatgataaactagataaagaaaatgtggcacatatacaccatggaatactatgtagctgtaaaaaaggatgagttcatgtcctttgcagggacatggatgaagctggaaaattgatcttttaatgcaccattttttttctcaagtgtttttctcttttcaactttattgttctactcttatctttattatttactttctttcgcctgacttggattttatttcttttactttttttttctagttttttaaggtggaggcttaggctacgatttgagacctttcttattttcagacataagtatttaatgatacagaattccctgtaaacattgtttatctgtgttccacaaaccttgatatgtcaaaatttcttttttattaaattcaaaatatttcctaattttcattgtacctccctatttaatccacgggttgtttagaactatgttacttaatttgcaagtattttgatattttctagatatgtttatattattggtttgtaatttaatctcacatggttgcagaatatactttgtattatttcagtattttaaatttgttaaagttgttttatggcccagaatatcttgctgaatggttcatgtgaacttgaatagaatgtgtattctgttgttgttgagtggaacattctgtaaatgtcaattagataaagttggttcatagtgttgtatatccttgctgattttctatttcttctgtcaattactaagagacaaactgtgaagtctccaagtgcaaatgtctatttttttagttccataacttttttgcctcatgtgtcttgaagctcttgtattaagtacatatgtattttcaatggttatgtctttttggtgaattgattcctttatcattatataaagtccctttggtaatatttcttgttctgatgtctactttgatactaatataaccactccagatttcattttgttgtgttttaaaactattattttaaataaatacatggttttggatagcatttccatggtatttgtagtttcattcttttacttttaatgtatttatatctttatatttaaagtaggttccgtgtaggcagcctatagttgggtcttgctttttaaaattcaatctgtcaatctctgtcttttaatgtgtatttagaccatttacatttattatcattattaatgttgggttaaaatacaacatcttattagttgggaattattattgatgtgctttctttttgttacatctgaatcttctgtgattctccaaatggtctctgctgagctgtggcaaacagaggggaagaggttattccattctgaagagtgccagtgccagtggggtctctagtagaggtcagctatgcccagcctatggcactgccacctagatctcaagcagcagaaacagcaatgtggcagactgacaaaatggccagttattcaacaaatcccttgatgagtactgtctcattaacatggtagatacaatcattataccaccagtgtacagatgagaaaattgaagctcagagagactaagtgatctgaccaagattatgcagtggcagagctaagatttgagcccaggtccatctgaatttgaagtttaacatcttattcactatgtggacaggctatagatacataatttgaaggcatacgttaatgatcttaatccaaattgttatcaatatgtaagttgaaggatgtaattacattttcaacctcgtgaggggtttgtgccttcaaggtaagataacacaaacctgttacctgttggatattatctatttaaagtggctatttttaaaaagatgaaagataacacatgctagtgaggatgtggagacattgagacccttgtatgctgttggtgggaatataaattagtacagccattatagaaaccagaatggagtttccacagaaaaattaaaaatggaactaccatatgatctagcaatctccctactgggtatatacccaaaggaaatgaaatcagtatgttgaagagatatctgcactctcatgttcattgcagcattattcacaacagccaagatacagaatcaacctaagtatccattaacagataactagataaaggaaaggtggttatgtatacacaatggaatactactcaaccttaaagaagaaaatgctgccatttggaacaacataggtgaatctggaggacattatgttaagtgatagaagccaggcacagaaagtcaaataaaacatgatcttacttatatatggaatcttaaaaagtagaatttatagaagcagaaagtagaatggtagttacacggggatgactgttggggagatgttggccaaaggaaacaaagtctcaagaggaatgagttaaagagatatattatacaatatggtgactgtagttaataacaatatattctattcttaaaaattgctaagagattagattttaagtgttctcactacagaaaataataagtatgtgaggtaatgcatatgataattagctcaatttagccattccagtgtgtacatatttcagaacatcatcttgtacatcataaatgtatacagttttatttgtcaatgaaaagttaactaattaaaattaaaaaaactggtattatttgcctttattagaaatccagtaattactgggagacaaggaaacataatcgagttgaagactcaatcaatttgtactgatgaattggccaagggacatttctgctaatttgcccatttcttgggtttgtagaaaagcagggtacagacgatcgcttcagtggagaaagaagctctctaaatgaagatagcaagtggtgaagcagagtgattctgacatctgctaactagataagtacaccgactccaccagctcattgctgtgctttcattctaccctgtggaatcccttttagccaatccttgatcaaataatgaacctattgcagaaataaaggggaagcacgtccatcactacctccctaactcagaaaaatcaagcttttttctgttctacactgtttcctgtcatgcgtaatatagcaaattaattagtggatctggcggcatttgctaatacaattcctctcccttgcttgaggtgaattatgttcatgcttcagtcacttgaatattactcttccatgtttgacggaattttgttatcaggtgactatattgcacactatctgattctaattaaaccagaaaatagtgacattgtacaagaggagaatgtttcacagtgtgcaccacccacccccttgtcgctacatcccagtttttagagctttttgagctgtgcttgggctattttcttatgtttacatcgtcttacgcttctccagacacaatggcttcttgggcattgccttcatctactaggtaatttgtataaattgagtcctggaagacataatgtttacacttgtctttttttttaatcagaagcataatgcacagtagcaaactgtgagtatttcagatgatatgaaagaagaaaatgtgctgttttgccaaaatcattcatgtaacttggaaagaaaagtttctgagagaagaaaaactaacattttagaggggaaacggagaaatgggctataaagatgaattggggaagcaatgtaatgtagaggttaagatcacaggcttgtagtgcagggcttgacttctggttctgtctttatctgacactatttctttctccttacacaataataagtgctcaggagttgatttgccgaaggtctaatgatgaggtagtaaaagaaccagggctggggctcccattccagttttcctttttttctataccctgttaaatgccaagccctgattctgccagggtggagagtgaaggggagtctctggagtcatcaattacagcaggtcactgggtatcagagtctcttttctcatgaggataaagatgtccttttgagttagactatattcacccttcatgaaccttggggacattgatggcagggagagttttctaaagctttagacaactcagaggtgaaataggcaccatgctgcaaatgaaaggcacttttatggttgtctgaaaaaaatacagcacactgctttaaacttagaaagcccaagtgcaagctacagtcaggtgtggtctgcaggctttggtcttttgtccctgttcaacagctggtaaagctgggagaggtaatcgctgatggagacttgctcctgttgggataatatttctcagaccatagtcctgccattttccagactttttcttttggagaaatgggctcctaccttggaagagccaattatgtaattcaggttgaacctggctcttttttttcccactgatctctatcttccttggtgaagaccacttggcctccgcctccctgttagatattattcttggcctatgtaagcagtggaaagcctgaattttgcccaggctttgggcaagatgaaatgacaccttctgggttggtggaaggaaagggctatttctttgggctacttgaaggacccagaaagcaaaagaaaaatcatgtctttctttgcagaatttctgctgtggaaagaggcaaagtcaatcaagagacagagatccttgacacatatgtattgaatatctactatattgcaggtcatattctgggtgctggggagatatctgaacaaaacagacaaaaatccctgccatgaggaacaaggaataggtgtttaatatggtctgtagaaaaagtacgggaataaaagtcccaaacctggcctttttactagtttatagtctagtggggagaaatagacttaagaaacaacaaaaagaggaacgtatatagtatattggaaggtgataagtttaatgaagtaaattaagcaaaggaaatagatagcaaaagcagagaagaaatggaggaggtttctatttaaaacagggaggtcagagaaggctttctgcaacagaagaattttgagcaaagacttgaagaggcaagagagtgaaccatgtagatatctgtgggaagaacattacgggaagcaaactcagcaagtggagaattcccagtatgttttaggaagagcaacaaggccaagtgtggtgggactagagagagagagcgagtacgggagagtggtgagaaatgaggtcgtcttcaatgattgtagtttgcttaacttgtggctgctggctagacaggatgaagtagtttgagttgtttaagaaggacttactaggtatgtgggatcagactagtgctaggctagaccccaggacaggaaagatgactgcattcaaggaccaagtagttcagttcaagattgaatattggcctgtatggaaacttagaaaacagtgaggctcaggtgtgttatatatagatatctgaaagaagagagaaggttgtagaggactggattggatataaggctctggaggcagactgcctgggtatgaatcgtagctccattacttattactggtgtgatcttgggaaaaccacttcaccgtctgaggatcagtgtttacatctataaaatggagttcacaatggaaggtacattgcaggggtgtgtgaggatttaagacagcacatgtttagcaagtgccatgtacatagtaagccctcagtaaatatgagctgacattcttattattcattgaggtggttagagaaggattctgtaaagcttgaaaccatggagttagtgatgtgccatggactgaactcaagggaatttctactagactgcccttaacttctcttagatggtgcttggatagattgcatgtgactgaaatagttttttggtgctggaagcatcataaggagataggaccagcggattagaaataaaggggtgatggttgtgcctttaccaacagtgtgttgctatggagaagaaggccctcaaggaaaaagaggaaaatgtgatcaaatacatcagcatggggttgaacaagagcagtgaggacaatgttcatagttgactgactagagtagtgtcaataagaatggcaatttattgagcatttgcacatgtcatctcacgtagggcttaccgtagtcctataaggtgggtactcatattatctttgttttgccacagaggaagtgaaggcttacagaagtgaagtgatatgctaaaggtcacacagctagtaagaggcatatctgggactcagctcaagggagtttccattagactgcccttaacttctcttagatggtgcttatatggcttgcatgtgactgaagtagatttttggtgctaggggcatcataaagagagaggtctagcagattggaaacaaagggataatggttgtgcctttactaacagtgcattgagctatgctcatttatgttcttatgatctcttagaaacagagacttggttctttcctgtcttaagaaggaaaatctgactgcggggtatggccatcccctaaaatatcaaaaagacatctatttccattttcttcctcctaatacctaggagacaacaaagtggatttccagtggtacttcccacatgagtagaatgaactttccttggtaaaagttgactttcttactaaaggacaaaatatataggctcctcaatttgagccatgggatttggtgggcagctggactgagcccaaagacatccccacagggaggcaaaactggctggtatatgtggaaagagtgagtggctcagggaatagatgctgtgagccaggttgtgaatttccagagcccagggattagagccacttgacattcactttaggtgaactgtgttgtcttacatcctatttttcatgaatacttttaaaatttttatttttttcttttaatttttttgacacagagtctctttctgtcactcaggctggagtgtggtggtgctgtctccactcactacaacctctgcctcctgggctcaagggattcttgtgcctcagtctgctgagcatctgggactacaggcatgcaccaccatggccagctatttttttttttttttgtatttttagtacagactgggttttactgtgttggccaggctggtctcgaactcctggcctcaagtgatctgcccaccttggcctcccaaagtgctgagattacaggtgtgagccaccatgcccagtctttcgtgaatacttttgatgtatggagtaactcataaatttttaaaaaatatttcaaattcctaactcttcttgaaacaataggtattatgggtggctagtttatttcttttcagttaatgattgaattcattgagcccttactaggtggtgagcactgtccgaggtgctgaaggaagagacaaagataggattactgtatctcagaagcttatattttagagaacaacaaagtaccatgtacattttaccatgtaagtttagcctgttatatatgaaaatgactttttacctaaaagtaatgagcacaagtcatgggttttaaaggtaacttgttcaattctgacattatactcttggtcaacccaattggtgaatcagtatttccttcaatagtcctgggataatgaagagttggcaaacatgttacataaaaatttaggaattaagaatattggactcttcctgaagataggatattttaaatgcaggactagagctcctgaaccatatattatagggaaaatctagagaaaaaataaaaggtatttatcaatgtttggttgtgtgatcttgggtagcttcttgtgcctcattgtttttgtcatttagaaaatgatagaattaatctgtacattgataatgaagtccctttaggttctagaattctgtaattttggtcttgaactgaaattaccatgacaagggattttgatagatgttgcctaattgctaaccaatgaaatgttttctacaactccacccctgctcttttggcattttatctttgttaagtgaaaaatgatatgtgttgctttgaactttattgctttaatttgttgcagaagttgagtggcttttcatatatattaaatttgattggttactttatttaaaaaattgtaaattgtatgattttggtatccaggtaagatactgtgaaagttaccttgtaattaagttcttgggtgatttattggaggccttaatattattataatagataatagggctgtctaaatgccactgtacttggttatcaagctcaatgccatttaaatttttttcaaaaaattttcaatgacattcttgttattgttaacagtttacttttttcccgtgattgaaaagactaacactcaagtttgaaagagaaatgttaattttcagggctgctgcaaaccttgaatttgaatcctaatcttgccacttactgcttgtgtgaccttcagcaaagtgctcaatttatagaacctcagtttaatcatctgtatattgggaataatagcaaaatctgcctcagagattattgataggattagctgaaataatgcatgcaaaatgcttagtttattgcctgaaaacttattaagtataataaatatttattattgtaatcaacagttgtactagagagctattgcacaataattatgattataatgaaaatgataattaataagacccccacagtttctgatttagaatgtgtctggggaagagcctgaggatgtgtctttctaacacattttggggtgatgctgatgctggtggtccaggcaccatgcttggagaactactgttctaagcatctgaacaatgtgatctcatttggtccttaccagatcactctaggaggcaggttcttttatgatggtgctttaataagtgagggattagggaggtttagtagctttcccaaagccccgcagcttggaagtggtggaaccaagagttaaagatttatgctcttctttccacctgtgattatttatgtggagttctaaaccattgatctcctgtatccacccccttgatgtcttctctcaccacctttcccgactctaagccattgccaattactatcaccatccccttgtccacactcgtgattcctgtgtccctctcttgcgttgtttgcttggcatggtcacaatcccggttaaattcatctctctgcctactctgtacctgcccttgagaaactgaacacggctggagaaacatacaaaactactccgaccttgccaggaacctcgaatgacccgttaacactgccaggagatcacactgcactttcctagcccattcattctgcatcttgctttttcgtttctttaaaaatttattttattgtggtgagaatgtttaacccaagatctaccctcttaggaactgtctaggtgtacaatacagcattgttaatgattggcacaaagttcagcagatctctagaacgtatttgtcctgcatgattgagactttattggttagcagcttcctctttcccccttcctccagcccctggcaactaccattctacttaatgtctctatgcatttgactactctaatttcctgccataaacaatatgatatatctgcacctacactcatgcaatatttgtctttttgtgactggcttatttcactaagcaaaatatccttatgattcatccatattggatattgcagaatttccttgtttttatttatttatttattttttgagatggagtctcactctgtcgcccaggctggagtgcagtggcgcgatctcagctcactgcaacctccgcctcccgggttcacgccattctcctgcctcagcctcctgagtagctgggactacaggtgcccaccactatgcccagctaattttttttttttgagacggagtctcgctctgtcgcccaggctggagtgcagtggcgcgatctcggctcactgcaagctccgcctcccgggttcacgccattctcctgcctcagcctcccgagtagctgggactacaggcgccagctaccacgcccggctaattttttgtatttttagtagagacggggtttcaccgtgttagccaggatggtctcgatctcctgacctcgtgatccgcccgcctcggcctcccaaagttaattttttatatttttagtagagatggggtttcactgtgctagccaggatggtctcgatctcctgaccttgtgatccatccacctcggcctcccaaagtgcggggattacaagcttgagccactgcacctggccatttgtttttaagtgtatgtatataccacattttctttatccattcatacatcaggggacatttaggttgtctccacatcttggctattgcgagtagggctgcagtatacattggagtgttaatatctctttgagatcctgatttcaattcttttggataaatactcaatagtgggattactggattgtatggtagctcaaattttttgagggagaaggaatctccataatgttttctatagcatctctcactttcttcaacacctattttacatgtctcttttcttctcaaaccccatctccttcccattcttactctcagctgatgaccatgtttctttgctctttcagagaaataaaggaaccagaagggaattcacactgactcccataatctcatctccccacattctggcatctgtactcacccactccaacctctcacctgtgcccataggtggaaggagggaaggaggttcacagtgagtgtctggagagctggcgatgttctgtttcttgagttgggttctggtagtataagaatatccagattacaattccttgagctgagtacttataattcatgcacttttctgtgtgcatgttatttgtcaataagtccaaaggcaaaaaaaaaaaacagataaactcattaaagtttaggatgaaacagggataagacttatttgcctttgaaatactagttctcaaccaaaggagatcctcatccctgtccctccccaccaagggggcatgtggcaatttctggagacatttttggttgtcgcaactagggagaaggtactcctggcatctagtttgtagaggtcagtgatgctgctaaacatcctacagtgcacagaatagtccctacaataaagaattatgcagccccaaatgccaatagtactgagattgagaaacttggccgcaaaagaacctgtctgagaaactccaggatcacttgaacattaatttcatccaccatagtctttgctgatattgagctccttatttactagattcagagaatgtatcctttcccaggggagcatctgagagcaggagcgaatttcatttgctacctcgtaaatctctgaaatggaaaacaggtctgaatattcctctgtctctctctctcccctagtctttgaagccctccaaagtgggccatggcagttagctcacaacaaattccccagacacaatttaaatgtcattttgggggctgggactagggcatgaatatttaagatgtaaattgtttgggctgtgcctaaatcttttatgggttttactggatgagaaaaatgagttactactttttgatgaagttcactttcctttcatattattagcaaacccagccaagtgaaccagactgcatctgccagagaaaatagggatgcttgtttgcgggatgatattagattatgttcccagcatgccgtatttatggttcaaaaatcaaagaacaggtaggagagttgtcttaggtcagcgtgtccttgccagtgaaagtagcttaccaaatacacttgggaggacagtttggaggagtggtggagagtagaagtgaatttaaatagtcgaactctacctgaagagttaggtaccctgagggttgattttagagaaatattgaaatcacgagatactaactccagagattagtcctttcttattcttcagtttaaatcccaggggatgggtacagagcagaggcaaaggaaaggacacacaacaaggaaaaacagagagagagagagagagagagagagagaaaaagagagattgattgatttaacaagttccatggacttcagaaagaatatatattttaatctttttggaagaaattatgcctcctacgtctcatttccaacccctacccagaaattaattttgaatgttaatatgaaagcaacctctctcttctctgaatgctgcttttgattctgacagggtatctaaaaggctgctattagacacattttcattaactaataagctggttcttgggcaaaacatgaattttttgtcatctcatgtgaaaattgtaaaaagctataattatgaagaaaatcactaattgtaaggcacaaaatttgtttgctaagaatagtcattaaggatcgacaaaagcattagtaacttcaatatcagaaaacaactattgaaatgcaagtggaatcaaggcatttgcccagacataataatggctttacgtttaaaggtctataattgtggtttgatctgagacattgttgggaattttcaagaaacaatacagagtagggctaaatacttaaagtaccgtggcttttggattccaaattacagactcgagttttaatttctagagaatattactgtagggagagttactcaatgatattgtcaatgctgttattgctttaggattgtgatgaagtggtcaaaaccaggacaaagaataatatttctgtggcccagacgttttatgatactggctttgcatgcaaagtacctggcagctggcagcaagtgaagtttgcacatcacttcatgatgtatgtcccttctaaagagtaacttttattgtttctgctttctgacaaatatcctctttgcagaaaattaggaaaatgcagaaaattgcaatgaagaaattttaagttctccttaattccatcaacaagagatagccagttaacattttggtgtattttcttctttttatttcgttttaaacttctgaagtataataatgtgataaagtacacaaaatttaagtatccaacttaaaatgaatttctatctatatctccatgtaaccaccacctagatgaagataacgaacatttccagtaaatttccttccttcatgctgttttctagtcagtactcacctctctgcctccctcgtagtacaaggtactattattctggttcttctcacaatagatttgatgatttttaaacttaatataaatggactcctacagaatatcctctgtaggtctggcttctctcactcaatattatatttgcaagattcacctagcttgcttcatatagctatagtctttttcattgatgtatagtatttcattatcttttatactattacttatccattgatgactgttgagttgttttcagtttttagctattatgaataaaaaacaaacattcttaaaaatgtcttttgtggattttcagtaatttcttttggattcctgtactttttcgtatgtgtgcatgtaaatgtgaattatacagaaggttgaatttacattatgtctctccatctccatctctatccctatctgcatctcaatctctatattcttattaatcacagtaattaaatgtcttctaggaaaccagtctgtcttgggatccctgccgtgcttggacattgactgggggcgatcttggggaaacaacatggtcctgcacatgctacataactatttacattctttagatgtatagactcttttctcttttaccaggccagcatgtctccagctgggttttcctgggatttagccatggttatcggcctggtatccaggagagaagttaagggaggcttttgaaggggttagctgttgccttgccaggtagaggcttctaaagcatctttcagcacagtggagctcctactagggaagagccagctacctgtacaaacccagagagtatggaggcagagcaggcagggcagtgttgcagaatctgtattctcagcagcatccatccagctgtctctgtctcatattttaaaatctcaagtttttcccactagaaccctgacctttaaataacaggcctaccttggttgagcactcaaacatctctgaagtgctgcaactataacaatcaggtcatcagtctgcctttcagctcactctgcccttccattagagaacacagtttgtttttttttctttttctttctttcttttttttttttttttttttgctagctaccacagaggctctctgggcctcgctttaccattaattgtttgataatagccttcagtctgtcagtatttttctgcagggcatcaataccactaggtagtaaccagccaactctcctgactttgaagcatggttggctccatattttccaattgcttatatcactacatttgatacagcatttcctcccactgggatattcttctatgtcccagcaaaatttttagcaaccgagccaccacctttggtcaaggactaaccatgttccatctaccagtcaggacaccatcttcacctgctgggcagtgggtgagccagtcttaaattcccatgttaccgcttgttttcttgcaccactgctggcctcgcttgtattagtcccagtcctctgagaagcagacagcaagacaaggtcaaatatgcatggatttcattatggaaaatgcctttgaaagaaaatggtgagggagctagagaaggttggaggagacatcagaccacagtgcaagtctgacccccaagtgaaggagagagggacaaatgttgggtggaagtgtcctagactgtcatgctgtgtaaggaaggttcacaagaccaccagggagttcttgaaccaaacttggctgttagaggagtctctcacttcccaggaaaggggcttgtcttggtattcctgctgttctcagacgttagttggatgcagtccatgggaagcatggcctctgtgcaaatgcaataatagattttcaggaagctcttgggattttggtcaattatactctctgtagctggaagtctatgagacgcatttttctggtcatcacaaataggatcagcacaatacctgtaagtctccatgttagcgacagttatgatttccttacatacttctacatttagggtgttgctgatttgtagtttgataaataatgctgctttgagcattgacataattcattgtttccttaggacagatgtttggaattagaatggtggggcaagaggatgtgaacattaacattcttgatacaaggttgcaaattgccttcctgaaaggcaagaccaattcaccatgccccccattccttatggaatacaaagtgcttgctttccttactcatatgaggtgcttctgtgttccggatatataagaggtcatgctgtgcaatgcagaggacaggtggaattcatgacacaagctggtgggaaagggaagacagaatgattatgggtacaatgtggaatgatttctatatgagcttagtttgactgagatggttagtttgggagagagagggtcatggatgacgtggacatagcagagggaaagctccaccttataacctcctcatgccatccatatgttggagaggtcttgtgtgtttcctataagaggcttcctggccaaaatgtcacactgtgagttctatggggaagcctatgaataccttgcctactgctgtgtttctgccacttggcatatataataaaacagatgtcctgtatttacatttgagttttagagaaagagagagcgcaacggttttctaggagcatatcgtatgagtgtcagtgcggagtagtgggaagtgctctgtatttacctggggttgaattctggttctgcaggagacctgctgaacctctgagtctccatttcatcagactcagtgtaaaatgtagtagcagatggaagtagaggcatttatcttcccttcctgcttcccccttctcccttccccttcccccttctccttccccttccccttcccccttcctctcccccttccccttccccttccccttccccttcccctccctctcactctcagctgcctgttttctattcccccttcctaagaaacccaatctgccttttgggggaattatctctccctaaaatgcagtcttagtggattaataatccatggttcctatcaaccttctggactagaccagggacaggcatgcgatctaggatatggaattttgcatagaaggatacagttacaagattccatggctgatgattcaatccagttgttgagggatgggggagaacttaggtgataataatgaacaatttcttctaccaggagcatctgtctgtttaaatcctagttcttcagtctccccactaatgagctccttttaataaattccttttctgttttagtcagttgctgttgattgcaaccaaagacccctaactgataaacatttatgctcaaggtttttgactttgtgctttttttttttttttttttttttttttttttttaaaaagaattcaatgaaaatgtctactagcttaatcagagtctaaaaaaactgggattggcaacggggagaatcttgatttccagttttcatctttttcttccattttacaacttctgccttcgtatcttttctagcaactgtcctgttcctccaaccgcaatttttaacttccaaaatgcttcataagcatggtgaaattatccatacttatatgctgtgctgtagaattcctttggagaacacacaatatgaattgaaaggagctgggaattaacttatcatctgttttgaagagatgtgtgggatgtggggcggagttttttgattgtggcttgaaaattgattctaattgctgtttttattgctggtttagctgatgctactttcagttatttacattttctgtctttttttatttttattttttagacagggtctcgcagtgttgccccagctggaatgcagtggtgtgatcacagctcactgcagccttgacctcctgggctcaagagatcctcccacctcagcctcctgagtaactgggactacaggtgcgtgccaccacacccggctaatttttgcattttttatagagacggggacctactgagttgcccagactggtttcaaactgttgggctcaagcgattagcctgccttatcctcccaaagtgctgggattaaaggtgtgagctaccacaactggctctatgtctttttaaaatgacttaggcaatggcatatttgactccaccccaaatatatttattcaaacattgaaaatatatctacatactcatgtggctgggcaatttagaagacaactcaaacccaacaattccagatatacttaaaatactgagactaaagtatcctctgatgagggtagtgcttgaatatctgaataattatcttaaatactgaacaattcagttacctctgagtacaaagatacatctatagtacagtggtttagggaattgactttggatttagatagaccttggtttaaaccctagctctgcttgttatagactgcattgtagggaaattagttttctcaacagtaaagggaataacaatgctattagcctaggcttatcctacttcattcttcagacctttattctgggatgctttccttaatatgtcaccctcaacctcagcccaggttggactcttgttatgcatgctcacaggactgtgtttattctcccagagacccggttacagcttgcatgggtacacttttttattagattatttgattacgtcttccccagctccctgtatcacactgcgctgtaagcaccgtgaggttagggacaaccatatctatctccttccccatttattctcagtgcctagctcctggttggcactcaataaatatttatggaatgactgaataaatggaaaaattctttcccataggggattcactgagacaatgaatataaagtacagtggctggtacatagtaacaactgagtaaatgtagtctcccccaaagaaaaactgcaaaaaaaaaaaaaaaaaatccaaacaacaaaatcccaaacaccctcaacaatcaaaccacatgtcatataagaaataaaatatttataggttgttgtcttcattaagatgctgacttttcagagtaagttatgctcttgaatcaaaccacagctgattttagtaatttaaaataagtttatttcttgctcatgtggcaatctgatgaaagtcaggttcatggtggccctatgactctcctaataagctaagtgggcctgaagggtctcccatcagcaattaagtgcttgaatttggaagtgatacaggtcatttctactcaaagcccattggtcagaattagtcatatgacctcttctagatacaagtcaggctagtctcctgtgtgtctaaaaggagaggggccaggcacagtatcttatgcctgtaatcccagtgctttgggaggccaaggtgggaaatcacttgagcccaggagttcaagaccagcctgagtgacaaagcaagaccctgtctctacaaaaaaaaaaaaaaaaaagaaaaaaaaaaaagaagctgggcacagtgacatgtacttgtagttccagctactctggaggttgaggtgggaggactgcttgagcccagaagtttgaggctgcaatgagctatgatcatatcatatccctgtattccagcctggatgacagagtaagacactgtctcaaaaaaaaaagaaaaaaaaagaaaaagaaaagaattggatatcagtcaacattagtaatgtctactgtaggctgttaaatgaagctaagcatacacttttctttaaaatgcagtgcctgggccagggtagaggttctataaatacttgttgatgaaatacaggcttgagtattctacatactaaatgctaacagacttaaacgaagtggctacgggtggaagtaatattcatggtcaaaatttacaatgctagactgtgccaggaggtctttctgcttggatggtttacgggctaaggtgaagggtctcagtgccaaactgaagaggccaaagagcataccaggggttggtcccttagagaaagaagacaaaggttctttcttctttcctcctgttccttggagatggatgagatgtgcttttggctggcatgttagtatcctagtaccacaaccttgggtaagccaaataaagttatttcttcacaattttggaggccagaagtccaaggtcaaggcgtcagcagggttggttccttctgagggccatgagggaaaggtctgttcccagcttccctctttgacttgtaggtggccgtcttcccccatgccctcacgtcatcatctctctgtttgtttgtgtccaaatttcctcttgttatcaagacaccagtcggccgggtgtggtggctcatgcctgtaatcccagcactttgggaggctgaggcaggtggatcacttgaggtcaggaatttgaggccacctggccaacacggtgaaaccctgtctctactaagaaacaaaaaacaacaacaacaaaaaaacaccaggtatagtgctgtgtgcctataatcccagctacttgggaggctgaggcaggagaattgctcgagcctgggatgcagaggttgcagtgagctgagattgtgacactgaactccagcctgggcaacagggcaagactctgtctcaaaaacaacaacaacaacaacaaaaacaaacaaaaaaacactagtcatatcagattagggcccatcctaatgacatcataaaaataaccctgtaaagagcctatctctaaatatggttacattctgaggtactaaggattaagaattcaacatatgaatcttttgagggttagacacaagtcattccataacaactagtcaaattccaggatgttgcattgacctatagtgtttagggtcacagtctgcttctcttctggggtctcatctcttcagaattgttctcttgcttttgagtaaaataggcataataatagtatctacttcaaggtttgatatgaagattaaaagagttactacatttgaagtacttaaaatagcacctggcacagagcaagtacccactaagtattagcattactggaagtacttgttgtcattactttttcaaatcatgatcacttctattaggctggacaatctttctttatttgtctcctaataatattagctgctgcttactcagtacttgctgtgtgcccagcactgtgctaaaggctttatatgtatcacttcatttaatatgacagcaatgctaagagatcaaatctgttgttatcctgaaggtatagagtggtagaaacagggatgatactaaaaaaaaaaattttttttagaccaggcatggtgggtcatgcctgtagtaatcccagcactttgggaggctgaggcaggtggatctcttgaggcaaggagttcgagaccagtctggccaacgtggtgaaaccccatctctacaaaaatacaaaaattcgatggacatggtggtgcatgcctgtgattccagctacttgggaggctgaggcaggagaattgcttgaacccaggaggtggaggttgcagtgagccgagattgcaccactgcactccagtctgggtaacagagtgaaactcggtcttattttattttatttttttaacaaactgagaagcaatggcaatgaaaggtctaggacacccttggccctgccagatattaagagttagttcctaatccgtagggattagaaggagggcccagagtgatgggagtgactctgggagttcagggaaataactctaaccagtagaattatttcaacatgttaatagctgacgagactgtacagaggcatcctggttcattgtctgccctggagggacctgggggtgactgtcccagatccatgttcttaaatatttgctagcgataaggctagagagcctcattttacagacaagagattgagaaccagagaaggcaagagactttcatgaggtcacgcagcgagcaggttggtgaagtagcctgactcctgattcctaggtctctgtgtaaattaagttcctttttcctgcacctctcactgctagtcaagaagcagcagcccagctcatggagaacggcaaactgggatcccagtaggatcccaatgctgcagggctctgtctccctcttttgctcacctggctggggtgggtagactgagggcttggccacctctcaaactcttatgctgtctattctgacaatgatggcagagggaagtggccactgtctgggacagactggcctgggggttgagcccactcagcaggcagatcttcaggtgccttttccctcactgagcactccagcaggcccagatgccaggtagctgagtcggccctggatgtggtgaaagactcagaggcacatggggatgtaccagaccagagcactcacctgtcctctttcctgacctgaaagagagacacacagaggcaaatgagagaaagaccaagaggtaaagccaaagagacaaagagctacatagagaactgagcaacagagccagaggcagaaagacccagagatgcagagttaagacagatagtcagatggagctcaagagagatgaagaaggaacaacagaaaaacaccagcgaggatgacagggaaaagcaaagaaaggcagagtgaaagaaacaggaacagtaagagagggaggggtgttggcggggtgctgtggctcacacctgtaatcccagcactttgggaggatgagacgggtggatcacgaggtcaggagttcgagatcagcctggccaacatagggaaaccccatctctattaaaaatacaaaaattagctgggcatggtggcagatgcctgtagtctcagctactcgggaggctgaggcaggagaatcgcttgaacccaggaggcggaggttgtggtgagccgagatcacgccactgcactccagcctgggcaacagagtgagactctgtctcaaaaaaaaaaaaaaaaaagatggaggggtggagggagagaaagagaggaagagagagaggaggaggggagagagggggtagagggggagaaagagagggaggaagagaagcagagagagggggagagaggggtagagagacggagagggagaggaggaggatagaggaagagaaggagagaaagaagagagagagatgaagagagaagcaagagaagataaagggagagggaggaggtagagaagaggggagaggaagaggggagagagaaagaggaaaggagagacagaatgactgatacaggggtataggggtacaggagaggctggcaggtgatgtagccagtgatatggggagtagaaccgcaaagggcttgtgaagaagaaagaaaaattaggagaaaggccattggggcaggtggaagggaggaggactaggacacagagaagacttttcgtggcattcgtggctctgtttgttatgacaggggcagaaatacagactcagacacccacggcggcccattagtccccactgccccgccgctctgccagacggccgccccttctaggtctgttgcctctgagccttatttattgctccaaaatctgggaccatggggagtccctgctgggaagctcaggcggaagcttccatctaaatcctggactcggcttccagccactgcagctgaacaggagggacagtgggaggacagagcttgatttgtaccatggctttttcacacatggagggtggtgtcttttttctggaagcggtaagaagattctgtgctgtccctagggatgtaagtcttgaccttattcctttccactaaagaaacaatttaaaaatccaaagccaatttcctaataccactctgggcattttaaccagagttgaagctactgaaaatacagtagctaccatgctaggaatgttgtaaggatgatctcatttatccctgtataatgctatgaggaaggttctattatcttccacttttgcaggtgatctaacaggctcagggaggtgaagaaacttgcccaggattctgtttctgtatataccagagtctgacctgtctggctgtgtttcttagtcactgtgccatcctgcccccgcctcccaccaccattatacagatgaagacatcggggcttgtcaattttttttaatacaataattttattattttttaaaattagatatggagtcttactgtgtttgccaggttggtcttgagctcttggcctcacgcaatcctcccgcctcagcctcccaaagggctatgtttacaggtgtgagctaccatacctggctggttctttttgtttgtcttttaacttttatgtttaagtttgggagtacaagtgcaggtttgttacataggtgaacttgtgtcatgggtgtttcttgtactggttattcaccacccaggtattatgtctggtacccattagctatttttcctgatcctctccctcctcccattcctcatcctccccctcctcccattcctcatcctccaaaaggccccagtgtgtgtgatttccctctatgtgttatgtgttctcataattgagctgccatttgataagtaagaatatgcaggatttggctttctgttcctgtgttagtttgctaaggataatggcctccagctgcatctgtgtccctgcaaaggacatgataccgttcctttttatggctgcatagtattccatggtgtatgggtaccacattttctttatccagtctgtcattgatgggcacttaggtcaattccatgtctttgctattgtgaatagtgaggcttgtcagttctaatcatttgcccaaagtcacgtgggtagaaaggtgcagaatgaggatttaaacccagtagggaattagacctcagtaggtctgcttaatttcagtgcgtctgctcttatcccctatgcattggcttggggattttcagaaataggtactccctccaggtgcttcaggcaccggtttgttgtgcctcatgaagtaaagagagcaaaagctccaacagaactacacacttaaaaattgttgcagtagtgaattttatgttacaggtatcttaccataattggaggttaaaaaaattgtgtgtgtgggtctgctgaggtttgaaaaatttttgtaaacctccaattgtcgctgtctgtggagtatggttaatccattctcatctagtcgtcatgctattttcatgatgcagctttgcctacttgctgcactgacctccctttacctccagatcttcgttcctgcagattcacagcttctgtttccttgggtcttctgttgtattgtggccttctgtttcctgctttctctgagtgcctcactacttccaacattctctctctctctctctctcttagatggtgcaaaattaatcgcggtttctgccattaaaagtaatggcagaaaccgcgattaattttgcaccaacctaatggcagaaaccgcgattaattttgcaccaaccgaatatcttcatcaagtcaaccgtcctaggagaaaagatcagattgaatggcatcttaggttgggtttcctggaaacaggctctcaggtgtagatttgcctgcagggacttttttgagggagagcttttgggatcagcattatgggtggagtgcagacaatggtactgggaggcagagatgttggactttgacgcagtctcaacagaggcctcagccaataccatggggatgctttggagctggaattgtgttcagatttatccccttcaagcaagaggttcaggtcttaatatttctgacactggtctgttattagatatgagctgcccttagtggggggtatgactgcaggtgaggtggctttctttcactgagggtgattttcagagatggactgagctgacatctgttggctaccagtactcccaccagctaggggaatgtgagcctcagtcctgaggggaggtctgggtggtaccccacaacatcctctgctgatggaataatcccttttcagaatacagcagcccatgggaccacctccatggctcttggtcttccctgctccatccaatggatgtctgtatttgcctctgttgctaattcctggtgcaatcagatgcaacactggtttcaggtcctatgacatggaacatggaaaccatgtgcaggaatggcctggggctttgctcagatggggtggcagcacagcagagcctttgagcaccctggattcttgaccatagccatgatgccttgccagcttcccggagtccagaagagaattcctgtactccaaatttttcttacttaaggcctgctagcccagttgttaggagcacagatctgaaaatgttctgaagctgatctccaaatagcagaaccatttcttctctgctctacaaggaattcctcttgttatgtcacccgatctcaaagtattagacaccaaggaagtgtcccaagagtgtaggtggatcaatacatagtcacagcccctcctgaacaagagcaatccttctgctgttggccagactgccattcatgcttctcaaaccctctgaagtttccttgtgaacagttagttttttttctgcttagtctaggactttctttcctctctagcaattttcctccatgaagtgaaaacagacatggagacacatatgctacgggggctcaatatagcaccgtcagtcaaaccctgctctctccctgctgcagcaaggatatggctgggctcccatcctttccttccccttaattgatttccaaattcagcctcctaggatggtgccttggctggcattccaagttcagcctctcaaccttaatttaatgcttctagggtggtgagaacttatgtttcccacctactagttggcatctggctgattttcttatcctgaagaatttagtttcattaatgtcaaacctttgtacattgcatttgggctgtcaacagtgatgcatactcctgctgttcccagtcctcctgaaacagagtccttcacctactccaggacagtgttggcattcagggacccagttgtggcccatagcaagactgtcagccataggacttgcttcattcaacccaggagtcccagggcccgggctgggatagctggaggatgctaaaagcaggttggataattcagggtctgcttaattttgcccaggcagcctgatatgaggtcttgaagtcaagttttccagccttcttcttccaagattgtgccagaaattctatacttggagcaagttaacttttcagcactgagatggcaaatgtttatgattggattttcacactcctttctggacagaggacaatttttgttgtaaaatagaaacatagggataggaggacccaaggcaccttagtagggctggatcttggaagaatagtgatatgatgaaacaggttttgtcttctgtattttcttacccctattctttgtaacaaatattgattatttattgggagtaacccaaatccctttaggtatgccaaatatcccagatctcaccagcttcttggtataaatggggtcattttgagacaaatgtttagaccatacaggctcatagcttttgcctcttcctggtggaccccagtgttttcaggagtcctgcagagatgtctcacgtgtgctagaatatgtgctaactcttaggtttttttcactcaagacttttttgtttgtttgtttttgaaatgtgtctcctgcaaaccacttaaggatgacaactctctgctgtacttctgctgcagtcttccacaacatccctgattccctgccactctgatgggcgcatgggctcttttacaaatgtgccgtggtccgtgcattgtgctgctgttgtgcccctctgctgcaacggcaaggaagtccctttgccttgcgtacatggaacttgggtgccaggctcccaaagcagttcttcttgtgcccagaacctctcagccaagtgccagtttctcttctcccgtgaagactcaagccaacatagaccagtatagcttctcatgtctcaaagctcatgagaaatttacaaaaaggatcagtggacctctggatttttctgccttgtgctcaaagctcagaaggccctgcgttacatttaggaaggggaggcacaaggagaggatgtgccatgaagccactgctgaaaagcagacttagtggttcacactcaggcatgtccatcagtcaagctctccaagctgtgttttttagtgtgttgcataagccacacgtggtgtggagggaatggtgttagtttatgccaaatcaacagcagcaaaaataatgacatcatggacaataataaaatagtcaaccagcaacagatggaagggaagaattccagttatgctaagaaactgttagtgacacaaactgtttggagtcttagctggtcaaaccaaacccaattccactagccaaaaaataacaaaaatattatcattcagccagaaacatgagccactcaaatcccctgtccagaaaaacagtccttttgggatctgatggggcggaggggcaaagcaatttcaaagtatcaccctctgctcaccatcaaagagccttgtttgttcactgatgcccagtaaatcagaaccagggaatcagatacaaatttcctttgccttttgatttcctttattaatggaacctttttagaggtctgtttatacttttcacttgtacaaaatcacaatacttcacacaaaggcagcagatgataccgaaagctggagattgggcctaattgcctctctcgtaaccagtgctaacagagccttctcttggatgtaaggaaacttgaatctaattgcagggttggttgttccaattctgtgtaactataggtttctttgtctggggttttttcctcctcaaatttaatgtttctccttgagctcctgtcagatagctcctttaggaatctgagtagagtaaccgttgattattttaaactgagactgaattttaagattacaatgttccaggagtggcgtctctaagacttgaagtgcctctgtgtccacatatccccctggatcctcctgttgaggtttcatgtgaacctcatatttgtttcatatttggtgttatgtgagccttccacctggccataggtgattggacagggactggcacttgagctgaaagtagccaatgagttagcctcatgtaagagtccatctctacataggactatgattaattagacccattacgttctccttctgaaagttttgaatgagacgttgctcagagtgagtgggatatatgttcattctagtaggaatcttgtctgttttctttcctaatttatcaccattattgataatagtacccagcacttggctgggcatggtggcgcatgcctgtaatcccaggactttgggaggctgaggcaggcagatcacaaggtcaggagttcatgactagcctggcaacatggcgaaaccctgtctctactaaaaatacaaaaattagccaggcacggtggcacgtgcctataatcccagctacttgggaggctgaggcaggagaatcacttgaacctgggaggtggaggttgcagtgagccaagatcgcaccactgtactccagcctgggcaacagagcgagactctgtctcaaaaaaaaaaataataataataataataaagtagtacccagcatggcacacaataaatatttgataaataaatgcacgcacccttatgtagaaagatttttaaaaaatgaatcaacatctctctccccatattttacctttttctcctgccaccaggcagccaggttcttccttatctcctcttttaaattgttattattcttttaaacacactttattttttaaggcacctttaggtttgcagcagaactgagtggaagataatagagacttctcacatatcccctgctgcctcacatgcatagcctcccttattatcaacatccccacagaatggtacatttgttataattgataaatctacattgacacatcattatcatccaaagaccaagtttacattagggttcactcttgctgttgttcattcaatgggttttgacaaatgcttaatgacatgtatctaccattataacaacatacagagtagtttcactggcctaaaaatcctctgggatccaactgttcctctctccctccctcccctcaacctctggcaatccctgatcctttcactgtctccatcattttgatttttccagaatgtcatagagctggagtcatatagaacacagccttttcaggttggcttgttttgcttagtaatatgcatttaacattcctccatgctttttatgacttgatagctcatttctttttaatactgaataacattgaattctctggatgtacatagattatccattcacctactgaagggtgtcttggttgcttccaagttttggcaattatgaaggaagaggctataaacatctctgtgtgggtttttgtgtggatgttaagttttcaatccatttgagtaaatataccaaagagtgcaatttctggatcatattgtaagggtatgtgtagttttgtaagaaacctccaaagtgtcttccaaagtgcctgtaccattttgcattcctgttagcaatgaatgaaaattcctgttgctccgcatcctcaccagcatttggtgttttcagtgttttggattttggccattctaataggtgtgtagtgatgtgtcatgattgtctgaatttgcagcttcctaataacatatgatggtgagcatcttttcttatgcttatttgctatctgtatatctttgtgaggtgcctgttcaggtcttttgctcattttaaattgggttgtttgttgtcttatttttgagttttaaggattttttgcatattttagatgctagacctttatgagatatgtcttttgcaaatcttttctctcattctgtggcttatcttctcactcttgattctctctgcatttttctgactttttgcctgggcaaaaaagatgggcagtatggtacagtatttaagtgttcagattctggagccatctgcctgagtgtgagtcctgattttgccacttgttaagcaattgatcataccatctgattctcaattttctcatctgtgaaatggagagaatattactgccaccctatagagttgttatgagaagttagaatggtcccaacgtgtagttagtaagcactgtataaatggtagtcattatttttgggattatctcttttttgcgttgtttggactcagtcactaattggttcttgtcttctaccaatcctttctttactcacaccattgaaggcacactggcctctacccccacctcagggtgtctgtccttctgtttcctccttttgaagtgctttcctcccaatatacttgtgtcttgctctttcatctcgttgttcagtatttttagctgtcataaacagaagcagtctaaaggtgatggggtttcctatctttggtagaaatctctgtccattgatgctagctatctcagagggaagaggagctttgtaggagcagagagggaggaggagaggttccttgagactgagagggaaaggagtctgtatgttcagagagtgatggagactgagccttgctctctgggaatgttcctggaaggtggcaagatctcaagggaaagctgcccccaggaagactgggggacctgggtccgccaaggatctccaggccccaagcatgacctatacactgcagaaccacttggattgaagtcaccatgtagactgaagcagagtgtacactggtgacagccaagtggactgaggtttgggtagacactttctatttcctactgtgacatgaaactctatttactctgcatctgacagagtaactgaggctaaacttcatgcaagttcatagggatggtggctcaaagccagagggactttgactaatgcaatctgagtcatagcaccagaattatgttatcaaacaccagatgtttgcccaagatccagttgtttgctgcacagaaagccaatcatagagacaataagcattacaagggaagattttttaacatgggtgatgtcacccaggagacaggagagaaatcccaaatccatcaccccatctgactaaaatttggggtttatacagcagggaataaatgtaactacatgtgggaaaataggaactagggagggggtaaggaagagtcatagtcaacaggaactagtgtaggaaaatatgaattagggaggaattgatagcagttggttggttaggcaatcatgacagatgagtggtctggtgtctcattgcagtgacctggtaagtttcagtttcttgatactacctcatggtcagtttcctgagaaaggaactcagataaggtaaatggaagtttctcaagttttaagactgggtatgtcaatttctacatttatttaaagaaccataaatatcagttctatgggataattgggctggttttataaagaaagtgatatttctttcaccttgagtttggactttagaattatacacaaaataaatatttccaagttcatccttgctcactgtaatttgagagactctagttactggtaaggttaccatttagacacgttccagtcgttcttgtccctgtgtctttcccccctcaccctgccctttctaacctttcaggtattggaagtgagttcccttctgagaccacacttttgaattgctcatatacctgcttgtttactgtgacatccagttgtatgtgttgattacttcagcctccccgaccaaactataggatgaaccttgagcaagaaataaacttttgttttattttttttttaatctcacaagaatggctgaaatttgttgttttaaatgagtgacattaggtgtgtttgttgtcctaccctcaacaaccttatcctgagcgatacctacattaaatccttaaaaacactgtcgccaaactgttgaaaccaaaggaagtgttcaaaacattggaaatggcatatctttacagacaaaatattttgccttagcaaacatgtggagaaggaagtggatgttgctatatttagagcacaaagcaaatgtgttgttttggagtattcaggcagataaacatgttcaaaaacatgttcaaaatgttccacctattgcctggttagaaataccaatacagcataaaagttcacagtatttccttctacatgttgtatacacacacctatacaccgataccatatactgtagagctaagggctgtttggttgctagaaacagtaagtatttaattaaattcacagaagttagagatcaaactatggcaggatgaaggcaagacacacacctagctcttgtgactccgtatcatctcctgttcatttgagtctcgcatggttttgcaaaattataaagtgttttcagattctcttccttcatcacatttgatagaatgttcacagatttcgtgtatcaattccttgttgaattttcactgttttactatcatctgttttattccctcattctctttggttatatattttacccttctgaacagtttctcctaattatgatacaatttttagcttttgtatttttgttacctaatttcagaatctctaaaaaggatgaacttaggagttgagttggaagggaggtttgggctaaagggacatttccttacctaagaatgagaaaacatcagttgtccatatcaagggatgggagatttgctaatggagattatgggggaacaaactatttcccactccagaaccaaccttggcaccacaactgccataaacttcttttttttttttttttttttgagacaaggtcttgctctgctgctcagactggagtgcagtgggatgatcttggctcactgcaacttccacctccctcctcccaggttcaagggattctactgcctcagcctcctgagtagctgggattacaggtgtctgccagcacacccagctagtttttgtatttttaatagagatgggttttcaccatgtaggccaggctgtctcaaacacctgacctcaagtgatctgcccaccttggcttcccaaagtgctgggattacaggcctgagccattgtgctgggcccattgtgtggaatgtttattcttcttcttcttcttctttttttttttttttgagatagtttcgctttgttgtcaggctggtgtgcagtggcgtgatctcagcttactgcaacttctgcctcccgggttcaagcaattctcctgcctcagcctcccaagtagctgggactataggtgcactcgaccacacccagctaatttttgtatttttagtagagacagggtttcaccatgttggccaggatggtcttgatctcttgacctcgtgatctgcctgccttggcttcccaaagagcttggattacaggcgtgagccactgcgcccggccagaatgtttattctaaaggcaatgatttcctcaactttctactttgtcttcttttaaacaagactctcatacaatctcttttgaaatcactacaatcagggagaaaaattgtttgatgtctgaccagttaataatgagactctggacaaattgttcagctccttagatggacaataatcatatgacttcattgaattactatgaagattatataaaatcatatctgggaatggcttatggggtgagggcatatggggtgagaacccttacgtctgttctttccttgcagctaatggggaggtagtgtcactgaactaaagtaggtccctttgcctatgcaactgaaagccaaacaccaaagcaccagatttttgtagcaagaaaggtttattgccaggtggccaagcagagagacaaagtcatgctcaagtctgtctccctgtactggccttacagctgcagatttaggggagcgatgttaggggtggggttttagggctgggcagtgattggctgaaagggagggatgtttagaaagtcccttggacatgccatcgtctcttgacacttcttcatgagttgcatgtgcaaattcggagggagttggtatgaaacatgtgaaaattcgggctgtgacatcgaaagattactcattgggtgagcaagtttgttctgtgcaggctccagtcagccatattggttccaatctgtttcggtcagttttgtaagctaggggggactgtagcaaactgtatcttttttttttttttttttttttttgagacggagttttgctctgtcgcctgcccaggctggagtgcagtggcgccatcttggctcactgcaagctccacctcccgggttcaggccattctcctgcctcagcctcccgagtagctggaactacaggcgcctgccaccacgcctggctaattttttgtatttttagtagagacggggtttcaccgtgttagccaggatggtctcgatctgacttcctgatcctcctgccttggcctcccacagtactgggattacaggtgtgagccaccacgcccggccagcaaactgtatcttattcctgcaagataagctcaagatttctgttagtcaccggtttctttaaccctgtggggcatggtttcagcagcatgacctagtaggtgttcatgctctaaagtcacatagctgggttcaaatcctaaactctgcctcttgccagctttgtataaacaggatgtgggggtgcaaattacttcagttctcaaacctcacttgcagtgtctacaaaataaataaataaataaataaaatgaaatctgatacagtgtgaggattaaatgaaatattgagtctatagcacttggtattgtaagtgctatatactcaagaaatggcacgttttgttaacttcattagaaacaagtatctcttttcagtccagtcctgtgtcatcattgtcttcatcatcatcatcatcattgtcatctttgttttttagagatcggatctctttctctgtctcccaggctgaagtgcagtgctgtgatcataactcattgcagcctcgaactcctgggctcaagcgaatcctcctgcatcagcccttgagggttcaggactctcagcccttgaggtgctgggactgcagatgtgcaccttcatgcctagctaagtttttattttttagagatgaggtcttagttgtgcaggctggtcttgaaagtctgacctcaggcaatcctccagtctcctgaagagctgggattacgaagatgagccactgtacccagctttgtatcttctaatagaagctcgcaatccttgattggaaacccttggggacacatgttttaaaattcagaatgttatggaaattagaaaggtaatgtggagcataaactatacattccacaacatcccactttcagtggggtctgcagtagcacttcctggtcagctcattactgccgttaaatatgtggatgttcatgctaggtgggatgtgagataaataaaggacataaatagcctcatttcagttctggtcaagttttgttgccaaatgaatttgtgccaaccttaattttaaaaaatttggtttccagagcttttgggaattcagaaacccatgcagtcattaaaaattctcctgttctgtgtatttaagctatttctagtgcttgtttctgctttaagctgtgcttctcctacatctctgtgtttcagtcaacctttcaaagctttctttggactcagctctcctcctttgacttcctgtgttttacttacccctctcatctctgtctctattctttacccccttctggacttcttctccttcgggagttcacacactactggcatgaagactgttttcattttctttgttttttccctctgctacattgtctctagattctcatgcctctctctctcctcctctgtggatttcagagtcttgcttgtgcagtgagggctccctgcctctgttcttgtctaagtatcatctcccatttgatatacccttttatttctggtgaagatattttatttttcataaaaacatcattgtacaatgctctatagaggaagaaaatttcctttaatgtcccccaaatgctatgtggtttaacagtcatcttcctttaaaaaactgaatatgtaattgataataacaactgatttcttgtgaaatatagcatttatgttttaaaaatttatttgcctttattttaactaaaggcaagtccagtttaaacctgtactttttgcagttagccaaatcaaagctatcataattcaaagacaataaaataaagtgctaaatggtggtgctgattctttgtttctgccctttcattcattggtggtggcgcttggctcccaccctaacgaccttaccaccctctttctccttttaatttcttcatctcttccagatatacctctttgttcatgctttcttttacaatgccaatatcattatgataatttattgagctcttactgtgtactaagcactttacatggatcatttagtttcatcctttcagtactccatgaggcagggtaaggactctcttaatccttatatttcagatgagaaaattcaggctgagagataaagtgacttgctcaagattacacagctagtcagtagcagaaatggaattcaaacactattgcattaaatttttgcattaatccttgttgcattaaactgattccaaagcttatgatttcagtcactatgcctttatttcctccattgcagcagatactgccattcctgttattgaattcatcttctctttctcgatttttacagcgtcttaaatctgactcatctctgctgccctcttttcagcatgccattatcttaggtggtttgtccacatttacccatttccatggttgaattgttggtccttatcttttcccaatggcacattgagattattttataatcaccacatactcatggtggactataggaccaatcccaatttcaaatattcttgtcctcacaaaccactgaagcatcctggaaataagatgctggtcagcagaaagagcatctgcttcctctgttgctagacacctgcccattcaaagtcatgtcttggcagaaggcaccattcaaagtcatgtcttgacaaaatggcttcatgtcataaagccatggtatctgtgttacctttcgggtatccgtgaataattgaacctatgtttgttatattagttagacttgctgtgcagcagtaaaccaaattgccacatttctaatttaatgtaacaaagacatatgtctctttcacctcaaagtcagaggtggtttaggagtctccttggcttttctccttgaacagtgactcgactcagggatctgggatgtttccattgtgtaactccgtcttttttttttttttttttgagatagagtctcgctccattgcccaggctggagtgcagtggcgtgatctcggctcactgcaagctctgcctcttgggttcaagaaattctcctgcctcagcctcccaagtagctgggattacaggcgcccaccaccacgcccagctaggtgtttttttatttttttttatttttagtagagacagggttttgccatgttggccagcctggtcttgaacttctgacctcaggtgatccactcaccttggccttccagtgtgctgggattacaggtgtgacccaccacacccagcagcaactccatcatcttaaagttccttgcttccagccacctggataggagagtgggtgggacctattcacagacgcttacccacaaagaacagtcattatcatgactacaaagacatattcattgagatgatttgtccaaggtcttccaagttagtaagtggtagattcagaagtaactaccttgactcttttttccatgataagttttagtaactagggatattttatctgtgttaatccttcctggcttgatttatttaattcacaatgagttattggattttttttctttttttcttttctaataattctgccaaaagttccagggagggttcccttgggtaggcttgggccatatgtccatctatcctcaaaccaatcactctggccatgacaatatggcattctgtttggtcaggtcagtgttgtgcatctgattctagagaggaggaaatggattatggggcaccttcacctctaccatatgtggtgggaacagtggagagctgtctcccaaaataaagccaggatgctgttattaaaagaaaaagtagcagatgtcaggcagtcaaatcaagagaaggactatcaagttgaacaactgaatgaagaaggaaatataaaggagaattagtgactaaggaaattaatcaatgagaaaataaatgaacaaatgatgcttctttgatggcagatgagggaatcctcccaaatggggaaaagtgaattaaaggcaagctgatgccacactgaacataggttttgaatgttgcattgttttgtggtaggttcatcttggttaaggtgaatcttggagggtccagaaactttttggtacaaaaatgattatgtgttccctgtgcacctttgacttttctcaatctcactggagtgggagcagctttcagctgttgacctgctaccctctgtcttagtccaccttgtgttgctataatggaatatctgagattgggcaatttataaagaaaagatgattatttggcttatgatcctggtggctggaaagtctaaaattaggcatctgcatctggtgagggcttcagactgcttcaactcatggtggaaagtggagggggagtgggtgtatgcaaagagattacatggtgagagagagagcaagagagagaaaccaaggaggccaggctctttttaacaacccactctcagatgagctaatccattcctgagagagtaggagcttactcattcttgagagagacattaatctattcacaggagatccatccccgtgaacaaacacctcccattaggccccacttcctgatactgccccacgggggatcaaatttcaatgtgagttgagggagactaaccacatccaaaccacagcagccccacaaaagaaactccataaagggaaggtagtttcttcctccccatccccaagccttaacctctctcctacaatttctgtaggcctccccctcctccttggagaatgtgttcctatcagccgagctgaaaaacagccaggaggctcatctgcgttcgcctccgtaggcaaagtgacttctgcaacaccaagcctagagtgcgtttatctctccctgagtcaaagagattttgtctataggcctttctgctgtgttcctccagagagaggtaaactgcccttaagtaattgctgaagaaggcataaaccagggaaatttgatttgagcatgcaatttgaatcgggaaatgctcatataaataaccggagcagctgaatgcggcgcgtttgtgctttatagattttttttttttttttttttttttttaatctcagggtcttcagaatacaagttctgctgcagcagcttaaaccacctcaggtctttgcactttggccttgtcctagtttggtactgttaactgccaggctagagtctggctaagttgaagttgtcttatttatctgtatctttggaaagaaaaaaaaattgcttgaacacccaaacaacattatatcatagaacagcaacacagtctttaaaaaaacaaacacttttgaaccaagaaggagtttggagtcatttagttcaacttccccaatgatggaataaggaattcagagatggtaagtcactttctgggttaactaagattttggaagtatcataatcagcttttgctgcagcaaaaaacaattcctaaatccaagagctgtaggtttctagcttatattatatctgtgccaaaggtcacccatggctctcctgggctgggctgagctctctcctcttgtattctcaaggagcagccactcttggcggcatgctactctcatgatagatgacagaggctgaagagcacagaaccaaatttcaggagttcatttatagctactgattggatatggtgattgtcatatctgttcacattccatcagtcaaaacacgtcccttggctgccaagcccaatggcaatagggcagggatgggaagcatggctagagtggatagggtgcaagtcattgtgagcaagtgatacagtccaccactggagagtggagaaactcttgcagtgatgaacgtccaagaagaaatgtgaaaactgagaaagtctttgatgtttcctgaatccacttattcttttagtgttactgatgttaatgaataaccacattcacccagtgatgtaagcttaatatgtgggtgtcattccagatcctccctcatctctgcttgttacatccaataatcaaccaaactctttccttatcagtacttaccaaacatgcctcaaatttcccccttcttttcacacttcatttcccaggtattttgcctacaggctctttccctccaatccatgcactgcaccatggccagagccacttcctctcatcctatctaggccactttcttgggtaaagtccttccacacttataaggataaaatgccattcttctaatgtcgccttaaacattcagttcctgctactccctccccacctacagctggccctgggttcaatatttactcatctaagagcagccagtttgaatattaaccaggtcagtatggaagcaggacttgggacatgctccagtctctgctgggatttgctaagtaggtgagaactaaataagaattgattataagtctcagaaggatgggaggaggaaagccaagcttctataatcaattctttgtttatagaggaggtgatccttcattttctctgagggctcagcagaataatggacttcttttttcccaacactagggtccagaaaatattactcgtcacctcctacaatgtaagccccattgagtatcccaggattctgtgatgatttaactatgaatcacccactcccaggtattggagagttgactcttgctttgatttcactgagatttgggatcatcctggccgtctttcctccatcctctattaatgagtcactggactatgctggaattagctggatattccacattgtttatcagtggctgtgtgcttttgtggcatgttcaaccattctttgtggctataatgcattttatgctccaatccataagtcctttacccctcatcctgattttgatttactcctcttgttaatctagaaaactgctattcaatatcatgagcctggctcacagcatctcttcattgaaagctctctttctggagtttacacactactggcatgaagactgttttcattttctttggtttttccctctgctacattttctctaggttctcaagcctctctctctcctcctctttgggtttcagagtcttgcttctgcagtgagggctccctgcctctgttcttgtgtgagtatcatctcctatctgatatgtgtgtttctggtgaagctattttatttttcctaaaaacaccattgtacaatgttctttagaggaaggaagttggagttttttacattatcttttttaaaaaatttatttttatttttattttaagttctggggtatgtgtgcaggttgtgcaggtttgttacatagataaacatgtgccatggtggtttgttgcacctatcaatccatcacctaggtattaagcccagcatgcattagctctttttcctaatgctctccctccccccaccccacccccccaacaggccccagtgtgtgttgttaccctccctgtgtccatgtgttctcattgttcagctcccacttataagtgagaacatgcagtgtttggttttctgttcctgagttagcttgctgaggataaagccttccagttccatccatatccctgcaaaggacatgatctcattcttttttatggctgcatagtattccatggtgtatatgtaccacgttttcttgatccagtctatcattgacgggcatttgggttgattccatgtctttgctactgtgaatagtgctgcaatgaacatacgtgcacatgtatctttttttacatttttttttttagctcctatgctgtcctgcacattatccccttcattcacttagttaattaatattggttgacagtttactatgtgccaggcaccatgcaaggcactgggaatgcaactgtgaacaagagtgacaaagcccctgccgtcatgataccaattgactaggggggattatggcatccaacaaactcacatgagtcaggcggttaccaatggggtgagtgctgtggaagaaataaataaggtgatgggctggagagtaactgggagaggtcacttggatcgtgaggtcaggaccacctctttgaagaagtgatgtttcaattgaggcctgaaagatgagaaagaactaggcttgggaatggatgagggaaagagtaagtgcaatgagaacaagggcacaggcttggaggcaagaaagtgcttgaggggcctaagtcttagccaacaatcaggagtgtggtctgagatgaggttataggagtgggtgtggatagaacatgtgaaaacttgtaggctattttagtaactctaggctgtatctaagaaaatgaaaatatattaaaggattttaagcagaggaatagcacaacatgatttaccatttcaaaagacaaccctagatgttgtgtgtattaaaatgggaagcagggatagacacaaaaagttcactttttttttttttttttttttttgtaaggaggcttttgcagtaacccagacaaaagcaggtgccttagactagggtaatggccatgtgcttacagaagagtggaagtcaagacctactttggtgataaaacaaacgggacttgttgatctatcgaagatgagttctagcagagataaatcaaggatgactttgaaagcaaggatggtttttgccatgagcaactgggcagatgcagaggccttttactgaaatatgaaaactggcagaggagcatgaggttggataaaatgagagctctttgaagacataacaaatctgagatgcccataagggggcgtgatgactaattttatatgtcaacttgacggggctaagtggtgccgagatagctggtaaaacattatttctgggtgtgtctgtgagagtgtttctggaagaggttactatttgagtcagtagactgagtaaagatgatcactctactgaatgtgggttggtatcattcagtccactgagaacctgaataaaaaccaaaggcagagaaagggtgagtttgttttctctgcttgagctgagacatccatcctctcctgcccttgagacatcagagttccaggttcttgagccttcagactcaaactgggatgcacatcattgttctcctggttctcaggactttggacttgcactggaattacaccccagctttcctgattctacagtttgaagatggtagattgtgggacttctcagactccataatgaggtaaaccaatgtctcatatctttctttttttaacttttattttaagctcaggaatacaagtgcgggtttgttacatcggtacatgtgtgtcatgggggtttgctatacaaatcatttcatcacccaggaatgaagcctagtatccattaattatttttcatgatcctctccctcctcccaccctccgccctccaaaaggccccagtgtgtgttgttcccttctatgtacctatgtgttctcattatttagctcccacttataagtgagagcatgcggtatttaattttctgttcctgagttagtttgctaagggtaatggcactcactgatcattagagaaatgcaaatcaaaactgcaatgagataccatctaaaccagtcagaatggctattattaaaaggtaagaaaataataaatgctggcaaggttgtggagaaaaaggaatggtctggcgcaatggctcatgcctgtaatcccagcactttgggaggccgaggtggtaggatcatgaggtcaggagatcgagaccatcctggctaacacagtgaaactccgtctctactaaaaatacaaaaaattagccaggcatggtggcgggagcctgtagtcccagctacttgggaggctgaggcaggagaatggcatgaacctgggaggcggagcttgcagtgagccaagatcacgccactgcactccagcctgggtgacagtgtgagactccatctcaaaaaaaaaaaaaaaaaaaaaaaaaaggaacacttatacactgttggtgggagcataaattagtctagccattgtggaagacagtatggtgattcctccaagacctaaagacagaaatactatttgacccaggaatcccattactgggtatgtacccaaaggaatataaaccattctattataaaaacacttccttaacctgcacaatgcacatgtaccctaaaacttaaagtataaaaaaaaaaaaacaaaaaaacacttccacacacgtgtttattgcagcactatttacaatagcaaagacatgaaatcaacctaaatgcccatcaatgatagactggataaagaaaatgtggtacatatataccatggaatactatgcagccataaaaaagaatgagatcatgtcctttgcagggacatggatggagctggaggccataataaatcttcctgtgtatctctatatatcctatttgttttgtttttctaaaaaaccctgactaatgcagaggctcaagccatctgtcttccactagactttgctgtatcactaatgttgagcacagtgcttgacatgtaacaggtactaagaaagtgttgaatgagagaattgaaatgagatgcttaaaagctacagatgactaatggcttctatgacaacggacaatcagagtccctagcaatggctaattaaaccattccaatctgatgtccaaaatattgtgtgctagagaccccctttcttttcccattaattgaacaggccctgtcttttttgctcttgtagtcaattgttcttcaagtgtaattagcccttgcattttgacagtaaatgagactccaatacttcgataaatggcttgtttctggaaaaggagtatttgtgaatagaaaactcagtcgtcttccccctttctcccacctcttcctcttccccctaatttgggtggcccttggcctatgttattaccttcagaaaggaacagtgtttcttcgaaaaggatagcaacacagaaagaatagttatcattcattgaacacctgttacatggcaggtgggtacattctatgcaatgcaacaatcctgaaaagtcattttaaaatatctttatgttccagccgagtaaactgaatgaagctcattgagactgaagaacttgttaaaattccacagttactaggaggctgaatcaagattcaaacacacccaagtttgtctgatgccaacatctgtcccttttctgtgattcggtgtctcccttagaccgtaaggagttggcccttgttgagaaactcctatggcctcacttgttagtggaaaaaatagcagtggctttgcctgttagcaaggaacaaacacccttccacttcgttcagatttcttaactcatgtgatctgttttggtcttctcattaaccctctgggggtggggggagtgagtgacaattatcacccgcattaggtaagaaaatggatggtgtctcacatagcttgcagtgggcgggtatgagcatcaaatctaggcagcctgaccaaccaagtcccctcctttagcctttacatgatgtgctctttttcagctgtctcgcccttcccaattgacgaagattctttgttcacattcgtgatcttatttggtgtgggaacacagagactgatttgctgaatttttttaagagctggaaacactatggaaggttgtctaaactaattcaaatgatttcccttgtcttgacccaagggggatgtgtgaatttctcaaaattgtccacatgacatcatgctcattaggatagtcaccatcaaaagaaaagaaaataacaagtgttggtgaggaggccaagaagttagaatcttcgtgtactataaatgggactgtaaaatggcataggcattatggaaaattgtatggaattttctcaaaaaaaatggaattacaatattatctcacaaccccacttttggatatacatgcaaaaaaaaaaaaataagcaggatctcaaagaaatcttagcactccagtgtacattacccaactatttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccattacccaactatttgtaatagccaagatgtgaagtcaaatgtccactgatggatgaatggatgcagaaaatgtggtctatacatacaatgaatatcactcagccttaaaaaagaaggaaatcttgctatatgctgcaacttgggtgaaactcaaggacactccactaagtgaaataagccagtcacaaaaggacaaatactctatgattctgatcaaagaagtatctcaagtagtcaaaatcataggaagtagaaagatggttggtaagggctgggggaaaggagaggggagggggaattagtgtttaatgggtatagagtttctgttttataagatgcaagtctgtggtgttcttttttgtttgttttttgagacggagtcttgctttgtaacccaagctggaatgcagtggaacaatctcacctcattgcaacctccacctcctgggttcaagggattctcctgcctcagcctcctgagtagctgggattacagatgtatgcccccaggcccgtctagtttttgtgattttagcagagatgaggttttgccatgttggccagactggtctcgaacttctgacctcaagtgatccgccggcctcccaaagtgctggggttacaggcatgagccactgtgcctggccagatgaaaaagttttatagatctgttgcatgacaaagcgacttacacttaacactactgaacggtacattaaaaaatggtggaagatggcaaatttaatgttatttgttttttactacaaagaattttgaaaacactgcggtggatttagcacttgaccccatgtcaccaggatccagtgaagtttgagctgcctaaaaatgaatgttgctttctttttttttttctttttggtccagggctatgcttctctcttaggttgtgtgttattttctttgccatagcaactttgagaagtaaatgggtgcttttgctacacctcagggggaatcaggtaagtgaggtaaacctaccagagagtccacctcttccaaggtgcattcattcatctcccttagaatggagatggagttatgaagtaaccaggggtggcattatcagtcctacatggggaaaccaagactcagcatgaccactggagtgttcagggtcacctgagggtattggtgatggagggtggggtgagacaatatcccaggaattccgatgctgggtccagagttagtgaagtgggaggagtggcacatttttaagacttggaactgaagaaaatgttgagaaacttggatgcttttcttatttttattattctatgtaaggaactttctacagcactaaagtgaatagttccattgagttgtccagccctgacccttgatctcaatgcccatcagtggcctcagacttgggctttctttcaggctttctttcatcctccaggctgtggggccctgtgagccttcttcttccccagcggtagatttttctttttaatgtttgaactccagaggcccccaagggcttctgccttaattaaaatttaaattcacaaatcatgtcttaaaccgtctcacaggcagccaaataatcgcaatcattagcaagtggttggagttgcttttgctttaatgcttttcaagggtgatggatacatgggcttagtcccatcattactgctgtcttctaccacccctctctccacaaaccttgctcagaaaacttttctataacacctttgttttctcttgtaatagagaagcctgtgttcttggttcagaatgtattaatgtgtcttggtctgtccctacccctgccttctgcagcttgcccatgtcctggaggccgtcctcatttggggaccagtcaattaccaggtaatggcttagagcacagacagagtgaagacccaacacaaggctggacgggcttccctaggagccacttctggactttggcattgggataggtcctttagtctggttatttgctcctgggaatttgcagagtgtcccacagctgtgcttcccctggtccagggtggctcaaccttggcactgccaacattttgggtttgacagtttgttgtagggagaatgtccggtgcattttagaatgtttggcagcctgcctgttctctacatactatatgtcagtagcagtccccagttgtgacaaacaagtgtcctgagacacggccaaatgtcccctggggcaaaatctcccagttgagaaaggctctagtccaacggcctctctaagaccaacacccttctctcagttcattttgtgttgcaggaatacctgaaactgggcaatttatgaagaaaagaggtttatttggctcttggttctgtaggcagcacaggaagcatggtgctggcatctgcttgtagtgagggctttagggagcttccagtcatggtggaagaagaaggggagcaggtgtgtcccatagtgagagaggaggaggtgccactctctttttaaacagccagctcttgtgtgaactaatagagtgagaactcattcattactgtggggagggtaccaagccatttgtgagggatcctgcccctccatgaccttgactttttatgacttacccttagaagtcacatagcactccttctgccaaactttataaattgaggcagtcataaatccacccatattcgaggggaggagacacagaccccaccttttgatggcaggagcatcaaagaatttgcagccatatttgaaaactgcacctcatttctattcccacgttcagagatgtgaatttttccaagcctttagcagataattcaatcccgccttgaaaaatttcaccaggtgtatttacaccaaaagcctacttcaattaatcaattctaatgctccaattactcagcttatattttcagacactctaataagcaccacaaatgaataggaactaagctgatggtgcatcaccctccactattaaaaagaccacacttgatttctcaagcagcctttacctttgtaaaatgaatttccttctctcacttgtatttagcacaggaaaatgtttccttagggttgtggtggagttgggacagatgggaagacatctaagaacatgtagcaattgtaataaaggtaaatttgttttttttcttgctttttttttttttttttggagacaggatctcattctgtcacccaggcaggagtgcagtggcatgatctcagctcacaaaggttacattttaaatgaagactgaagccttgttagtttgtgatttttgtcatgttgggaaggatgtggactcctattcagactctaggattaaacaacctgggcctcagtttactcatctgtagagtaaggggttggacttgatattttccaaaacctctaccaggtcctaaattgtctgtgattataggaatatttgccaagggcgattttctaacatcaatacccagagggagcacccatgtaataatcatattcattgacatgaatcatattcattgatatgaatcatattcattgaatagcttgccttcaagaaatactgtggcacttctggtaaccataccttttactctgcatttacttaaatatgtacatgcatttttacataagtggtagtatacattttcttttgtaatttccttttttcccctaccactataatacatgctgaaaagcttccatctcagtacctataattaagcttaattcttttttttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcataatattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagagatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgaggtgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatattgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagtgcttccttcaggagctcttttagggtaggcctggtggtgacaaaatctctcagcatttgcttgtctgtaaagtattttctttctccttcacttatgaagcttagtttggctggatatgaaattctgggttgaaaattcttttctttaagaatgttgaatattggcccccactctcttctggcttgtagggtttctgccgagagatctgctgttagtctgataggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgtcggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctagatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccatgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgcctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcatccatcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttcaagcttaattcttttccactgctacataatagtccactgcacggataacttaaaatccgctatagggattatttaagtgtagaccattttgatgtaaatttaagttactttatttcttttgcttttatattagcaatgcttcaatattagcaatgctgcaatgaatagcactgtgcatacgtcattgtgatggttaattttatttgttaactgggctaagggatgcctagatagctggtcaaacattgttttgcagtatatctgctaaaacatttccaaaagagattagtgtttgcatcagcagactgagtaaagaagatggccctcagcaatgtgggtgggcatggcgtaatccgctgaaggcccagatagaagaaaaaggcggaaaaagggtgagttctctgtcttgttgagctgctacattcatctcccacccttggagactggagctcctggttctcagggctacaggctctgggacttacaccagtggcctccccagttcttggtctttggacttggactgaatgacatcactggcttcctgggttcttcagcttgcagatggcagatcatgggacctctgggccaccacaatcatgtaagctaattcccataataaatctttgcctatatatactgtattgattctcttcctctggagaaccttgagcaatacagtcattttgctcctatgcagttatactgtagaataaatttctagaagggaatttgctgggtcaaaagttatgtgcttttataattctgatagctatcgacaaatttctcatcacagagatcataccaatttgttcctcaatcaataatgtataaaagagctttgtcctcctacacagggtatgatcaaactttacaattcttggcactctgataaggcagaaatggcctcattatggttttaagtggcatttctcctttgtgagtaagctagcatcttttcttatatagaagagtctttcgtatttctttctctcagaaaagtatccttatagactgtgaaagggcataacttaaaacatttttatttatttatttttaattattatactttaagttctagggtatatgtgcacaatgtgcaggtttgttacataggtaatacatgtgccatgttggtttgctgcacccattaattcgtcatttacattaggtatttctcctaatgctatccctcccccatccccccaccccatgacaggccccagtgtgtggtgttccccgccctgtgttcaagtgttctcattgttcaattcccacctatgagtgagaacatgcagtgtttggttttctgtccttgtgatagtttgctcagaatgatggtttccagcttcatccatgtccctacaaaggacatgaactcatccttttttatggctgcatagtattccatggtgtttatatgccacattttcttaatacagtctattattgatggacatttgggttggttccaagtctttgctattgtgaatagtgccgcaataaacatacgtgtgcatgtgtgtttatagtagcatgatttataatcctttaggtatatacccagtaatgggatggctgggtcaagtggtatttctagttctagatccttgaggaatcaccacactgtcttccacaatggttgaactagtttacactcccaacagtgtaaaagtattcctatttctccacatcctctccagcatctgttgtttcctgactttttaatgatggccattctaactggtgtgagatggtatctcattgtggttttaatttgcatttctctgatggccagtgatgatgagcattttttcatgtgtctgttggctgcataaatgtcttcttttgaaaagtgtctgttcatatcctttgcccactttttgatggggttgatttttttcttgcaaatttgtttgagttctctgtagattctggatattagacctttgtcagatggatagattgcaaaaattttctcccatttttgtatgttgcctgttcactctgatggtagtttcttttgctgtgcagaagctctttagtttaattagatcccatttgtcaattttggcttttgttgccattgcttttagtgtaacttaaaacatttttaatagatgtttttatatttttctagtgaatccactccatgacatcaccttgccttcctcttttttttttttttttttttgagatggagtctcacttggtcgctcgggctggaatgcagtggcacgatctcagctaactgcaacctccgtttcctggagaatcagtgaactgattctcctgtctcagcctcttgagtaccttggattacaggtgtgcaccaccatacctggctaatttttgtgttttgggtggagacagggttttgccatgttagccaggctggtcttgaactcttgacctcaaatgatcctcccatctcggcctcccaaagtgctgggattacaggcatgagtcaccacgtctggccctcgccttcctctttatgccagtttccgaagtcacatgtaagcccttaggcagatggtgggatcctcattctatcactctatccctttatggttttcttagttgtatctttaggtggagtgaagcgggacagctaacacagtgacctccagtagccacagaatttgttggtatttgctagaaatacatttggtggataatatggaccatcaaagctttactttgactccaccctgcaattttgtccaagtgtctcaggaaatgactgcacttcatttttgctgaagcctatttctctgcagtacattttgtaatccttatgggttttatcataagaaaaaacaactcatggtctttctagaaaaagtcaaacattggctggtttcatcgtttatcagcatcagctctttctgctgataatgctggtaacaaaacttctttctctcagcacctctttcagcctgactgttaaggttttgatggagaggaggtgggaagcccaggcttgactctaagcctaagccacacttgtcaatgcagttaatcagaaactttgcattgttactggcccctgcccaactagggataaagatgacactttacttagattttcatgtgatctttatgtctgggaccaaccggttaaaatcccagaggaaggaagtttgggcaattggctagattccagcattttccacacactggattctgtgttagggatactaaaatgaattaataaaatgcagccctggccaggtgcggtggctcacacctataatcccagcactttgggaggccaaggtgggcggatcacgaggttgggagtttgagaccagcctgaccaacacggtgaaaccccgtctctactaaaaatacaaaaattagctgggcatggtggcgtgcacttgtaatcctagctactcaggagactgagacaagagaattgcttgaacccgggaggtggaggtagcagtgagctgagattgcaccactgcactccagcctaggtgacagaacgagactctgtctcaaaaagaaaaaaaaaaaagcagcccctggtccaaagtcactcccacatcaaagcaggtcccacctataagcagatatttataatacaatgtagtaagtaccatgataaaagaaatctttccaatctaactcatagaggaagggttcctggaggagataaacctcggtaaaaacattagtatgaattggtattagataaggtggccagaccatgtgatcaaataaatagagatgtgaaataaaaaggtacgtatgtgtgccatgataagtggtgtttctggagcagaaattatgtcatgcgttagtggttgaagaagtagacagaacctggtgaaacctgtttgttctctaaaagacttgtaatttatcccgtagattaactggtttttcccatggccagacacccacagatagcatttcaccctgtaataacttctcttgggtgtgcctaggcttctgcatgattaccagctcattggctgtatcagcaacccgttttttctatccagtgagtgtgaaagagatgaggtttctacggtccttaaaaagcctggatccatcagcattggagcttggagaggagttgaggtaaaagaaatgcaatctaccaacagatataatgtttaagtatcttactttttactgtaaaaagtatcaaactttttactgtagagttgaatcatttatacattttggtttaacctaattcaatttcttttcttttcttttttttttttgagatggaatctccctctgtcacccaggctgcagtgcagtggcacaatctcagctcactgcaacctccacctcccaggctcaagcgattttccttcctctgcctcccaagtagctgggactacaggtgtgcgccaccatgcctgactaatttttgtatttttagtagagacagggttttgccatgttagccaggctggtctcaaactcctaacctcaggtgatccacctgcctcggcctcccaaagtgctgggattacaggcatgagccactgtacccggccctaattcaattctttatgctgattaaagaatggaaaaagcaggagatgggacatgcaagggagaaagtggggacagtgtaactggcccagccaattctgtcctctactcatggtataagagagcatgagacaggaggactgacgttcatgccccatcatcagccttggtctcccatgtggctttcataacctgagtatctcttggagccaaatgggagtctagtgtttagaaatatgtgtttttcatacaacctgggtgctaaacacaagataaacggttcaccaaagaaccagtgagtgatcaatttttgctgggagacagactggcctggctggccatatgaaaaacccagcatatgcagttgactctctgtatctgtgggttccacatccatggattcaaccaactgtggatcaaaactacatggaaaaaaattgtgtactgaacatgtacagactttgtttcttgtcatttcctaagcaatgcaacataacaactatttcatagcagtgacattctattaggtattataagtaatcagacatgacttaaagtatatgggcggatgtgtgtagattgtatgcaaatacgacactgttttatatcgggaacttgagcatccaccagttctggtatctatggggagtcctgaaaccaattccccatgaataccaaggagtgtctgtattgtatttaatgggcactggaagggattcaagagttattttgattatatactctctacttgccttgctgagttttttaaaacataacacccaaatgggaagcaaaattactttgtttatgtttctcaaagacgatgaaggagacaaaaacctaagttcacagcaacctcatgaagctcctcttttatttcccatcctctcactattcttatatttctccagggcattcctccctccgcacagccctgtgaagctctcctatctcttcctctactctgtatccttttatttatttttattttattaacttattcactttggaatagggtctcactctatcacccaggctgaagtgcagtggcacaatcatggctcactgcagcctcgaatttctggactcaagcaatctcccctccttaacctcttgagtatctgagactataggagtgcagcaccacactcagctaattttaaattttttgtagagatagggtcctattatgttgcccaggctggtcttgaactcctgggctcaagtgatcctcctaaccttggcttcccaaagtactgggactatgggtgcgagccactgtgcccagcctacattcttctattacataagatgatcggagcttgtctccagccaacaggaatcattattatttctgagggactatgagtgggtgggcaaaaattgcattttctttttctttttttttttttttttaacagccagggtctcactatcgctattgttgccccagctggacttgaattccagggcttaagtgatcctcccaccttagcctcccaagtaacttggactacaggctatgccagcatgccttgcaggatttacattgttaatcataagatactctctgtgttatggaatgaattgtgtccctatgccccccaaaattttatgtgttgaagtcctactcaccagaatttcagaatgtgatgatatttggagatagggtttttacagagatagttaagttaaaatgaagtcactggggtgggccctaatccaacatgactggtgtccttataagaagaggatatttggacacagacacatacagagagaggatgacatgacaataccagaagttggtcatctccaaaccaaggaaagaggcctcagaagaaagcaaccctactgacacgttgatctcagatgtccaggttcttcaactgcaagaaaattaatttctgttattcaagtcacatagtctgtgatattttgttttggcagccctaatgcaccttggaaggggagatcacttagacaaacaatgcctgtcccattccactccagcctcttcaaatttatacatacaaaggagaaccactcacgaacattggtattttgtgtttttttggtcacgtattacttgtgctgcccatcacagcttactagaagactgaaaaacattgctgtaggggagaaggggccacaggggaattcaaagcagagaaggacgtgatggatctgaattttgggtggatcacaccaacatcaaaagtgaagatggattgaaatagggcaagacaggagatggagaactattaaaatgctttttcggctgggcatggtggctcacgcttgcaatcctagcacttggggaggtcgaggtaggcggatcacgaagtcaggagtttgagaccagcctggccaacatagtgaaagtccatctctactaaaaatacaaaaaaaaaaaataataattagctgggcatggtggtgggcacctgtaatcccagttacttgggaggctgaggctggagaaatcacttgaacccaggagaaaggaggttgtagtgagctaagatcacaccactgcactccagcccaggcgacagtatgagactccatctcaaaaaaaaaaaaaaatgctttttcattcagtagcagcagggatggagaattagggatgggtttgataaatatctaggtatgagaataataatattgggtgatagaattggggtgatgaaagggagtagagatggatgatttctatctttctagtttaggtatctgagtatacaatggcactgccaatagaaagcaactatagagtttatttgcatgccactgtattctagaaagaactgaagttggcttatacaaaaactgatcatgccataataaatagaagtaaatggggaaagcgaagctggctgtgcttgaaaactggaaagacaaaatgaagccaagagcgaggttagcacacaaatcctcatccagggattcttaacacttgtcagagatggactgtacattttgctttaggccaacacatgacattattcacacttgtcattttggtcaatgtttctcacctcttccaaggacctggagtctgaaaattctaaaacaatgaaaatctggctgttggcttctgggcgtgagaggcaccaggaatactgggagaggctcagattgcatatttggagactcctcagagagaaaggtgtggaaagtttaaaaagtgtggagcatctcctgcctcaccttagggtagggtggaatctggcgcttgggttcagagactgggaagatggactgtctgtacttccatgcaacagtgtaaaaatccattgatttgggaaaatgacatggatgtgtcatatgccttctgtggtgccacttgactgatttacataatattgctgtttttgctatgtgaatacacaggttacataagcagtctggcagcttaagtctcattactgtcatttccaaggtgttagattgttcagaacaagggaaccctttctgctacagaatctaaagtgaatgtatccccatctaggcacatttcaatgatcccttcatgatcacacctttggaatatgcccaaatagccagtttgataaccttaggttggaaaagggaatggttgttcccaagctgtctttcccagagtgtttccctcttgccaagtgttgagtgaggttcaacaggtttatgttcctgcctatggggcacctttctctatggagaaaggacctttagaaggactatatagagagaggtgagctctatacaacagctcttggcgctaataatactacaccttgatgggtccaggactggttggggcctgacttgctgatcttttttgcttttataatttcaacttttattttagatttaggtggcacacacgcaggtttgctacatggatatattgcctgatgctgggtgcgatacacatgatccagtcacccaggtactcagcatcatacccagtggttagtttttcaacccttaccctcctccccttcccctctagtagtcccccagtgtctattatttccacctttatgtccacgagtatccagcgttcagctcccacttgtgaatgagaacatgcaagtatgtctaagatggtgtctccactccatgcatgcctccttctagacaggatctggctggctgtgggcagtattgtggagttggtaagtttcctctgtgcgagtttactcttccttttctttcaatgtgtaccagagtgatgggattggctttggagtagagatatgactctctctggccagccaagcctggtacaagtaatttaactccttggaatctcagcttcctcatctgtaatgtgcggaagataacagcagcctcacaggactgccctgactgcaatcacaatggaaatgagtggctgtgaatttcttcacagcgtcctgatgcaagaaaggcccaaaatacttcactcattttattgatttatttatttacgtatttttacatacatacattttagggacacccaggctggagtgcagtggtgtgatcctagctcactacaaccccaaactcttgggctcgagcagtcctctcactttagcctcccaagtagctaggactataggttcgcaccaccatgcccagctaattttttatttttagtagagaccaggtcttgctttgttgatcaggctagtctcaaactcctgatctcaagtgatcctcccacttcagcttcccaaagtgctgggattacaggtgtgagccaccatgctcatccactttacttgttttaatcagagtaaatctggctgtaggctctcaagaactacagtgttgagaaaataaatcacagatttctttaggagcattccctaccaatccccaaagatataaatggtcttttaaatcccttatttgggatttaaaaattagggagggggccaggtgcagtggctcatgcctataatcccagtactttgggaagccaaggtgagcggatcgcttgaggtcaggagttcaagaccagcctggctaacatggtgaaaccccatctctactaaaaatacaaaaattagccgggtgtggtggtgcgagcctgtagttgcaactgctcgggaggctgaggcatgagaattgcttgaaccccggaggtggaggctgcagtgagctgagattgtgccactagactgcagtctgggtgacagagcaagacggtgtctcaaaaaaaaaaaaaaaaaaaaaaaaaaaggaaaaaacatgagggaggggcctggacctcagtccttggagtcaccagagttcctgctgctctttctgctccatgatgctcctgagtttgtcctgcttgctttctcagcctttgttctctcgacagacccagggctgttcctcaagaccattgtattttcttctagccagaagtttgaccacatggaattttgccagtgctgtccaagtcttggcactgtatccaaccaccctggtatccctgagatctgtgttcaaagacagcccagttctaatcacctgtgaaaaccccaaacctccacactcttcaatgttatgggaggccaaggctttacctgcctccaggcaccccaaaccccaactgtctccccgatctattttccttcctcatgaatgagcttatgtttcctaaacaaagctgggatgagtcttatgtcctggaagtctcatagtttctactgagttaatattgactctagttgtcctcagtagccagtttcttcttcactcacaccaacagaatgtttagctacacaggaaatgcctagaataaggctgacattttgcagcctgcctcatagctagggatagccatgtggttgagttctggacaaagagatttaggtagaaagtgtgggtggcagcttctgggagccttctttaagggacatacctgccctttgatgttcttttcttcttccatcttgctgtctcctatgcagctgctgccatcttggaccaagcacatgatggtcatatcctaaaagatatcagaatggtgagttggtaggagactgagtctttgtttataagacaagacacagagtggggaaaaccccttttgtttggtccaatgtcatgacaattgagcatcaaagggaagaatctcaaggaccaaggttacctgctgagcatgaccaaacccaagagagcccacgtccttaatgacatcacttacccaggagcctcctccctccagactccttctgatgggagatgagatgagacattttccccactgtttaagccacttttctttggatattttattgcctaagagcaccctaaccaatgggatataaagaagaacagtctcagagcacaagggttgtttacttgtttttcagatgaggcagggaaaatccctcttgatcttttgagcatccttcagcaacaagaacaaacacaaacaggtatctcagtaaatgatgcccccatatgtaaaaaacacagcatggaacctgacacatttaagcagtcagtaaaaggtagctattcttctttttcttagtagcataatgcctcaataaacattggtttctgatcctatccccttgagtatctctccctttgctgctaagtttctccatacctttacatttatctcccttctcccctattaaacctggctcttgaaaagactgtcaacttgctctcattgaggtgtcagtgatagataaggcttaatgtatgacctcattccccaaacactatcggcttgtcagtgagatttacatttaatagaggattaaagccttaagccaaaggaatgaatctttaatggtgaaatttgaggcaccagaaggcttatgaaaaacaatattgaagagggggaggacctccttggtgatcccaattttctgaggcattctcataaagttctccaaattctcccaaatttaaaaacgtcatgccgtactgcacttcacaattggcagttggcagacagattctggatgaagctttgtggaactgaacgggagtgggagggggaatcgtgaaatcaaaggcacaagaagagggtgtctcaattccagagggagttgtctgttgagtgggtgagtcaggctgtctgagcatgtggatggaacttccctggggcagctgcctgtgttgagccacatttgatattgacttagcagtttcctgctgcttcttgaccttttttttggttggggctggtggttgagctgtatcaagttatctttctatcccaccctcccagtttcttccctgaacctcatcatcatctcagttcttctccctgcttgtcctgccctctacaaagtgcctctttggccaggcttctcaaatactgtgagcaagacttggaatctctcttctctccttgcacccaccactgaatctttgggcatcttggccgggtccccagcagtgcagacctgacaggctgcattcttggtcactgggatttcttctctgagctccagcttatgctgcttccttttcagcatctcctcttgagtatcccacggattatttatttagttatttattttaattttttgttgttgttgagatgaagtctcactctgtcacccaggctggagtgcagtggcatgattgtggctcaatgaaacctccgcctcacaggctcaagcaattctcctgcctcagcctcctaagtagctgggattacaggagcccaccaccatgcccggctaattttagtatttttagtagagatggggttttggcatgttggccaggctagtcccgaactcctgacctcaggtagtacgcccacattggcctcccaaagtgctgggcttacgggtgtgagccaccttgcctggccctgattatttatttttttgagatgaggtctcactctgtcactcaggctggagtccagtggtgtggtcatagctcactgcagcctcgaagtcctgggctcaagtgaccctcctgcttcagcctcccgaggagctggaactgcaggcatactattattagtgcttggaacacttagcaacatacccagctacgttgtaaattagagacgaggtctcactatgttgcccaggctggtctgcaacttctggcctcaagcaatcatcctgcgtcggcccgccaaagagggaccccactccaaagcactgggattacaggtgtgagtcactgtgcccaacccctactgatactttaaattcaacacatgtgggtcaattatgttccatccatcccctggatgtgctcttcacccacctccaccttgttccttccatggcagatggagtcattggaacgtcatcacctctggctgggtttgaccaattaggaggagaaaggagagaggagggaggagtgaggcaggagtgggaggctgcagtgttcatcccctaaaggtggtctccgccggattgtgttcctccaccaaaagcctgctcctttctagtggccttctgtacctacacgactccctctttccaggtcttggcaactattccctgtccttgttcccccaagcttggaggcagtggcagctcctccactgctgctggcctcgggtgactgctctcacccttgcagtggttcccttgcgggagattggcatcacctggaaacacattaaaattgcagacttggggctacctcccagcccttctgagcttgaaattaggggtggggcccagcagtctgcatctgtttttaatttttatttttattttaagttctggggtacatgtgcaggatatgcagtttttgttacattggtatacatgtaccatggtggtttgctgcacctgtcaacccatcacctaggtattaagcctagcatgcattcgctatttttcctaatgctctcccttcccctagcccacccctgacaggccccagtgtgtgttgttcccctccctgtgtccatgtgttctcattgtccagctcccacttctagctgagaacatacagtgtttggttttctgttcctgcattagtttgctgaggataatggcttccagctccatccaagtccctgcaaaggatataatctcattcctttttatggctgcatagtattccatggtgtatatgtaccacaatttcttgatccagtctatcattgatggacatttgggttgattccgcagtctgcattttgaccagatctctaggtctaggtgattctgaagcacgctcatgtttgagcatcaccaaacttcacctttccagctttgaaattagtaacaaactcttccaattgtgccaaatgaacatttcctctgttttctattgtgatcctaatgatataatgacaataataataatagaattcagatccccggcataaaagtgacccttgtctagggtctctttctcaatgaatgcaacaccatgggacttgttcttacacatcttttaactctgcacctaccagcctgtgtggtacattgtaggtgctcagtaaaggctcatttcaacagaaatttcatttttttaccctcatggttttgtgcctttcccaacacaccgtgtatacatccattcatccacccaggaatcaccatatgggtactggggatgtacagccaaatatgatattgtgtttagtctcatgggtcttatgagttaatgggtgagatgtcagctgtctgagtttcagtaacaccatctattaatggatcataatattactgactccatggggttgttgtgaagatgaaatgggataacgcacagagtgctcttggcacggtgcctgacattgaaactattcaatcaattttagttttattactattgcagtagttgatatagcttaagcctggctcaaacagagacgagaacatgatttgtgggcatctctccacgccatgggtataagcgtcttacaagttacaggatcattaaagtactttgtaaattacttggcatttcataaggcgtttatttttattttttaatttttgtgagtacatagtaggtgtatatatatatggggtaagtgagatattttgatacaggcatgtaatgtggaataaacacatcaaggtaaatggggtatccatcaataaggtgtttttatatttactgatctggctattattcttgtcctcgtgtgatatctctgtcttgtttatcctcttcaaggctaccctgtaagtttcattttgacctgcttttattcctgtgcaaaagttagccagcacaaaagagtagcttaataatttattctggattgagacgcccttagggtctgtccattaatttcttcccttccaaaatgactataattttttattgtttttattggttaaaaagatgtatgttcattgctttaaaaaatgaaatgatacaaagcggtacaaagtacaaaatactttatcagttgaaataaatcactcagagatacctcttttaacatgttgctgaaccttttccttgaaatatcattatacatttctctgcaactctatctagtatttccatgttacatgaatagggtcattctatggagccagctcactttttagccagaaactatctgaggaggctctgggaaaatttcgtctggggaggcgcgcttgctctcccacaggaccaccagatgtcgctgcttctgaatttatcagaatttcctgtccccagggcaggctgcagaaattaatgctcaatgttccaatcctgggccctggttcgtaccatccctctggcctagggctgaagatgaattgattttgttttcagtgacacctgcagagggcaaaagtcatgcccacactgtgacatggagtgaacctgtagtggctcttggactgaacaagttctgacatgtgtgttggttatgtttgcacctgttttctcctcctcccccgtccccaaattagatcgtgagatccctgcaggaagagactgagtcctgtaacccagagttctctttctgtaaagccctcaatacctgttaagtctcaattaagaataaggtagcttggggacctggcatggtagctcacacctgtaatcccagcactttggggaggcccagttgggtggatcacttgaggccaggagttcgagaccagcctggccaacatggtgaaactctgtctctactaaaaatacaaaaattagacaggcgtggtggggcatacctgtaatcccagctactcgggaggctgaggcaggagaattgcttgaacccaggaggtggaggctgcagtgagctgagatcacaccactgcactccagcctgggcaacagagtgagattacatctcaaccaaaaaaaaaaaaaaaaaaaaaaagaaaaaagagatggtggctaggaaaatagaggctagaaagaaaaaaaaaagtaggtgttttgaaagcagaaaacaaagtataaaaaattattgagctgggagtcagaaaatccaaattttacatttggattaggtcttaattcactggctgactttggacaagcctattgacctttctggggtcaagttggtttatgtataggaggttggatagaatgatctctcaacctctattagctctgacctccttggatacaaaagttcttcttgtcttttgttgttgttttttgtttgtttttgggatgggaggatgtcaaattgcatctagaagtgaatcattgggcaccgtcaagaaacctggggaactcaggtcctggggcatccagggcaggtcaggcctgaggctgagctgcacttaacaatccaccctccttgcagggccattggcgccggccgcaccagcacagcccatacatcattattagattcccttcatcatgctaattgacatgggatgaaaaatatccagtgaaggaaacagcaaatgctttcacattcagccagggcacctggcaaatgggagaaactgctgtaaaagttaactgagattgaaaacgggcctactaatatcttgtagggtgaatgtttcctgttgccgggaactagttcggattggcaatgtgagtgagtggtggagacagggagggagggaagcttggggtaccacgtgtgaagtgtagaggttggggggaaccttttaagacagtttaggttcagatgcatggagaaccagacagaacaaataaagaaggatagagaggagagagagggagctggtcttgtctcctctaaactgtagtgataattgtacccccttctcagtttgaattctgttgagaattattttctcaagaagagtccagtattgggtggaggggaatgtagaattcctggctctagaccagtctgggggtagaggaggttgcaccccaggggacattaggtaatgtctggagacatatttggttgtcataagttgggggcgggttatattagcatctcctgggtaaaggccagggatgtggcaaaacatcctacaatgcacagggccaccccctcccaccaagcacataatgatcccgtctaacatgtcaatagtcctgaggtgaggaagcccggctctaaaacaatgtgtgactttgcacaagtaactaaacacctccgggtgactattttatcaatctacgtgacaaattttacatggtatggtagattgctggcaaaaatagcccaaattctcctccatgtcccccctggccattgcaatatcactttgcagctcctgctatcaagacatggagtctgttcctcactctttgaatcacggctagcctgtgtcttgctttgttcagcagaatctgcagaattggtagcaccaagtctaggcctcagaggctttgcacagttctgttgtctccttccgagccctgctctcctgtgtgcgtgagcctgggctaatctgctggaggatgagacaccacgtgtacaacaggcaaactgccctaccctgtctatgctaaaaatacaattgctaaaaattgcaagatacagtccagcctagagtaaaactatctactgaccgaggaccatggactgcagaccctagctgagataagaaaacccacccaggtaatccatagtttcctgggagataacagattcgtactttttttttttttttttttcctttgagatggagtttcgctcttttacccaggctggagtacagtggcacgatcttggctcactgcaacctgcctcctgagtagctgagattacaggcacccaccaccatgcccagctaatttttgtatttttagtagagacaggctttcacttgaacccctgacttcgtgatccgcccaccttggcctccctaagggctggaattacaggcgtgagccaccatgcctagctccagattcttactgtttaacccactgaatttcagggtggttcattatgcaacaatagctagctaatatgcaaggtcttgaaattaagactcaacggtgaattccaaggggaatgggaaacatctcaagatttgcttcctttgttaatagctgacattttcctaagtccgatagctttaaatgaatcaagatgtgcataactgcatcctttgatacccaattaatggagctgggcaagttctatctggagacaagtttgctaaaggttaattttattcacttttatcaggacaagttgcagcaatcaactctgacttaaacaatagcgaaagggcattggtgaggacaccaggaagctgatgaatacacagccttcagcaacatcgggagtcagagctgctccagggatcttggcaggagggatttgtggctctccttccagaatgctgtcaagggtgacagaggcctaagcacctttcatcctcatgtaatttgtgctccagatttgaagaccagggtggaagaacctcattggctttccttatgtcacctgctctgctaataggtggtatcgtttgattggcacctctgccattcccacgtagagtggaaaagggcaatcagacagaaacagaaggtgccgtctgcctccctcctccctaccccttcccctgccacccacaaccctacagattgggaaaggtagaattaggaagtatgtttagaatttttggtgtgtggtctggacctctaagatggctcatcatagcctagctggaaaatggaaagcctccgtcagaaattaaaaatcaaatgtaacagtgctgttgactctcatacgactctcctccagtcacccttcacttgtcatgtcagtgtcagcatttgtggtaatggtttgggatgtggaagggggagtgagaagggagataatccttcttcttctccttcttcttctgagacagggtcttgctttgctctctctcccaggttggagtgcagtagcatgatcatggctcactgcagccttgaactcctgggctcaagcaatcctcctggctcagcctcctgagtagctcaggctacaggcatggaccaccccacctggataattttattttttactttgtaaagatagggcctcgctgtgttgcccaggctggtctcagactcctaggttcaaatgatcctacagccttggccactgcacccagtcttgatctgacttttgaagcactatgtatttaccgtactccagcctgggcaacagagagacatcctgtttctaaataagtgttatctcttagtgctatttctattcttgttgtcagcttgcaagttgatagctggggtcaaaagtgtgacagttgtttgagtcagatttggaccagaacattttctgccacttattccaaggagatggcaagggtcagcggggggtcctaaaagtctcgggtccagacattaagtttctgccttctgtaagtcacccaaagatccccaaagtgtcccagctgtagagacacatgaattacctacttcccacctgtaaattaggagggctgtacacaatctgaggtttacaactatttttttcttttaattttcttgaacccttcaagtaaaatcttatgttgaagttcagcacatataactgataaatgtgagtcattttcatagaagcagttgttgtgtgtgttttggggcgcagtggggagcagggggagcaggttggagccctactcatatttggcctccccctcttctccaaagtggctctgaagacatctctaggaccctcttggttttgaggaccacttgtgaagaccatgggaccagtgacattgaggcctttccaagctttgagtacaattctctgtgtgtagatttgaggaaatggtcttcatcagtgctgagatacagaagatagacctggtggagaaagccagggggatggcagatgctggaccaagccattctcctgcctcagcctcccaagtagctgggactacaggcgcctgccaccacgcctggctaattttttatatttttagtagagatggggtttcaccgtgttagccaggacggtctcgatctcctgacctcatgatccgtccgcctcggcctcccaaagtgctgggattacaggcgtgagccactgcgcctggcctcttcatctccttttttgcacaaagcagcacagtgaggcagaagaacaagggctttgcaactctgatcccagctatcgacttctgagctgacaacaagaatattaatagtaccaacagctaatactttttttggggggatggaaatggatttcatttggcatttttaccaaagatgagggtgttccctagggaggtagcccagcagagagcttaagagtctggaatgttgaagacgaacagtctcaggctgtagtccccccagtcctgccacgtgttagctggatagtctctttatggctctgagtctcagttttctcaactgcaaaatggagaagcaacagtatctacttcctagagctgctgagagaatttcagtgtaatgacgaatgggaggtgcttggagagtgaaccttggagagtgggtaaattctacaaaatatagaaaaattgctcaggtggagagtgtacatgaatggagggtgaaagcagcagccaggtgtggtggctcacacctataatccaagcactttgggaggccaaggcaggaggattgcttgaggctaggagtttgagaccagtctgggcaacatagccagaccccatctctaaaaaataaaaaaaattagctgcctattgtggcaggtacctgtagtcccagctactcaggaggcagaggtgggaggataatttgagcccaggaatttgagaccagcctgggcaacatagcaagaccctgtctctacaaaaaataaagtagccgggcatggtggctcccactggtagtgccaactacttgggatgctgaggtaggaggatagcttgaatcccggagttagaggctgcagtgagctatgattgcaccactggataactccagcttgggtaacagagtaagacctcatccgcccaaaaaaagtattagctgttggtactattaatattcttgttgtcagctcagaagtcgatagctgggatcagagttgcaaagcccttgttcttctgcctcactgtgctgctttgtgcaaaaaaggagatgaagaggccaggcgcagtggctcacgcctgtaatcccagcactttgggaggccgaggcggacggatcatgaggtcaggagatcgagaccgtcctggctaacacggtgaaactccatctctactaaaaatacaaaaaattagccaggcgtggtggcgggcgcctgtagtcccagctacttgggaggctgaggcaggagaatggcttgaacccgggaggcggagcttgcagtgagccaagactgcgtcactgcactccagcctgggcgacagagcgagactccgtctcaaaaaaaaaaaaaaaaaaagaaaagatgaagaaaaaggagggcacctctcacctttgctaggagtttgctcctaacattctcttctctaatgctaggggtcccagtccccattctctctcttacaaaggaccattcacttttcctgtcgtcccctgacaagacctccaggagcgaaattaaagcaataagagctaaactgtctgtgatcggagaacagagaatgtgataatgatatataaagcttaaaagcactaagtgggcaaaactggtgctagagaagtgagtaaaaccaagacaaatccgtcccttgagagctataacacataacttaaataaccggagcagcaggggtccgttatcccttggaagagcggtttgcactcccgtggagcacagcctctgcccagcatccataattccccatgtgcttaggactggtcaccacagcctcagggttaactgctggttggatcagggtttctgctgccacctgggcacatgcagcccaccctatctggcagcagacatctgaggtctaacctcagcagtaagatggactggagaaagaactgcatggacactgagaggactcagattttgtttttgcctccaccctttttgagctgtgtgaccttgattaagttacatcacctttctgaagaaccctgtcttttttttaaaaaaaactttctatttaaagttgtgggtctcaacatggggtccctagaggaaaagcatcagtatcacttgggaacatgttagaaatgcagattcttgggccacaccgcagacccatgaaactagaaactctgggggtgtctcctagaaatctgtgttttaacgagccttctggtacatgctgaggttcgggaatgagtcttttaagaaaaatgatcccaacttgtgtttttattccctggcatccttaactcgttaataaggagggaaggagttcaatgttaatgggagctagctgggcttccaggaagttcctgggctaagtcacaagagcttttgttccaggagacatttggggcatgctgaggcaggaggatcccttgagtctgggaggttgaggctgcagtgagctgtgatcaagccactgcgaagtctccatacctctctaagattcactgcaggtgtgtgtacttccttcattccaggcccagctgacttttttcccttccatagtcctttgctctttcccccttcccttctcccagacacaagaaatgctttcagtctgggaaaagttcagggaggtgggaacttgtctctacccaatagcaatttttctatattttgcagaatttatgccctaattccttttagccgtgggcttttgaagctcaaaagctcacgtttggaaactcacaatatgaggcatttgaaatttaaagccttttcctttgcttttctgcagcccctttattaagcaaataaatgctgttaaatcgagttgctgctggagtcagggaaaggaaagagagtgaggagtaatgagagtgatatggaggagagagtgcagtcaatgatttcaaaggtaaatgtctttccacataaacttgtgatataaataaagagaggaacaggcattctgctgaacatctctgggcaacattaccctttatttaaaaaactctacacgccttattttatggagagttctggaacccaagataggaatgtcacttatgtgcatattcttacgccagctttccttcccacataccattatgataactctccatccctgtaaataaccagggggtctctcttccttctgacccttgcacaacgtagctagctggagtgatccatttcttcttcttcttttttttttttttttttttttttgagatggagtctcgctctgtcacccaggctggagcaatccatttctatctttcgtgacacccgtctggtactactttgagaactagatgaaaactagaagtgctttttgtctatttaaaaaccttattatgctggtttcaatgtgttttttggtagttacagttctgagaagtgtggattttgcagttccacactgttaagcatgatctcactgttgtgtatctgggtaaaaggtgatttaaaggcatcgcaaggagccaagcttccatctgatgagaaatgcaaaaagacacaagggggccattcctggaagtgtgaaactctatgttcaacaggaccaagagacgagtcggttgcatatttacattttacatttatgtgatgcattagaatttataaagcgtattcacatgcattaatcactaagatggaattttaacaggcaactggtacgagctgcattggaataagagggattgatagtatttaaggaccagtcagaagaggactgatggtatttaaggaccagttacaaaacaggctggttgcagtgactcacacttgtaattccagcactttgggaggccgaggcaggaggatcacttaagcccaggagttccagatcagcctgggcaacatagtgagacctccatctctacaaaaaatgttttaaaaaattagctgggaacggtggcatgtgcctttagttccagttacctgggaggctgaggcaggaggatcacttgagtgcgggggggggttgaggctgcagagagctacgatcacaccactgcactccagcctgggtgacagatcctgtctcaaaaaaaaaaccaaaaacaagcagaaagtgaaaaaatagtgacagagtatatttctttgaatcatgccttcaattgcatgtgctccttggttaagaacactcattgaggattatatttaacttttctgttttattttatatagaaaaacccatattagagcaaaatataccttagtagtggtaagctgtggtgactctaattaatactgctttctaactactctacaggaaaagtgatctacagggtttacctgtagaaatacagcagtgccatagccaggcgtggtggctcacacctgtaaccccagcactttgagaggctgaggcaggtggatcatgaggtcaagagatcgagaccatcctggccaacatggtgaaaccccgtctctactaaaaatacaaaaattagctgggcatggtggcacccacctgtagtcccacctacttgggaggctgaggcaggagaatcacttgaacccaggaggcagagattgcagtgagccaagatcgcgccattacactccagcctgggcaacagagagagactccgccccccccccccaaaaaaaacaaaacaaaacaaaacaaaaaaagcagtgccattaggcactagtgccagagtggttgcatgcatctggattccctggaaattcctgggagcgggagtgacagagcccagtcctgtcactgagtgggttcttaagatgaccacggttcctgttttcccacagccctctgtcaagtcttcaccgacgggcagacagcacagttcacatttcagtcacggcactggcttgcccctcttgcttggcagagaaaggacagtgactcccttacctggaaggttgtgctcttatctaacagaaggaaggtgaagaggtgcagagcagaggatgacagccggggggcaacatgacttttgctggatgtgagaaatgccaagtcagtcgctataccgaccttagttcttcagccccacgtcccatttgagacgcatattcctgcattctagggatacacccaactgacctgtttcatggagggaaattagagtttggctttggctgtcagtttctgaaaggaattaaagggtttgctcctcatcctccatgccgtgctataatacaccaaaatgaccacccggcagtttgcagctgaactcagacatcatatagtcagttacatctctctcgtcagataacaaatgtcttggaccccactgtggaggggtaattggaattcagctaccgtgggaactctaccttaattgccatacaggatgacaacaagggagcccaaatagcagaatacatccctgtatcatttttttcttggcttggcagaggtgtgtgtagtgctggtgtattagggttctcgagagggacagaactaataggagagatgtatatataaaggggagtttattaaggagtatttactcacacaatcacaaagtgaggtcttacagtatgttgtctgcaagctgaggagcaaggaagccagtcttgagtcccaaagctgaaggacgtggagtctgatgttcaagggcaggaaacatccagctcgggagaaagatggaggccagaagactaaacccgtctattctctccatgttctgcctgcttttattctggccacactcacagctgattagatggtgcccatccagattgagggtgggtctgcctctcccagtccactgactcaaatgttaatctcctttggcaacaccctcacagacacatccaggaacagtacttcgcatccttcaatccaatcaagttgacactcaatattaaccatcatagctgggttctgtcagttgctctcccaggactttccagggaatacagattagtagagatagaagaagataaggaaagactattgcatggaagagttgccttagtgatgatgaaattggagggaaatatgtaatgctgctgtgttggaatcttccccatgaagaatgctttcccaccttggatctacagagatgtcttttgtaatagggtttggcagaaaaagcaacagactaggagtcaggcggtctctgctttgctatttacatccacctaattcgtagaacccagacccaacctgcaaactactaagtcctggcaaaaccgcagccattagcatgggatccacattcccagtgcatgtttagatggccttctcttcaccctctctgattcctggttaatgttttctttgccaccctgacttatgagtatcaggactcatgagcagcaagaaatagaaaacccagctcagactgactcaggccaaaaagggtatccgttggcttatctaattgtaggcattgctgggtataaggactcctttgatttgattgggactcagtttcttgccatctctcagttctgagttccttttccttgactccactttttagcagggtctttcctcctgatgatgaaatagttgccagagatgctaagcttatatcctctaaagcttcaacttcagtaaaacagagagccaacttctgtttcagcaatgtcagtagtgtgtgtcactagctttggaagggtgattctcctgatttgggactagatcaaatgttccccccagcgaggtgtggtggctcatgcctgtaaacccagcacttttggaggccgaggcagacaggtcacttgaggtcaggagtttgagaccagcctggccaacatggtgataacctatctctactaaaaatacaaaaattagccgggcatagtggtgggcacctgtaattccaggtacttgggaggctgaggcaggagaatcgcttgaacttgggaggaggatgtttcagtgagctgagatcacgccactgtactccagtctgggtgacacggcgagactctgtctccaaaaaaaagtacccccgccccacctctgcaggagaggaagccccactcgaatcacttgggttaaaagtaggggaagggttaatctcaggtgaaaaggaggtagtactgttgcaagaagagggactggatagatgtgggtgacccaaccataactacctactctccctcagctcccaaaacatagctcaagcgttcctcagtagcaggaattttacaaaacactgctgcaagttccaataagaggtatgttgcaaatacctaaaattagctggaatttgtaacgagtttttatttttaaaaataagttagagtggattcagagttatcctggtaaagctttcagtgatggatatgtgagcattttaatacggttggctctatttgtgtaaaactttgaaaattttcacaacaaaaaaggtatcccctaaagaatatcaattttactcatttgttttccaaaacacttttttttatatgggaggtaggttgtcagagaaggggtgctcaggcctgcttgttagactagagaaggcttcctggccaagtgacagctcaggatgtgggaagtagtaacagccaagtgagtgcattttttttttaagagatgggatctcactctgtcacccaggctggagtgcagtggcacaatcacagcttactgcagccttgacttcctagggtcaagccatcttcccacctcagccattctagtagctgggactataggcacaccacaccacctggctaattttttattttttgtagagatggggtcttgctatgttgtccaggctggtcttgagaccagaactcctgacctcaggtgatcctcccacctctgcctcccaaagttctaggattataattatgagccaccacacctgacctgcattttgaatacaatatgagaagggctttgtaaactgtaaagtgccataaaagtattgtaagtatgtggtggaagaatatttttgaaatattaacatgattttcccctcagctttttttcccattcttactgcctttgttttctcctcactcagctaagccaatctatattcattctatcaggaggaagactatgacagcaggagaaagaacaaagaatcttctaaggggcacagaaaagagagagttattaagtcttccccaccaccagactagtaaaaagattccctagactgggagaacagagagagccagaagttctatgcctgaagctttccaatgacaaaataagaattccccatggcaggtgaatgggtaaatgatggaagtgtcctatgcatgaattattatgtagcctttaaaacgaatgcattaaatctatgccagttcatttggagggggcttctggtttacaacaccagcgagatgtagacaaagatgctacaaaattcctttttgtagaacaaatgatgcccagcccccattattaacatagacatttgcatgtttgcatacagttgcatgagcatgggcaaaaagtatgaaaagatacactttgcttcctaacactatttacctggggagagaaaataagtgggaggaatagaaacttaaaaagtatgcacaataaaaaagcatttgtggcaattccatttatgtgatattcatatgtatacatacgtgtgtgaatgcgtatgtgtgtatgaaaagattaccaccaactcaaatggtacagatatgtatgaagaaactcaagataaataatagtaacattttgattattgagtttccttatagttatctaaattgttcaaattattttctcaagcttcatgtattttcccacttttaagcaggcaataacagaaactatcttaaagataacacatttaaatttactgacacacagtaggcacctaataaatagtttaaagaaaataagtataattctcaaaattcaataaagatcttgtcattgtggagacaaaaagaaccacgcttggagagaagccagagatagctgagaagatgctcactctgtcttctccttgaaagaaaagccaacacagatttaagaggtccaaaaatgatagagaggaagagagagagagagaaagattttcaacctgctgcttttcaaccaaaacattgcagcaagggctgcaagccacatacgtggaatatactgagaatttagcatctgatcatgagcaaactcagagacatggatggtccttcctgctacttctttgagtttgcagggcttggaggctgtagcagtgagtggtgctgctgtcctaatgtcctgactataccgggagccactcttcgatcattcttctgtccattcagatgagtagagatgggctgcatgaacggttttatccccaggatcaagtggagcatctggcatggaacagccagccactcagtaagtgctgggtgaatgcataaataagtaagggaatgagtaaatgaagggttgagtatgtgagtgagtgagtgaatgggtgagacaatggatgaatgaataaatttgcaccccagaagaagctctgacacagctttgaattactcctccagatgcgaggggctttgtggagagctgtccatcatccttgcctgcccaaggacaatgacttctcagctttcaccatgcatcctgcagccatggagggaagcaaaattaactggtctccatcagcctccccatcaaacatttgctgagcacccatcatgtgcaaaatattgactaggaactgtgggagatgggaagaattctggaaactcctaactctcaaggaatttgcagggttatcagacagttgccacacaaagacataaaaacatcccctgctaaaataaagaccacgccagatatgtgctgtaggtattcacccctgcaggaactctggggaaaatggggcaggaggagtcacccttggatgtcacaaatggctctccaaaggaaatagaacaacatcgcagcatgaattctgaagccggcccacctgcctgccttgaattacagcttccaccagctgtctggccttggacaaactacttaactctccacatctgtcaaatggggataataatataacaatcccccaatattgtgaggatgaaataagctaatacttaggaaaagcttggaacagtgcttggcacgtcttaagtgtgatatgtgtgagctccttccttgattctcattctgacttgaagaggatttttagaggggagacccagggaacagtggggcagcctagacgggtggaaagtgttatgctggaggcttaacctaacctggttcaaaacctggttctgctatttctaccagtgtgaccttgacttaaactctccaaagctcagttcctcacttataaaatggtaataacaaaaccaatttcattgaaaacgtatgctaacgatgccatgataaataatagttattattaaagagaaacacagtaaagaagttcccagagggaggtgaataaattaagcatgatgacgtgccttgctacttccccatctttctcttcttcccccagatttgttcaaggtctcatcattactggtttgcatttctattttaatcatgttataggtttacagtatttttccccctgcatctttatatgctataatttgggtactatttttacacaacgaagccatttttaaccgagaacagattcaattgtctttcagcatatatcattgtttatcttaattaatgctaaaatattcttagggggaaaaacacatcccacagagtattatgcgaagaaacttagcattcatttttgcctccctcttttctggcatatcaatttataaaggttttagcatcctgttatttcaatgacaataatgcatgctcttaaacgcagacacccatctgtgggaagcaagtcacagggtgtcaacagcagcaaggtgtgtgttgcagtggaggtggaggattgacagctggaagaagaaggggattttgctggtgagaataatgccaagtgaagtcataggctttgtctctgattgatccatggaaacattccttgagtagagctgaatctagctagattccatgcttggagtctttcttagtaaggctactactataagcacagatgatggaaaatggatgatgtttttattcatcatccattctctttccttcaaataagatgccccatgcacctctgagggaatgaccctttacacactcaacctaagttttttgcctctccctccagctctagggtgggcatgtgatatagaactgaccaatcaatatctattatctttctggccacagtgattgggcaagggatagccatgtgacccaatcagagccaagagactcagttttgaggctttagatagaaccactgggaaagagggttctctttctactgggatgctgacctggcaggaatattacccagagctgcctgtgaccatctttactatgaaaaggggagagcttgccaaagaatgaagctgtattatagtctgttctcatgctgctaataaagacatacctgagatggggtaatttataaaggaaagaggtttaatggactcaaagttccacatgtctggggaggcctcacaatcatggcagaaggcaaacgaggagcaaagtcacgtcgtacatggtggaaggcaggagagcgtgtgcagggaaactccccttcataaaactatcagatctcgtgagacttacgagaacaacacaggaaagacccgcccccatgattcatttacctcccactgggtccctcccatgacacatgggaattaagggagctacaattcgagatgagatttaggtggggacacagccaaaccatatcagaagccaatatgaaagaaaacagaactgagagatggaggcagactcttgatgacaactcctggaccctggatcaatttttgtttaaagccagtctgcactctgcatctttgatgtaaaccaatgtatttcctttatttgtttgtttaaactaaattaagtcatttgtaatttaaagagttcagagaggtgccgtgtttcagtagggaactgtaaaaagccaggatattctgtaaattagaagggaataatgtggtgttgaccacatctgggagaatgtgcatctgagggtgtcttgcatgccaaactcacttgtcttcctaatcaagcaatagtttggtaactgagaagttccaagtagcctttaagtcacacaatcatactagaggaactcctaagaacctgggtgacattgtgatataaaatgtggaacttcactaggttatgcaagaacctctgaaaagggttgataggaagggtgtacgttaggtgtgtaaagaactaggtgtgggggaactaactagtacaaaagggatctggtgaatttggattctaccctactcgagatgatgttggagggctctgatcaaagtaggggtttgggggcagaattatgacaagtatctataggaagtcactatcttttattaaaaatttgttgtgaacctgtcctcactcatagttgggaattgaacaatgagaacacatggacacaggaaggggaacatcacactctggggactgttgtggggaggggggagggatagcattaggagatatacctaatgctaaatgacgagttaatgggtgcagcacaccagcatggcacatgtatacatatgtaactaacctgcacatttgtgcacatgtaccctaaaacttaaagtataacaaaaaatttgttgtgaaccagatactgtactaaatgacttacctacactgttgtatttaattctctcaacaacctgatgagttctgtatcttattatatccattttacatgtaagggagctgaggcttagaaagctggagtgacttggtctgccatggctaggatttcagctcatgtctgtatgactcgaaagcatctagtgggtggtaacattggtttgtagacttgaaacaactttggctaatgactggggcacatggaagaggggacagagtccagcttccaaagttagaaggctaccaaaactaaggttttggtcagagattcaacattccaggggcagaccctgatcccaatgggagagtagatttgatagggaaactgaggcaggatcctgggactggagccaacacagggagcattagttgggagggttgttgtgaccagtcaacatacttctgggggcttgtggcaaagaacaaacacagaactccaaatgaattccctgccagagcttgttcagagttggcttgggataggagaatctgaggggagtatgaggctgacagagaaaaaagagagtcttgtggaatcctaagatttaaaaagagaggaagaaaagatgccttttatttattaaacagtgattacgaaatacctaacacatggccacgattagactaggctcttcccatacatgaagctcagagaggtcaagtgagttgttcagggtaacacaggagctgtgcctgggtatgaagctgtatctgctcaaacataaaggtcttttcatggtgccagagtctacatttcccagagtactaagatagtgacttgatcatcagcactaaatatgtgtcgtaaagatagctcacatttacagatattatagctactctgtgccctgcaaggtgctaacgactttacttggattatctcaacttatcccccagacaacctatgacgtttagccaggcatcatcatcatcatcatcatcatcatatcatcgttatcctcatcctcatcctcatcattgttcttgaatgatgaaaattggagctcagaaactcaacctgtgtcaagattacaaagctagcaattctgggtcagaacctgaacccaggcagcccgcactttcgatgtgcccaagcttatatctccacctacaactctgcctcagtttctccctctgtaaaatgaagacagtaataaggcacctcacaaggttattgtgagaacaaaatgaaccgctgcatactaggagcttaacagactggcaaagaaaactccatcaatgttggctttcatcggggctattttaatttttgcatcaccctcttcaaaagggcacttctcgctttcccacggctaagctgccacactcaagtgtgctggaaaaaaaggctgggtagctcacaacgtgcgggggcatcttagtgtaatcctggggtgagagataaaagaagctcgcttgacataacttcataaacccattttaatctaaacattgattttcctttggaacaatccctttccccttgctcacagtcccaccacgcctctaatacagacgtgggtattgataacattattgagataaaacagtcgcctctttcttattccctttattcatcagtcaccccaggcctgtctttgtcttttttcatcctctgctacccagcattattcattggagtgccttcttttccctcaccctccataactcaaggtgaaagttttcagtaatgacaagtagtaaaatatgagagatttaagcaaattcaactggaaataatgtgaaaaaatattattcgctccggacacatgcttctcttttgatcttccttgtccaagatacattttaaaaaaaatactcctttgataacaagaagtgagcaggggctaaaaggaaaccttatgtctttgttgggaaataattagtctgatcgaatcgcttgctttctgatggacaaaggagtctttaaagaaaatcatttgtgttctctgggccccttcaggcagcacagctttccgaggcttgggcttttagatgagagtttggggaatggaaaatttccctgaataagaaatcagagagcttgacctacacagttacctctctcttaacatgacaacaattggcaattactttttgatccaaagtgtgaggatgaatatggaaaggaagggcgaatcattctccttcttctcaagctcattctctctttagacctgcacctgaagctgattttcttttcttttttttttttttccagtcccagcaattcaatataatctatagctggaaatacctatgttagctgcagctgggggaaaaagcagttggcaaattcatgaatcagggcttcttttctttttcgcttgtgaaaggtaacttccgacagcttaagggtgatttggaatgaagcgtgggttggttcctagtgtcagcacattgcctagttgttccagccaggctggctgtaatgaagcgtggacatccatacatagtttcagtgtcagggacaccggtgactctaatgaagagaggaccttaactttgatgcagaatcatgattgtttatagctgtgtggtgaagaatgggctctgaaatccatcgcacttcggtgaaaatgctgtttggtctgcaatgtgaagctgatagcttaatttctctgatactcagtgtctttacctgtaaaatggtgccaatatcaaagtagctgtctggtatagcagggtttcttaatcttggcattatcaacatttggggccaggacattcttcatggtgaggggctgccctgggcattgtagggtgtttagcagcatcgttagcttctacccactagatgccagtagcactctccccccaccccattatgacaacaaaaatcgtctccagacactgccagtgtcccctgggaggcgcaatccctcctccctcccctcaccgaaagccgctgccatggagctattgtgagaatgaaatgaaataatccatacaatgctctcagcactgtttagtagacagtacatagtaaatgctcaatacgaattagttgttactcagacaccaagagggtaacaacaggcgcacagacactggggcctatttgagggtggaggatgagaggagggagaggagcagaaaaaataactattgggtactaggcttagtacctgggtgatgaaatcacaaaccctagtggcacaagtttacctatagaaccaacctgcacatgtacatctgaatctaaaataaaagtttgaaaaatgaataaataactattacttgttactgtattaataaaactgtcaatagaaactcaacacaatcattttttttctcttgaagaatcttatagaatctctggatctttagtgtcccaatttccctgatattggctaggaaacctcagttgccccacctgccacttgtcaaatgttttgtttttggcaaaaccatccagtgctaggagcaggcaagtcaatttccaagtggttctgtgaatgaagggtgtcctctcactttagtcccagggaaatagctaatgcacctgggtttaatacctaggtgatgagttgataggtgcagcaaaccacacaggcacacttctacctatgtaacaaacatacacatcctgcacatgtaccccagaacttaaaaaaaaagttcagaaaggatcaggaaaggagagatcatatccatagcagtagggacagcaacactgaggatctgagtaattagaagtcaaccaaagcttcctcatcctttggggagaaagcaggatgcccagaagaggtaaccgcagttgctccctggggcctggaggtcttgtgtgcatgctggagtgggaacagggaaaggggcaggtggcgaagagcaacagatgcaatcaactttctccatctatgctttagttctagcgacttctaccacttgatggactgcacctaatagtaaccactgtttgaactctatcatggcctgagttgtgtctcctcaaaattcaaatgttgaagccctatttggagataggaaccttaagaaggcaattaaggtgaggccctaatccaatagagctgatgcccttgtaagaagagaaaggcaccagcactctgtttttctccttatgcagaggaaaggctgtgtgaggatggaacaagaaagcagccatctgcaagccaggaagagtgatctcaccagaagttgaatttgctggcaccttgatcttgaacttctagccaccataactggagaaaacaaatgtctgttgtttaaggcccatcctgtggtattttgctatagagatctgagcagaccaatataagtgcttaccaggtgctcggcgtggtcactcatttcgttctcataatgacactttgaggtaggttttacagaagaggaaacaagctcagaaaggttaaaaacatgtccagcgtccacacaaataggaaatgtactgctgggcctgtccatcttcaaaaaaatgaggtccttaaccaccatctcaatgtgggctgtctctatccccacatcaccatttctagaatgttgacattgtacaagtctctatgtcagggatttaaataaattagctcttgcactttgggagaccaagatgggaggatcacttgagaccaagagtttgagaccagcctttccaatatggtgaaacctcgtctctactaaaaatacaagaattagccaggcatggtgatgcacacctgtagtcccagctactcaggaggctgaggcaggagaattgcttgaacccagaaggcggagggtgcagtgagctgagatctcattgctgcactccagcctgggcaacagagctagattccatctcaacacccccatccccaccccccgaagaaaagtacatcagctcttttaaatctctgggtggggaactcttgctgtgagaaatgagctgatatttggtctttagatatcacagaaacagctactgaattttactgtctacaattttaatccaaccaaggattctgagggtgcatgggggtgagggctcagaaagagaagagcccattcaactccaggtcactccaggtgagttcactccaggtcaagagtcagccaatgctattagtggctgcaatttgcttttcagggatctgcttttatgcaaatgaaagcaagaggtctccaactaaggaaggggaatgaacatccctcctctgccctacaattctagtccaagatgtctttctccagctgggggcttagcaacaaattgtatcttcctccttcgtttccttccaaggacaatgaataatcataattcaaagtagagcaaagagcctgcatttacacagtgcacatttccaatgttttttgagattacctgattttaccttcaagtcatcatgggaggcaagtgctttctgacagatgaagtcaagacatagaagtgaggactcttgacctcaacccactgcatttttcccaggtggtgccatttggctggcagtaatgctgtagccacttggcatccatcacaggtaagggcagcagaattagaggcagacagacctaggtttgaatcctgcctctgacccgaaccatctgtctgacattggacacattaacttatctctttgaaaatggtgtagagaaaatgaagatggagatcataatgatctgcaggggtcaaccccatacaatttgaggggatctatggaaagcacagtgcttggcatatatatgatcaatgcttagcagctgtctttgctgttcccaatggacaagaactttctagaatgtataaggtctgtgcctaagcactttctttcacgatccttgtccatgtcatggggtcctctgaaggaccttagaggtcattcttagtttggctggggcttcccttgggtaggaaagataacgtagttctgaaccaggcagtatttaatgagtgttcactcagttcttggccaactactctaatgaccaagagtccacagaatctgttgtttatgaacgccagccttgaagtcagatcaagtcccagctcagcacctactagcatgtgtcccattggacagttgtgagaattcaatgggataaggcatgtgatatgctcagcacactggcacacagtatgatggagctgacacaatcttcccaccagcccctttctccccatttcctcccagtgcagatggacgtaaggagctctgcaagttggttaagtttcccttttacttctctcattccttcactggaggatggctaaggttgcagtgagctgagatcgcgccactgcactccagcctgggtgaaaaaaagatattgggtttgattaggggctacacaagggagagaatgcagtggtggtgggctgtgcaggaaaacctcaactgcttgcaaacagcatgtagttttagctgggcatgatggctcacgcctgtaatcccagcactctggaaggccaaggtaggtggatcacctgaggtcatgagtttgagaccagcctgacaaacatggtgaaaccctgtctccattaaaaatacaaaaattagccgggtgtgggggcacatgcctgtaatcccagctacttggatagttttcctggaatgacccacgttggttcctgtgctcaatgattcttttccaataaggcaatattcatctcgccttattggaaagggattttccatctagttggaagaatctctcctccgtagctacagccctgatggatagaagcagatttagattttcttttgacttttgaaccatttaatgataactaggcccttagacctccctccccacaaccccgttacagtaatgcccatggcataaacatggaatgtggtgtccaggaaactcggattctaacctcaatttttatttttctaatggggctgaaaggcaaggcaatgtctaaaatttatcgcagtttggatattctgcgtttttgtcattcccttgataaccaacgcagaagtcgatcagtcctaagaactaagatgatgaagcactcacactacatcttatatttcatcctctttcctgtctgcttagcgtaagctctgcttctcatcaggaagatttgtgacaagtagtggtaaattattcccaaagctcgcttgacccacggctaacaacatccttcacagtgggtgttgtgctaaacccctattaacctcattagggaggcaccaggttcaagaggctgaagaagagacccggagccagtaaataagacatggggtagctggctgcggtggctcacgcctgtaatcccagcactttgggaagctgaggcgggtggatcacctgaggtcaggagttcgagaccagcctggacaacgtggtgaaacattgtctctactaaaaatacaaaaattagtccagtgtggtggcgcatgcttataatcccagccactcgggaggctgaggcaggagaatcacttgaacccgggaggtggaggttgcagtgagctgagatcacgccactgcactccagcctgggtgacagagtgagactcagtcttacaaaaaaaaaaaaaaagaaaagaaaagaaaagaaagacatggggtttgattaggggcaacatacatgggagagaatgcggtggtggtgggctgggcaagaaaacctcaactgcttacaaacagcatgtagttttggccgggtgcggtggcttatacctgtaatcccagcactctggaaggccaaggtaggtggatcacctgaggtcaggagtttgagaccagcctgaccaacatggtgaaaccctgtctccataaaaaatacaaaaattagccaggtgtgggggcacatgcctgtaatcctagttacttgggaggctgaggcacgagatttgcttgaacccgagaggcagaggttgcagtgagctgaaatcacaccactgcaatcccgcctgggtgacacagtgagactctatctcaaaacaaaaacaaaaaaacagcatgcagtttatatagcattttcacttagcagcctccccttaatgacctccacctggcaactttcatttaatccaaaacttagagtttcaatcccctgtacaacatatgtttcatgggacaggccaggaactcagatgctcttcatagaccaggaaaaaatctccaggttggccactcctgattccctagctcagaacgcacattcaggtgcatctgccatacagagtcattctaagggtgtgctttagttattgctgtcaggtgcatttaccctacagtggcttatgacatggttaagagcaggcatttgaagtcaaatcccattctggctacttgctagctatgaaactgagacctgttctttcttcaacattcatttattcatttcaaaagctagtacagcgatattcctttggtgccgtggatacagtgatgaacagggcatacactatcccctccctgccttcaaagtgtacaatctactggcaaagacagccctgacaaagtgtgacccaagcgaggatatgggaagacccatttttatgagatcatttgcagaagccactactgtggtctggacagggtagaagtcagggaaggcttcccagtggcgctaagcctaagctgaaaatgaaggctgaataggagatggaggaagggaacctttgctgggcggagagaacctcatatatggaggccagagagctagagacagtggagtgccttaaactctaaataaattgagaaaagttcatctggaagtttctactctgtgtgtgtctgcgtgtagtttccttctttcctttttttttttttttggagacggagtctctcactcttgtcctggctggtgtgcagtggcgcgatctcggcctgctgcaacctccacccctgagttcaagcgattctcctacctcagcctcctgagtagctaggactacaggtgcccaccaccacacccggctaattttttgtatttttagtagagacagggtttcactatgttggccaggctgttctcaaactcctgacctcatgatccacccgcctcggcctcccaaagtggtgggattacaggcgtgagccactgcgcccggctgttttttttgtttttgtttttttaattttttcttttagtggagtgtggggtagagagggaaatggtgagagctgggactggagagcaactggagagctagtgagggccgggttatgaaaggggttcagaaccgtattaaggagaatagacctgtatcctcaaagtaatgggagcctcatagacaattttaaagagggaattacatgattgagtttttattttggaaaaatcaactaaattttggagaatggtttgtgtgggaggagaagaagttggaggatagagcagtgacctaaagcgatggccagaaagaaggcttcttgaaggctgagatcttcgtcagttttgtttctttcagcatcccagtttcttggaacagagattggtacataccagacaatcagtaattgcttgttgagtgaccgtggcctagaccagggcagtggctgtagggataaagggattcatgtggatttgagacctaatttgtgggccaagggaaaataatcagtgatgagtagaagggagttaagaaggattctcagtgttctggcttgagcaactgaagggaaaatggtgacattttctgagatgaaaaatccttaaactctttgagcctcagtttcttcatccataaaatgggaccagtagcccacatctcacaagtatgtaaagggagtagcctagtgcctgatacataaggggtaatcagtgcgtcaatgtgtccttcaggctcagatctcctctatagcatgcaaagttccctctataggttatgaagaaagcccacatggacattttcccagggtctccaggtttgaggttcccagagatggtgtcaggagcagcagcaacagccctacaagtggaaatgcatagccaggaaatgaaataaacaactgagattgctaattggagtttattttctaaaaatgaacagcgattctcagcatggcgcagtcacctgcaaagctggtccttaataagctattctggtcgttgtcaacatgaagaatttgattggacagaggagtagattggtggtgaggctttctgtagctaaggagtagttggggtggtgggaggtgggcaataatttagcagaaaggaagtgagtttgtttttaaactcacaatcctccctggggtacaactacttagggtcatttctccagtctcattttctgggaaactggaattgcacctggttatgggcagccagagcattgttgaggctgcagtttcctgtggacaagatgcaaccactggtgttaacaaggcccaggaggtcactcagagccaccgccacctctttctcttccatctactcagtggatggagaccaagcaacaactctctgccatgcaccacagtatgctagtactgaggttaccgagatgcacgagtcacagcccctgccttttgcaagggaaacagaccagcaaacaggcaatcacaatcccataggatgggagtccgtatttatttcctagggttgccataacaaatcaccacaaacttgcatggtggtgcaagtttaacacaaccacagaaatttcgtatctcatatttctggaggctagcagttcaaaataaaggtgccagcaaggctaggctctctctggtggatctagagattcatcattttttgcctcttcatagtttctggtattgctggttatccctggtggttcttggctggtaaaagcatcactccagggctcgcctctgtcatcacatggaattctccctatgtgtctctgtgtttcttctcttcttgtaaggatggcaatgatattggatttagggtataacctcatcttagctcagttacatttgcaaataccctatttccaatgaaggtcacatttaaagataccagaggctaggacttgaacatattttttaggagtcgggggacacaattcagcccacaacaatgtgagtacaagcgtgcctgatgtcctgtcgaatcagattttaccttgttacaagtgttatgggagcaatccctatgatgtgatctgcagttctctctctcccttttcctttttcctttttttttctttttttattttgcctcccttcctttacttcttgatttttttttttttttttgagatggagttttgctcttgttgcccaggctggagtgcaatggtgcaatctcagctcactgtaacctctgcctcctgggttcaagtgagtctcctgcctcagcctcccgagtagctgggattacaggcgtgcactaccacactcaactaattttttgtgtttttagtagagatggggttttaccatgttggtcaggctggtctcgaactcctgacctcaggtgatccacctgcctcggcctctacattgttgggattacaggcgtgagccaccgcatctggcctacttcttgacttctttcttccctttctgtagttttgtcaactcatactaattggtcatctcctgcatattaggcagagttctagacatcagggatggagtgcagagaccaaacagacacagttcctgtctctgagactcacgagttatgggggaaagagacagcagccaaacagtcacataaatacatgtcaaatgacaaccggaacaattggaaggggatcccttctgaatatgcagggtaacagcttgaactgaccttccaggggaacaattctaaggccgtaaagaccagtctccagccatagactgtgtatttccactctgtaagcatcaacatcttctagtccacaagatacaggaagaggagagatagaaggtcattgatttacttgggtccatgtatttgaaaccctctgcttgagaagtaggagaatagggaatgaggataaccaaaggttaagtcataagcaaaacaacagcaggtgcagccagttctaggcaagactgggcagcatacaggccacatcctcactctgaaataacaacatggaaatttccatttcagcctctgattgaccacaggccaagtctccacttcagcctctgattggtcatgagccatctccactttagcctctgattggttcttgggccaatccttcataggatataaccaactggaggcctctaaagggcgccaagtgggtgttaccaaactcttttagcttaataagaaccctaaacaacattataatgggagcgtttgagctgcttgttcaagcctgctcccactctgtagagtatacttttgcttcaataaatctgtgctttcattgttttgtttttttttgttgttgttgctttgtttgtatgttttgtttgattctttgttcagtgcaccaagaacctggacaactcacagtcaagcatttccatcccgtaacagttggagaataagcctgagtgacgggccttccatttagcaggtgaatctcagctgctacgtaaatcgtcaaagccagaacttggaatgtgaatatagccatgagagtgcctcagcaaggagccattatgaggtactgataaactgaccaccctataaaaaccaagggggccaggaagttataaatggttcagcagcatccagggaagtgggaaacactcacaaacctgagattatctggggggactcttgagcagcgttggggaagtcacaaccagtggtgagaggctacaaaggcaaggagtacgtggtgtttgagggtaaatgataggctggacctggtcagggtggggaaagggatttcctgggaagcgacgcttgtgctctgtttcccaggtccatgaagacaaagctgtcaaaaaataaaaatataaggcttcccatccacacccatgtaatactgtgaacggatctcagagtttggtgtcaaaactcaccaaaacatacacttaaatgggtgccttttatcatatgtaagtgatatctcaataaagtgaattttgaagatgctggtgatagccctctttgtttttgttttgttttgtttgcttgtttttgttatttcaaaagaaggtcttgctctgttatcttggctcactgcagccttgacctccggggctcaagcgatcctcttaccttagcctcccaaatagttggggctatggatgcataccaccatgctcagctaattgctttttaattttttgtagagacaaggtcttgctatgtttcccaggctggtctcatactcctggactcaagcaatcctcccagcttggtttcccaaagtgctgggattacaggcatgagccaccatgcacagcccctctttttttaaattctgggtgtcaaagccatggtagaagcctttctaattttgctcaagagtcattggatcctgtattatataatgtcagagcctggagagaatcccaagacaattgggatcaaacacatcattttatacaggaggtgactgagtttcaggagagacagcaaggtcatagtcacagcagtcagaaggatgcgccatagattggaaaaatccagaaggtgggagatgggtggagtgacatgctcttagacaatctagcccatgtgctgaggtcagagaagttagatttgaggtccttcagctagtcagattttggccctaaatttcctggccatccacttccttctgtccttaacatgttctgtgaacactcagtcactgctacagtcatacacagattgcatttattttcatatctctttgcaaagcttcttctgcacggggtgtcttgatgtgttcgatgatctgggtctatttaggatcagctcagactcggaaaccggggtggggccaacatcacgaaatggaagaaattataagccaggcatcatagtctggagcagaggtcttcaaacattggtatgtatcaaaattaaagtgccaatccctgggatccacatccagagattctgatttactaggccttgggggtgtctgggaatctgcattgataacccacaatgcaggtgattctgatggaggtggttcaaggacgagagtttgagagtccctgtcctctagcaacctctggattaaacatgggagaaaacaaatagacctgggctgttgactgaccaatgaactttcaaggtaacccgcattcaaaatattctgtatttttcaaaggatggtaatggaaaagaaacaatgacaacaaaagcctgtcttgaacacatacttatttgtggcagttttcagaagcgtattattttctagtgatggagggattttttaaaattctgctaagccttcttttgagtcactctcttgagatatatttcacataccatacaattcaaccatttaaagtgtacaattcagtggttccagtatattcagagttgtgtaaccatcatcatcaattttagaacattttctcctccctccccaagtcctactcccattagcagtcactccccatttcctccgaccccctccacccctaggcaaccactaatctactttctgtctctctagatttgcctattctggacatttcatataaatgaaagaaaatgacacaggttctttcgtgagtgggttcttttgcctagcatgttttcaaggttcattcatgctatagcatgtatcatatcactatttcattttgtaagttaccaagtagtattcctgatgatggattttaaaatggaacttctctcttttcacaagttgaacagctatctttcctctagaataacattttcacaagtggaacatctattttccttctagaacaagaggctttgtagcagataggaatgtcagatgcactgcaaagacttaagaatcttattcaaggcccaagtgacctttccagcctcatctccgtcaattttgcacttccttccatgacgttctagccacacaagacacctctggggtctcccctactggcctctggtcaaaatagcatggcttcttgtctgtgcagtgaatgcctcccctaattctgaactcaagcatctccttgcctggacctttctctcatttttgcccttgatcttgattgtaggtcttttcattttgtgcaatgatgggtgaagtcaccactctttagactggtgacttctctaacagaggaactgaattttcttaatttttgtattctcagtgcctaactcgttcttggcaagtatggggtacttggttaatatttgttgaatgagtgaacgaatgaatgaacgagtaaatgaaagctacagaagccagcatatatagaatgaaagtcgtttttccctggaagttttaacatagtcattttaattcctcctgtttgaaatgacttgtttgcaaaagagtaaaaatgacaatttaaagaatattaaactgcataagcatgaaaaacaatctgctaacagtggttatctctggggaagagttaagaagagctggggggtgttttcactttttctttcattagagacttcaaaagaagaaaagtggtgtaaaaatgggtgttgtttttcttttatggtttttggggatttttaaacataaaaattataaaaaagtaaataaacaataagaagcagagaaaaggaatgtctacacattgttggtgggaatgtaaaatagcacagccaccatggaaaacagtatggatgttcctcagaaaattaaaaacagaactactatatgattcatatgaaatttctatctcagtttaagccattgctagtttgggtctctgttacttacagcggaacctaattctaacaaacacaaatgctttagactcggatctgagtaccaggctggctctgggtgacttgtggcaaatcacttatcccttctgtactcagtttcttcatctgttaaaggagaatgaaaaaaacttacatcatgggaccactgtgaagtttaaaaagcacagtgcctggcacagcaaggacatttttatttattatttatttatttattttttgagaaggagtctcgctctgtcgcccaggctggagtgcagtggcatgatcttggctcactgcaagctccgcctcccgggttcacgccattctcctgtctcagcctcccgagtagctgggactacaggtgcccgccaccgcgcccagctaattttttgtatttttagtagagacggggtttcaccatgttacccaggattgtctcgatttcctgacctcgggatccgcccgcctcggcctcccaaagtgctgggattacaggcgtgagccaccgcgcccggccgcaaggacatttaataaatgacagctcttgccattgttattagcaataatgataacagcaataaacagaaaaatgacaaatcaacgtatatgaaggtcccttttatctgtaacagactttgaatccaatttgatttatagcctgtctgcttatgctgggtggcttaacatattgattatttgaaaaccgtgtggcttagccctagaatggaggctcatttaataaactccacttattgggtgattatgcagaaggcagctgcaatgacctccaggacagagaagcctgatgataatagtagctaccatttattgagcccttactatgagctaccacttagtctaacacaatcccatgagaccgtataattcccgcccccccaccccgcccccctcccccggccccgccgccattccacagatgagaaaatgaggcacagatagcttaaatgctttaaatagctagtaagtggcttagtcaagattcagacccaggttttctgaaccaaagttagtgagcttttcattagactagttgctgctcaagctacaaataatatggtgtaaaaaaaaaaaaaagcggggggtggggcgcgggggggtgggcttggcatggtggctcatgcctgtaatctcagcactttgggaggccgaggtgggcggatcacttgaggtcaggaattcgagaccctctggccaacatggtgaaaccctgtctctactaaaaatacaaaaactagccgggcatagtggcaggcacctgtaatcgcagctactcaggaggctgaggcaggagaatcccagtttcaacctgggaggcggaggtagcagtgagccgagatcacaccactgcactccagcctgggcgacagagtgagactccatctcaaaaaaaaaaaaaaaaaaaaaaaaaaaaaaaaaaaaaaaggaggaagaagggagataacaaaagggtattggggctttaaagaagggtcagcagttctccaattttcacatttgacgactcatttaattccccaatgagtcctcaaagtcttggaatgaagtatggtaacctcttgctgcagtcactcatgccagggagttctgtgaaatctggggaggggttacctccagtacccaaggatgctgagcaagggactatcagttgtccctctatatccaatcttccttcttccaaagtaaaatgatttttcatggagcatatattaattgttgcctagaatcaagactatgcttcccatccttgcttgcagcaaagtgtggccatgtgtctaagttttggccaatgagatataagtaggaagtattatgtacaactttgggtttgtttctttaaaaggaatgggtatgctcttctttgcttttccctttctgctggttggattgcagatgtaatggctggggcagctgtcttggcaatgagatggacatggaatttgcagtagaagaaacagacagaaggagctcgggtctatgatgctgtcataaaccataccagctttcaactaccttactagacttttcgtgacagggagaaaaaattttctaagtttaagcgattgctaatttgagtctctgtcacttacagttgaacctaattctaacaaacacagatgctaccctgccattcattaccctatcctccctttcagtggcccccaatttctttttgggggaattctgtcaccaaattagatgccttttaaaattgacacattgtattgtacatatttgtggggtataatttgatattttgatgcatatgtattgtataatgatgaaatcagggtatttagtgtgtcaatcaccttgtgcatttatcatttctttgtggtgaggacaattacaagcctctcttccagctatttggtaatctacaaaataccttacttttaattatccttgcccaactgtgcaaaggaacaccagactcatttctcctatctaatgtaactttgtaccagttgatcaacctcgccctatcatcccctctcgcattccctccccagtctctattaaccattgttctattctttgcttctataatagcgtctctgttttttttttagattccacatatgagtgagatcatatggtatttgttttttcatggctggcttatttcacttaacatgatgttctccagatccatgttgtcaaaaaattacaaaatttcattcttttttatggttcaatagtattaaatagtgtatatatatcagattttctttatccattcatctactgtaggacacttgggtggatttcatatattggttattgtaatagtgctgcaataaatatgggagtgtaggtatcttttcaacatgctaatttcatttcctttggatagatactccatagtaggatggctgaatcatatagtagttctgtttttaattttctgaaggaacatccatactgttttccatagtggctgtactactttacattcccaccaacaatgtgtagacgttcctttttctgtgcatctcaccaacatttgtttttatctgtctttttgataatatctagtctaactggagtgaggtgatatctcactgcagttttgattgccatttccccaattattagtgatgttgagcatcttttcatgtaactgctagtcatttccatgtttcctttggagaaatgtctcataaggtcttctgcccattttaaaataaagttttttgttattgttgttgttgagttgtttaagttccttatgtattctggatattagtgtcagatgtctaatttgcaaatattttctcccattctgtaggttgtttcttcactctgtttattgtttcctttgatgtgctgaagctttttattttgatgtaatcccatctgtctacttttccttttgttgcctgtgcttttgaggtcttattaaaaattatttgcccagcccaatgtcataaagcatttccccgtatgttttcttctggtagtttcataggtttgggttttacatttaggcctttaatccattttgaattcatttttgtatatggtgtgaggaaggggtctagtctcattattttacatgtgaatatccaattttccttgcaacatttgttgaagagatggtctttttcccagtgtgtgttcttggtaactttgctgaaaatcagttggctgtaggcgcacgaatttgtttctgagttctctgttctgtttcattggtctatgcatctgtttttgtgcctgtaacaggctgttttggttactatagctttgtagtgtattttgaagttgagtagtgtgatgtctccagctttgttctttttgctcaggattgctttggctatttgtagtcttttgtggttccatatgaattttaggattgatttttctatgtttgtgaaaaatgtcactgttcttttgatagggattatattaaatctgtagatcactttaggtagtatggtgattttaacaatattaattcttccaatacttggacattgtactttttgtgcaggaatttaagaaaaattgttttaaaaattaaaaaacccaatacttggacatgggatgtctttccatttatttgtgccttaattgattttttcatcaatattttatagtttcagtgtggagatctttcatctccttggttaagtttattcctaggtatcttacatttttgtagctatgatatgtgagtttttttatttctttttcagatagtttgctgttagcatatagaaatgctactaatttttatgtattgattttgtatcttgcaaatttgctgaattcattgatcagctataataattttttggtggagtctttagggttttctgtatataagatcatgttgtctgcaaacaggaacaatttgacttcatgtttttcaatttgcatgatttctatttttttttcttgcctaattgctctggctaggacttctagtactatattgaataggattgatgaaaggaatatctttgtcttgttcctgatcttagataaaaagttttcagcttttcctgttcaatatgttcttagctgtgagtttgtaatatctggcctttatggtgtggaggtacataccttctgtaacaaatgtgttggcagttgttaccataaagaaatgttgaaagttgtcaaatgctctttctgcatctgctgaagtgatcatatggtttctgtctttttgttaatatggcatatcatgtttattaacttgcatatgctgaatcattcttacatccctgggataaatcccacttagtcacagtgaatgatctttttaattttctgttgaatttggtttgataacatcttgttgagaatttttgcatctgtatttaccaaggatactggcctgtagttttcctttttgttcttgtgtctaccttatattgcaaccagggtaatgctagcctcaataggtcctgggcttttttccaatggcagacattttattattgattccatttcctcactcagtattgatctgtttagattttctatttctttataatttaatcttggtaggttgtatgtgtccaggaatttatctatttcttctatgccctcaacttctttgatatatagttgttcataatagcctctatgatcctttgtatttctgtaatattagttgtaatgtctccatttccatctctgattttatttatttggatattttctcttttttttttaagttagtctcactaaggatttgttgattttgattatcttttcaaaaagccaactcttcttttgttaatttttttgagttttcttttgttctccacttcatttatttttgctctgagacttattatttccttccttctaccattttgggtttagttcttagttttttagatcctggaagtgcatggttacattctttattagaaatctaataaggatttattagatagatagatagatatattaggtgtttattgctatgaaattccatctcaggactgcttttgctgtattccaaaagttttggtatgatgtgtttccatttttatttatctcaaataatttttaaattttccttttagtttcttcattgatgtattggttatttaggagcacgttgtttaatttttcacgtatttgtaaggtttccaaggtactcttgttgttgatttctagttttatactatcatggtccaaaatgatacatgatataatctctgtcttcttaaatttgttaagacctgttttgtggtctaacatatgatttattctggagaatgttccatgtgcaattgggaagaatgagtatactgtaactgtttaatggaatattctgtaaatgtctgttaggtccatttggtctatagtgttgtttaagtccaaagtttctttgttgattttctgtctgggtaatctcttcattattaaaactgaggtgtaaagtcccctactattattgtattgcagtctgtctctctttagatctaataatatttgctttacatatttgggtgcttcactgttgggtgcatatatatttatacttgtgatatcatcttgttgaattaatctgtctatcattatataatggccttctttatttctttttattgtttttgacttaaagtctattttatctgataaaagtatagtcactcctgctcacttttggtttctgtttgcattttttctatccctcactttcagtctgtctgtaatgttggggtaggtctcttgcaggcaacatataattagttcttgttttttaaaatctattcagccactgtatatcttttaattgcagcatttaattcatttacattaaagattgttattgataagtaaggacttactcctgccattttgttgataattttctggttgttttatggatcttttgtgcttttatttctctcttgttttcctctgtggtgtggtgattttctgtggcactaagctttgttttctttttctttctcatttgtgtatctactgtaatgtgtttctttgtggttaccatggggctaaaataaagagtcttatagttataataggctattttaagctgataacaacttaattttggtcacataaaaatcctccagagggccaggcacggtggcttacacctgtaattccagcactttgggaggccaatgtgggcagattgagagcagcctgaccaatatggtaaaaccccatctctactaaaaataaaaaaattagctgggcatggtggtgtacacctgtaatcccagctactcaggaggctgaggcaggagaatcacttgaacctgggaggtggatgttgcagtgagccaagattgcaccactgtactctgtcctgggtgacagagtgagaccctgtctccaaaaaaaaaaaagaatcctccagacttcatacacccacacacacacacacacacacacacacacacacacacacacacaatttgtatgttgttagccttaatgtacatgttggtcttttgtgtgttccttagccactaattgtagttgttcacgtttttgacctttttgactttaaaccatcatactagaggatttaaagatttacacagcaccattacagcattggggtattctgagtatgagtatgggtttacctatactggtgagttttatactttcatatgttttcataatagtaattatcatccttttgtttccaattgtagtactctcttaagcattttttttgtaacacctgtctatttgtgatgaattctctcagtttttgcttatctgggaaggtctctacttctcatttatttctaaaggagagctttgcaggatatacttcacttaatggtgtctcataagtcttgtaggcttcttcattctttttaacttttttttctctgactgggttatttctaaacacctgtcttcaagtttagaaattctttcttctgcttgatctagtgtgttgttgaagccttcagttatttttatttcattcattgaattcttcagttccaagatttttttcctctatttttattgatacacaatatttacatatttatagggtatgtgtggtattttgataattgaatacagtgtgtaataaccaattcaggatatttaatatacccattaccttaaacatttattatttctttgtattgggaacatttcaaattcttcagctccaagattctgttccctctttttttatcgattaataccatttgtaaatatttacgggatatgcagtattttgataaattcatacaatgtgtagtgatcaattcaaggtatttaggatatccatcaccttaaacacttcttatctctttgtgttggggacatttcaaatcttctagctacttttaaatatataatatatatacaatattttgaatatacaatatattgttaactatagtcactctactgttctatcaaacactagaacttatttcttctatgtaactgtatttttgtacccattaaccaacctttcttcacctacctcccaccctttctggcctctggtaactatcattctactctctccctccacaaaattaacatttcaagctctcacatatagtgagaaaatgtgatatttgtttttctgtacctagcttaattcacttaacataatgaccattggtttcatccatgttgctgtaaataatagaatttcattctttttatggctgaatagtattccattgtgtatacataccacattttctttacctaatcatccattgttcaacactttggttgattccatatcttgactattataaatggtgctgcaataaacatgagggtggaggtaaccctttgatatactgattttcttttatttggataaatacccagtagtgggactgctggatcaaatggtagttctattcattttttgagaaacatccatacagttttccataatgaatatgttaatttacattctcacccacagagtaaatttccttttctctgtctctgtaccagcatttgttgtctttttttgtctttttgataaaagcaatactaactggggtaagatgatacctcactgtggttttgatttgcatttccctgatgattagtgatgctgaacattttttcctatacccattggccatttgtatgtcttcttttaggaaatgtctattcagatctttttgctcatttttaaatgggattatttgtttcagctccaagatttctgtttcgttctttcttttttgagacagggtctcactttgttgcccaggcttgaatgcagtggtgcaatcatggctcactgcaacctcaatctttagggctcaagcgatcctcccacctcagcatcctgagtagctgggactacaggtgtgcatcactacacccaattaattaaaattttttttaatagagatattgtttcactctgttgcccaatttggtcttgaactcctgaccacatgtggtcctcctgcctcagcctctcaatgtgttgggattacaggcataagccactgcacccagccctggttcttttaaaacatctatttctttgttaaattcctcattcagatcataatttttttgttttattgaattatttgtattatttggtatattcttgaatttctttaagattattattttgaattccttttcaggcatttcataaatatccttttctttggcgtctgttactggaggcttattgtttctttgagggtgtcacgtttatttcctttttcttgtgtccctatgttgatatctacacactttgtggaacagttacttttttcaattttatggaataacttttatagaatgaggcttttccctgtagaagggccctagggtatcagttgggaatggtgcactggttttggttctaagtggactgagtcatatgatctccatacagattatttagctataatctttgtctgcaatgtctgcaattgtgtcaggggccttggctatgggagtttgtgacaatggtaacataatgtttctggggcctagggcatagaggtggttgtcgggccaggtatctgcaggtgtggtgggttgacaggctgtgtagtgggctctcttggagagtgggcctaccactgggctggctctcagggtaggtatgggtgtagcatgccaggtggctgtgtggggctttctttgtgcgatgggaccacctctgagccagctcttggtctgggagtaggctggctgactgggcagggcagtagccccaatttctattagtggtttcatgcagttctagaaagtcttcacagggtggagcatatgacctaggataaaccaatcataacattttattccctctgctacagtgagtgtttctgggacaggtttgtgacctaagcttgcccagtcagaaggaatcttaggatacttgcagagattgctgagtcaaagacatgctcttttgctatggaaagtatagcatgtgcatgtgaaacttggaactgtgaatatcatcttgctgtgatgaaggaaacctggctgagaatgaagctgacataaggaagtaaaaaaaaaaaggtacaatgatagacaaacagaacgagagtcttgatcaaattatgcctaaaatctgttaccttctgtgttcttcatatttgtgaaccaatatgttgcctatattgtttgctattactttttggcccttatattctaagtcaggtttgggatggattttcttatttgcagccaattatatcctaattgatagagatgtcctgatgtgttttggttctgtgtccccacgaaaatctcatctccaattgtagtccccatgtgtcaaagtggggaggtgattggattatgggtacggtttcccacatgttgttcttgtgatagtgagtgctcacgagatcatctgatggtttaaaagtgtggcacttccctcttcactctcttcctcctgccactatgtaagacatgccttgtttccccttcatcttccgccataattgaaagtttcctgaggcctctccacaccatgaggaactgtgagtcaattaaacctcttttctttataaattacccagtctcagatagttctttatagcagtgtggaaatgaactaatacatgtcccttcaccttctaccacatatagaaccaacaacaacaaaaagaggaaagtactttgttagctcttctgaaggaagatagagttacagattgaatcagagatatttcctctgtgatccttccctgatgtccccagttctgggcaaagagccctccttgatattcccatagctccttttcattctcatctcttataggaaagggagtctttagcataatacatcattgcaattatgctatgagagccaatcagtatcagcaagaagtttgcttatctagtgtctagttcattctgatgaagttaagagaattaccaagaagaaaggtatctgccatttttctttcaggatgaaggcaggaataacaaaaccatgcttttgaccatgtagggagctgaaaggatggagtcaaggccttgaggagacagcagagaggcaactaagagaagatggcaggcagccagaagaaggcacaatcccaggtacccatttgagggaatccaatgggggaaagtaaagaaacctggacgttttaagtgtggtgatcagattatgctctttctggctaaggactaggacaaggccatccaagtgcagaacaaaatggtgggtttgcatttgtttgctgtcaatctcccctgtcaggtcaactccacgaggacaaggatgataatggcttggccaccattatctccccacagcacagcacaatgcctgggacatgaaagatacgttacaaatatatgtgggatggatggatggatggttggttggtaactctcagtttatatctttgggctgagtattatagttaagaacacagtttcccagagtgactcagttaaagttgagcttcttttatgcaaactctccttctctgtctttcactgaatttcactgacagaccatgaaaactcagaacagaaagggataatgtcgaggcgaatcgtataatgtcaaggcaaatcctgtctcccatctagaggccagggaaggaaattaatcactttgctaaagtctggaattctagttcctctgtctgatggttgatttaaggtcaacctctgcttgacttaaggtcaacctctgcttgacttaaggtcatggtgtattattttttaacatcattatgggctacactcatgaaaatgcctaaacataagagaaagatgacaccttgttctcttgctccacatgtacatatatctgacctctattcaacattcatttaaactgtgattcaatgagcatctactatgtgccatgcactggactcagccttggggacagaatgaagaataagacacagcctctattcttacctagtttataatctagtgggggatgacaagccagtgatgataatacagcacaagatgcagagaggcagaggttgcagtagggacccacataggaacattgaagtcagctggtgggattgaggagcacttcctggaagaagttttgcttaagctaagcacatggaaaagcaccagccaggtgaaacggttacaaaggagaggaatgtttcaggaggaaaatgggagtggtgattggagggtgatggcaccagagtgaaaagctggggtcaagcattttagggccttctaggtcatgcttagcatttcagacatcctaagagcagtgtgtgctggagtcactgggaagttttaatatgggaataatatagggatataggatatagggatataggaataatatagaaagttttaatatgggaatttaatataggaagtttaatatgggattaataatatagatataacctatagaaacttcctctggggcagtgtggaagggagattggagggggtcaaggttggaaatgaggacaccagtttggtggctattttaacataagcacatgcactcactagggcccaagcatatgtactcactctcttgctctctctccctccctccctctctccctccctccctccctctctccctctctctccctctctccctctctccctctctctgcctctttccttctctctccctctctccctctctctccctctctcttcctctctccctctctctccctctccctctctccttctgtctctctttctctctcacacacacacactcatacacacacacacacacacacacacacacacacacacaccaaagatatatgcaagcagcaccaaagtatgcccaccactggggctggaaaacaatgtcttaggctgctccatttcctaatgccttaattttctcatctgtagaatgggaacagctgcaactgtccctcggtgtctcccaggattgctcagagagtggaaatgtcatgtggtgaaagcctttacagctcagtgtggataagtgcaaagggctgtttattcctggtcccttttcatttcatccagtccttcaatccccagcatctgaagcatctctgggaactgcatatggaataagacattctggatgacagcagatcttaagaaagtcaggtttagattagatttccactcaatctcaaagttgaaattagagtaggggaattgaggtcttacctctagacactataactgagaaattacaaaattggctggagactcccaggcaagggtaggaagccctctggcttgggactcttttgaagggatgattccactgattggacagtgttcacactcttggctgtggagtacctgtgtgagtctcctagggcttcttaacaaattgacacagactgggtagctgaaacaacaaaaatgtatttctcattctggaggcgtctctctgtgacgtctgagatcaaggtagtagcaggatcggttccttctgaggctgccctacttagctgtcatctcgctgtgttctcacatggtgttccctctgagtacatctgtgtcctaagttcctcttattataaggacactagtcatagtgtccaccctagtgacctcatttttacttatttacctctttaaagaactcatctcaaatacagtcacatgtgaggtgctaggggaattttggcagaagtgggaaacaaaattcagcccacagtaattcccaaatcgtctatttgggtagtggatataaacaaacagtgaggaaatcccaagactgtacaaatttctgctgaagtttatcctccaacgaagggtcctcaattgaatagatttgctgtcatctcagttgtggcagcatccatattttcctgttctttatctcagctctgaggtgctgctgcagaaaggtgctggtctacattcagttctctctttctttaccactttgcagaacaagttttgctatggcaaccactggctgggaagagataacccagggggtgcgagggtcagctcatgttcttctctcctcatttctaggacagctctgttgtgcttcagctgctgtgtaaatccccaaagaggagttttttgctaataattgtgtgtgtgtgtgtgtgtatgtgtgtgtgcgtacctgcatgcatgcatgtgcatgtacgtgcacacgtgtgtgtgtgtgtgtgcgtgtgtctgggcaaagtggtaccttcaagaaagtagccaaatggaagataggatcaccctgaagagggaagccattcactcattgaccaatgggtcacacttggattttctgtctcaggccaacccacattctagtgactgtgcagcccttggcagttttcaactggctcctcctgcctacccagcagatgggaataatactctgcagacttcaaatcctcttgattctctctcctccaggttttgaaggcagattttatctattgtgcctcttgggctttggtgtctgggccattcacagctacccacctagagacccctcagatgtgtcagaagtggaagtttgtcatgggaagaggaggcagtaatgtgaaagcaatgtgaatttttgctattcgaaggggcacatgactcactgagtcatctgcctgaaagccatcttcagtgtcccctgggccttgaagacgtgggaggcagtgtttgtggatgagaaaggggacattcggagcagagatctgttcaagtctcctggcacaactcaggtcctccaccttggagtctgtcttgggtggtcccaagcatcataaatcctctggaatctgccctgaacacctggatttcctgctagggtcttcagtttgcccagtgatgtgtccatggccagctttgtgcaaagtttgctttccagctcagttgctctgctgcagtttaccaaacttgctagtggacagacacagccttgagcagtccctgtggcttctcggggcatctgtcaaagatgtgcacacagaattcaacaaagttccggttcctcccttgggaggataataattttgtgtgtttgtatatgtgcatgcatatgtgtgtgtgtgcatgcgtgcattcatgcatgcatgtgcatgtgtgtgtgtgtgtgtgtgtgtgtgtgtgcgcgtgtgtggctgggcaaagtgataccttcaggaaagtagccaaatggaagataggatcaccctgaagagaagcctttcattcattgaccttatcctcaggaagccagacgtggtacccacagaggccaatttagatctccggctgtttctctacttccctgttggccctatttgtatatttctagcatgccttttctttatttgttcattcactcattccttcattccacaaatacctattgagcaccagtgatgtgctaagtatggcttaaatttaccctgggaacacagaagtgaaatatacaaatctcctgcccttgggtgcttatattttagtgtgagagggtgggtgagtggatggagggaggtaggtctttgcacttgcgttttcatggattataacaaattttcacagcacttttaattccatgataatctctaactggaaaagcaatcccctcaatacacacctcccaccactttatcctgaatctctgtcctggattgtgaagggatgtcaggcatggcaatatgcttttatgcattttccttttgcttaactcagggctttttaacccattctgtgctctggactcctttggtggtcctatggacccctcctcagaatactctttttaaatgaataacaaaatatgtaaggttatgaagaaaaccaatattttgaaatgcagttctgaaaatctttttaaaagttgtggtattataacttttgtgcccttttattaacacattaaagaacatgatttagcagtgggtttcataacaactgtgatttcaaagtactgatgagcataaatgatattttgaaatatctgtaacacctgcaacgtgttatgaaaatatccctgatttctattggtgacaaagtcctaggtactgcaaatagtaatgtggtttgttgtcactgtataaatctgctaggtctgccattacaaagtcccacaaactgggggacttaaacagcagaaatgtactggtgtgtgtgtgtgtgtcttggcaaagtgataccttcaagaaagcagccagatggaagataggattacatttcaacagaaatgtaagacagtacatttctgtggtttaagcctcccagtttgtgagactagcccaactctgttactagggtcttgcttttaacctaaaggatgtttcctcaattgtattcaagtacaaacagaaaggtactttgagttctggaggctcaaaatccaagatcaaagtgttggcagggctatgttcccactgtaggcactagaaaatggccaagataatacaacaatctacacatacacctcacacataagaaagagaggtaggcattgtgtttttgagaaacaaaaggctccaactagcccaactctggcactagaggcttacttttttcttgatagcctactacatacctccctcactctcagttctctgacaaacaactatagcaacctcaagtgacccaatcttctaacactgaaatcacctaaggatattatgcaactctaggaatacatggtgaagggaaactacctccatttttaatctaaaagccaaatgtcattatgtcaccccctggcactacaccttgaccttctcattggtttcaaaaatccttaaggtagctttcaaggttccttatgactggtccttgcccacctccctggcctcatcccactcctcattaagccccaagatggtccagccacctgccttctcacaggccattgagcacacccatcttctttctgcctctggctttagcacgtgccatttgttctgctgtggttcagaagctttaaggttttctgaaagatgtcaggatgatatggttttgctgtgtcctcgcccaaatctcatcttgaattgtagtttccataatccccacatgtcatgggagggacccagtgggaggtaattcaatcatgaaagcgggtttgtcccatgctgttcttgtgatagtgaataagtctcatgagatctgatggttttataaagagcagttctccttcacacaggctcttgcctgctgccatgtaagatgtgcctttgctcctccttcaccttctgccatgattgtgaggcctccccagtcatgtggaattgtgaatccattaaacctctttttctttataaattaccctgtcttaagtatttcttcgtagcatatgaaaatggactaacacacaagggaatgcacttttctggcctctgaattagcaaagggaaagacggtgtaaaacccaagagtttacagtcctgaggaatgcactttgcatatgagtgagagtccagttcatctaaagcattccatttttgaatggagctatcagttcctgggcttaaaacttaagttctgatttacgtctctgtatgtgtttgtgtgttttgtatgtggtttttggtgaaaataatttcttacaggcttggaataatgagctccctgaatgtgcaagctttggaaatagtaatctacctgtgctaggtaaactgtgtctgaaatgttacctgttgagacaaaaatattcctgggaggtgtgattggatgtgttctgtgtgtgcaaggggtggtgtgtgtgtgtgagtgtgtgtgtgtgtctgtgtatgtgtgtatgtgggggggggggcagtgaggaagagagagggagagaccttagcccaaaggagtgtttcctgaattgtattcatttgttcactgcctttaagatttttgctatattcaactaccatctgtacttactttcttacagggatacattttcatgttttctttaaattgacccattttttgtaaacgtagcttcaacctgaaaagactatccaacaagccacagacttggaggcaataattgaaaacacacatctaagaaaggtctggtatctaaaatatatacaaagaactcttaaaatccagttataagaaaacaaagaacccaaattaaaaataggaaaaatacctgaacagacacctcaccaaagatatacagatggcaaattagcatatgaaaagatactcaacatcatatatcattggagaattgcaaattacaataacagtgagataccacgtcacacctattagaatggctataatccaaaacatggacaatgccaaatgccgaagagaatttggagcaacaggaactctcatttactgctggtgggagtgcaaaatggtacagccactttgcaagacagtttgacactttcttacaaaactaacatactcttaccatatgattcagcaatctcactccttggtatttacccacgtgagttgaaaagttatgtccaaacaaaaacctgcatataaatgtttatagcagctttattcataactgccaaaacttggtgctatgatataaatgttttttatccccgaaatttcatatgttgaaatcctagttccccaaagtgaaaggggtggagctttggggaggtgactagatcatgagggcggagccctcatgagtgggattagtgctcttatagaaaggcccaagggagcttgtttgtcccttacaccaagtgaggatgcagccagaaggtgctgtctttgaggaatgggcacttatcagacactgaagccagtgctttgatcttgcacctcccagtctctacaactgtgggaaatcaatatttgttgcttataagccacccagtttatggtatttttgttatagcagccaaagcagactaagatacttggaacaaaccaagatgtccccttcagtaataggtgaatgcatgcctatggtacacccagacaatggaatattatccagcaataaaagaaatgagctaacaagctgtgaaaagacatggaggaatcataaatgcatattgataggtgaaagaagccaatctgaaaaaggtatgtctagtatgattccggctatagcacattctggaaaaggcaaaactatgggggcaggtaaaagattagtggttgctgggcgtgggtggatggagggatgagtaggtggagcacagaggatgtttcgggcagtgaaactgctctatataatactgtaatggtagatacatgtcgtcaacatttgtcaaaattcttagaatgtacaacaccaagagcgaaccgagatgtaaactattcactttagttaatacgaatgtgtccatattggctcattgattataacgattactactacactaacaattagtactacactaatgcaaaatataaataataggggaaactatgaggggaagcagaagaggatatatgggaattctttgttctttccagtttttctgtaaaataaaattgctcggaaaaaaaaatctgttattaaaaaagaatatcatatccaaggaatcacatggttgatgttctcctagttatatgttttcctgcatatgaatacatatacaactgttagaagaaatacaaagtaatgaaaatgtgccacccaaaatcatcttaccagtagaacttgaaccacatactttaaaaaaccacagttccatccctattttttaaaagtagtggtcccttcctcatctccctgcttcccctaaataaaatctcagcagacagacaggctagagcagagctgcttgggctaagatggggagaggcggcctggcgttctgcagccccctctctttccaccttattttccatgaccccctccctttaaccctgacaacaccacagaaccctgctgctatcaggaacacagctgagaaaccactggtctaaaggtcagcatatttggtagagcacaggatgccctgattcccatccaaagacccctggcaactgtagggaatcctctaagctcccctctgccttggttgtctcctgtaactggagcccccctggatctatcttgcaaaggtgtgatgaagacagagactaagacagatccatgtgtccttggaagagtcttggaacacagttattccaggctgaaaggatgcaagtttaaccctttaatacatactgcttgctgatgggagtagcaattggtgtgaccactgcagagagcaatttggcactatggggtcaaattgaagaaggaactgaccctttgacctgccaatgccacttgcaagtacatgtccaagtgtgagttcagaagctcttaaacatgttcatgaggaatatggtcaaaggctgttattgcagtagcatttgtaaatgtgaaaaactggaaacaacctgaatgtctatcaggaggagaatggataatggcattattgtagactcacacagtggtatgctagacagctgttaaaataaactagatgtgtgtcagcatggaaggatcttgaaacataatgttggttgaaaaaaatcaagttccaaaatgatatgtatgacatgattctgtccttatcaatactaaatatactaaataaactgaatatagtttatagatatatatataggtaatagattataaagacattagaaaaatatgtattcatgataataggcagggaaggggttctggggaggaggaacacaaattgggtggctttacacacacatacatacacacccaagcacactcttacacaaatctgataaaattctaacttttctcaactttggtaaatacatatttatttaaacatagttgtttttacttcctacatttaaattaagacattattttcatttggctacaatctatcaaacagttctgtagctcttactaggtatcagattttacaaccttcctaataaccccaggaggtactgttttagaagggaggaaactgaggcacagagaggctaagccactcatccaaggtaaaacagctggtaagagcagagccgggcatcagacccaggtagcctgacacacagtccatcttctcaagcacgtgccacaaggtatccgtggcttgtaatctctcacttgggttccttacatgtaccctgtggcccctcttacactacccattgtctactttgtattaagcgttgtaggagctaagttcacttctccctcttcgtactcctccagctctagcctggctcctgggccatagtaagtcaatagcaactgctgttgaacaacggaatggatgcatgcatgagtggcttcaggttcctggaagctgctctgtgccagtatcatgctcagggtcatcatctctgagtcatctgctgccatctgatgttacccaggatgttggcactaggtatatggaaaatcagcccaactggtagaaaaaaaactcaaataatgtgggatgtttatttcagaagcactacctttctccctctacactggagtagttggtcagggaaaatggtaatttatattttagaaaatatccaggcctccttgcaaatccattttctttctcccactaattcacagtgaacttctggtttcaatttaaatgacaattctgagcaaccttctcttgccactttgccccttccctgctgctattctgcctcgtattaccccttttccatacaggaatttttttttttttttttttttttttttaaacagagtcttgttctgtcgcccaggctggagtgcagtggtgccatctcggctcactgaaacctccacctcccgagttcaagcaattctgcctcagcctcccaagtagctgggatttcaggcgcctaccaccatgcccggctaatttttaaaacacttttagtagagacagggtttcactatgttggccaggctagtctcaaactcctgacctcaagtgatcctcccgcctctgcatcccaaagtgctgggattacaggcatgagatattaaacgtatcacaacttataatcatgtatttatcggtgaattcactctttctaatgtctgtctgttggagagtcaactccaagagtccaatcaagcatcatgcatgtttggctcataatttattgccagtgcctggcacagagtaagtgttcatttatcaccatggaatgaatcttgctgcttaatgcagtggcttgactgaaagacattctacagaggcttccttcttttatttaacagcaagactccttttattaaatgaaatggtccagactcccttatataaaccaacacatggctccggttacactggggaggacgtgtgattggggaggatctgcttggcctgacttctccctgcttttcccaagaagcttccagaggcatctcccagcccaccccttggcaaacttttctgagccctgatcttgagaaaaccagaagggtcttttcacccaggaagcccttctttgtgggttgaaagactgatggtgtgtgctctcctcccaggtccctgattcagccttgtagggcacttgtctaatgaaaccataaattctcccctaaatgagcattctgatttggtttgctcttcatatgaccttttcctggggaaaatgtgaagctttccctgagttatggcaaagactccagtgggtggctgtgtttgtcctgcctctgccatctgatagtctaattcatttccaatttatgagcttgttagttccccagccagttcccaccttggtgctgctgacccggtggcagtatttgcctgtgtcatcttgctcagacaaacacagacgtttccgctgaggaggcagtcccagctctgtcatctctttgactgaccctggctgactccgttgaaagcatcgaaatcatagagcaggctcccttcccatagtcagtgaacctctccgtgtcggcttcagcatggctcagaagccgagtttccctgtgtttactaaatgcttccctgccaaaaagacttggaataacgtctgcctttcaaagtgatggggctgctgcctacactcggtcccttcttcctgctgggattttggacttccctaagttctccatctggaatgctcactggcagattctgtggcaggataggggcaatccccttgctttgaatctgactctgggagtggcaagaagtggaattggaggtgctttctatgtgcctctattgtctggcctctgcaacgggcacaataaagtaccccatagaattctgggagggttaaataaggtgcatacaccaaaggatttaggagtagggtattgtgaggactttacgtacctttatattttatttttatttttttgaaagaggatctgtctcccaggctggaatgcagtggcttgatcatgactcactgcagcctcgaacttttgggctgaagcaatcctgcctcactttttaccaccacgcctggctattttaaaaataaatttttgtagagatggagttttgcccaggctggccttgaactcctggcctcaagcgatcctcctgcctcgacctcccaaagtgccggaattgtaggcatgagccaccgtgcccagactttaagtactttttaagcgattcagtctatgtttatctctatctatgtctacatgtacatctatccctatatttaaatctatattagtttgctttggctaccgaaacaaattaccataaagtcggtggcttaaagcagcagaaatttattcttttcacagtgctggaggccagaagtctgaaagcaggtgtcagtagggctgcattccatctggaggcttgaggggagaatctttccttgctgcttccacttctgatggctattggtgttcctagtcttccttggctagtggccacatcattctaatttctgcctctgtctgcacataccctcttcttctgtgtgtctctcctctgtgtctcttatgaggacacttgtcattggatttagagtctgcccagataatccaggatgatctcctcaccttaagattcttagctcaattaaatctgcaaagatggctaggtgtggtgactcacgcctgtaagccctgcactttggaaggccaaggtgggtggattatgaggtcagaagatcaagaccatcctggccaacatggggaaatcctgcctctacttcaaatacaaaaattagctgggagtggtggcgtgcgcctgtagtcctagctactcagtcctagctacttcaggaggctgaagcaagagaatagcttgaaactgggaggtggaggttgcagtgagccgagatcacaccattgcactccagcttgggcaacagagcaagactccatctcaagaaaaaaaaaaaatctgcaaagatctcttttccaaataaggtgacattcattcacatgttccagggatttgatgtgcacatgtatataaattggccacaaccgtgtctctgctatccatctatacctatatattgatggaaaagcaaaaatattaagatgctaaccatttctgaatctaagttttccatgtgtgtgtgtatatatatacagacatttgttctgcctttgcttatctgtattctcaagttcttctataataaatgtggtgttcttaaataaccagaccactttaaagataatgatgtgaagctgtcagggctttgtgagaagcgtgaagatagttcctgcttttcacagctccccaaccaagagccacacaccctcaaagatgctccagagactctaaaaggctgtagcttgtgtcccaaggaataattgcttttattacagctgtgtaataaggaattgtgcacccacacaactccttatccaaaaatcctgggaatcaaatatgcttttgaattcagatgtttctagattttagaaaaacattcaggcgcatgtactatttattacatcacacacttagtgggggtctgggtggcatcccataatcaaacatattatgtctgctatgatatgtttggatatttatactaagtggagtaaataaaaatctaaataattccacacttaatttggtcagattttgccacccaatgagttttagcaccaaacatatgaaaaacatctggatttcagagatctgtggattttagaattattgagaagaaagcgaaggctgtactagtcttactgctttttttatatgtttgaaaatcttcataataaaacatttaaaaatgaggttgtgcttagtgtcatgtctggcactgaataagatctcaaaaaaatgtgtaaccattaacattaactttgtaatcattaacttattgacagtgttgtaagtcagacagggattactgaagattttgacacagaggaatgacatggtcaggacaagaagaatctagaaggatccctatagctgtggcacccaagatggcttgcatggtgcaagcagtgaagagaggtggttaggaggctctgggactcacccaggcatagggtgataagatcctgagtagaagaggagaagaaagggccaggcatggtggctcatgcctgtaatcccagcactttgggagcctgaggcgggtggatcatgaggtcaagagatcgagaccatcctggccagcatggtgaaaccctgtctctactaaaaatacaaaaattagctgggcatggtggtgtgtgcctgtactcctagctacttgggaggctaaggcaggagaatcacttgaacccgggaggcagaggttgcagtgagctgagatggtgccactgcacccagcctggtgacacagcgagactctgtctcaaaaaaaaaaaaaaaaaaaaaaaaaaagaggagaggaaagagtgaatgaacctggaagaacttggtgagtgttctaggagaacaggatggattcttgtcaccccaatatgcttctgaatgacagcaagagagacatactgaatgtttggtgcatttaggaaggaaaatacatgagtcaattcaggaacaagtcagttggaaatttcatcggcctcctaatctggatagtggcctttgtaagagcagcacttttagttgtaagggttgatttggggcggtgggcttggtaatgaggaccacctgagcatgaagcatagtagcctagtggggcccctctgtagaggcagttttatcccaggttactgatttcaaagctgcagatgctgtgcagatcacaggggctaaggtagggtttctcagccctgattgtgcattgaatcacttggagaaagagcttaaaacactctccactgtagatcaaatagaatagaatctctgggcctaagaccctggcattatgtttgagaagctcttccagatgattctaagatgcagcaagatggagactgctaagtttagggttcagaaggggcaggggaaatgacaaaaaatgcagtcaccctgagctctccctattaatatgcaaaggggaagggtctgggaaatgatttgagtagtgacagagagggaggaagagaagaataacccaaattgggtgaaaacgtaaaaaaccaggagattaaaaaaaaaaaaaaaaaagcaaaaaagcaacactagagatgaactgcgtagtaagcgtgatggactatcccaaagccatcaccatcaccatcgcctaaggggcgatggaagacagagcacaggaaaagatcaaaacaaagcaagatagtccatggaggaattgcaacatttcctcactaaacattgagcgtggggttaagaggttagaaatacagcaaagggaggaaaatgcacagccctaatagagcagttattccttaggatccacactgcagccttttacaaagtccctggagcatttttgagggtgtgtggctcttgggtggggagctgtgaaaagcaagatctatcttcacacttcacatgaagctttggcagcttcacatcactatctttaaagtggtctgggttatttaagaacaccatatttattatagaagaacttgagaaaggcagatgagcaaaagcagaacaagaccaaagctaaattcaacagtcctatgtaaaaccaccaccaaagccagatctatttctttcccattgtcttgtctatttctttcccattatctttcctctgctctgagtgtactttttcttttttcttttcttcttttttttttgaggtgggtttgctttgtcacccaggctggagtgcagtggtgcaatcagggctagccacagccttgacctcctaggctcaagcaatcctcccacctcagcctcccaagtagctgggactacaggagcaagccaccatgcccagcttatttttgtatttttttttttttggtagagatgggggtcttgctatgttgcccaggctggtctcaactcctgggctaaagttatctgcatccctcagcctcccaaagtgtgggattgcaggcgtgagctactgttcctggaatactttttcttcttacacaaaaagattatactagatctaatctgagggaacaggatggattcttttcacccctaatatgcttctgaatgacagcaaaagagagacatactatacaaaatgctgtgtgcatttaggaaggttttgtaattttttttcatttagcaatagattaggaacattttcatttaacgataaattgggaccatttttttctatgttagaaaaaaccacatgatccttttaaatgactgcctaatgttttattgtatgaatatttcggcatgacttaattcccttgtaataaacacatagacaattttcagtttttcagttattttcattgctctaatatcctcatacatgtatctttatgcagttagctgatttttgctttgggaaacattgctccaagtggaacggctgcaacaaaaggtgtgtacatttttaggtctattgattcatagcaccaaactaccctgtgattagccctccccgtggtgtaatgtgagtgtgtgaggaattactcttaaactagtcaatgcagctttatctatatagataaataaggatcatgctgctctagggttctctccacttgatgggatgaagtctaattctctgctataaggtgctgatttacctgggacaaaggtgttcaaacccatcttctctcctatatctccataccccacgtttgtaccctcatgatgtgaacagggtggggtaaaagagattgggaagctctcccagccttctcgggtcctaagtgcctgctagtccttcaaaaaggcaaggaagacaccccctccagttacccagctttagaaacaataaacctctgtggccaggtgcggtggctcaggcctgtaatctcagcactttgggaggctgagacgggtggatgacctgaggtcaggagtttgagagcagcctgaccaacatagtgaaaccctgcctctactaaaaacacaaaaattagccgggcatggtgacatgcacctgtaatcccagctacttgggaggctgaggcaggagaattgcttgaacctgggaggtagaggttgcagtgagccaagatcgtgccattgcactccagcctgggtgacagagcaagactgtcaaaaaaaaacaaataaataaaaaaggaaaagaaagaaaggaaagaaggaaggaaggatggaaggaaggaaaagaaagaaagaaagagaaaccaaacctcctgtgattgaagctcaggagcccccatcattttacaatgactgctttgggcgatttttggtacctaaagatagagtcctgagggtggtggttctcacccctaactgcaaattagaatcacttggaagagattttaatatattctgatgctgaggtcttactccagttcatttaagttagaatccctgctattaggtaggggacttggagttttaaagtgatttccaggtggttgtaattgcccccaaggttgggcaggacagcctcagggcattaaatgacccttgttagagaagatgcaacctggggccttagggaaagccaaaccctttcacacattttcaatgagctctttaacaaccaatttcagactactttaagcattttaaactcttcctgccctcaggcacatagtccaagcagcacattcataaagggagaggctattgcctcagctcaaagaaaaattacacttctttcatgtgaatataccattctgccaatgggcagtttaagtcatcacttccagacaatttgttttataattacaaacctcataaaaataatgtcctacaaattaatcagctgaggaaggactgaaaagcttttgttttgttttgggtggttgttttggctagggacaaactggctcttttaaaaaaggaaaatttccagagtcttgcaaagtccctcagctcactgaatttcatgtcctctggcccttggattttaccatccaactcaggatactcacagtcttcttaataaaccctcactctcctgtcctctaagctgttgctcacatggtggtttttccacttggtgtttccttgaagtaggattgccagatttagcaaaaacaacaacagcacaaaacacagagtgcccagttcaatttgaatttcatataaataacaaataatttttaagagattctgccacttgttaaatgtgtctgttctaagatgcctcctggaaccagggaactaaccacaggatggatttggggacccactgtactcactgtgagatggatctgagctaaaacgccattgcttgactgacctccataagctcttcctctgactagtggaccacagtgatgtttggggttcccaggaattggtgtcaattcagagccagtgtccagtaatcactcaaagttctgattatttcctttttcctaatgcatagtcaccctgataagaaccccttggtccctttggggaaggctgaagaaagattagcaatatacactttgggcagtatagcatggtccttcctcaaggggactcagcctccctttcattcaaaggattctggttctgtaaactgactcaagtttaggaattaatcgaagggcaaggactctgttttggtgattccagttagacttctgttcactcagcctagaactcttctgtatatacagatcacatacgaatttagtagattgcccctctatttcttttttagctgctgcatgatcaaccagccaatgctgtgatctctgtgactcagactcatgattcctgttttgaccccctgtccgtgactgtaaccacacccacgttgcctttggtgattaagtgctgtcatttgtcccctgctccaggatccaattattcccattgcatttagaatcccagcttagtagcagcatttctcattgtaatttctgacattcagataaaaatgaccccagaactcttcaaagatgctgggctcccctgacaaatttatttctcacagttgtagtgaaactaccagggtgaatgagcaggctttacatgacaaattcactctaacattccaattccaatctctctaagcctttgggcaccttcttctaccttcctttacagaataacaatgcagttctggtatttcaacttcatttagtgcaggaccccttttgctccatgtttcagccaaccaaacagccacactgttaaaactcttaactcaaggagctgcaacatgagatccagaatttctgcttagtgggcccatatcagtaaattcagcccaatccaactttatgttccttccactattatcccacacccttgatatccattcccacatatattccctagatttatgtccgtatacattggaaaagtcatgcatttcttttggagtgtagcaccctgccgccaaccataggtcattctttgtacttcaaactttggggcctgctgggacttgagactagttataggtccagaagcaaagaggggtggtgggagtgggttccgaagaagaatcagcactgtctcaaaagataactacctcagaggtggccattacagatgctgcaagcaaaacagtgttaacctcaaactgcagggaggcgatatgcttaggctttgtgtccccacccaaacctcatcttgaattgtaatccccatgtgttgagggagagacctggtgggagatgattggatcatggggtcagtgtcccccatgctgttcttatgacagtgagtgagttctcatgagatctgatggttttataagtgtctgactgttcctccttcacacactcactcactctctcccacctgccaccatgtaagatgtgtctcttccccttccgccatgattgtaagtttcctgaggcttccctagccatgcagaactgtgagtcaattaaacctcttttctttataaattacccagtcttgggcagttctttatagcagttgagaatgaactgatacaggaggaaaggaggatgaagggctgtttctactggcaaaaagacttggcacaatttatgggttcagtgtacccagcttcattgggatctgcccatacgaccccattcaaaatttcaggatctcattctctcctaatccaaaccctcactttaacagcaaataccctgtgaggctgtgaattcaatttccattgtagttctgctattctcaagatgagactctgggtcacttttcagcaatctcagccttgcaggagatacaagagataagggtttgttcctcccccccctgcccccgccggggcagacacagaagctttcaagtaatttatgcagtattttgagctgagaatttgaaactctgagcttattcttttctttccccactttctccagctcagctgagagcagctagcgaatcttattatacttactaatttgactaaaatgttctaaggtatcaaatgcatagtcacccagaaccttgccttttattagtattcggctagtagtatctaatatttgggacatacttgtactaaaaaatcatacattgtttatctgaaattcaaattgaactaggcattctgtatttggtctggcaaccttgctttacagaaatcctctttatcctccaaaattgaagtatatttccaatagactgctccagaaagaagttattactttaattaatattatttattgaccacttacaatgtgtctgttctaagtgctttccataaatgaattcacttaaggcctgattataacttagggctagctattcttttactcccattttacaggagaagctgagcctcagaagagaaaaataagttgcccagtagatcacagcaaaaaggtggtggagtgggatttttacccagacagttaggggtctgggttcacatggataatcatggataacatgacgcgaccttgtgacctcttctaccagaagcttccacagaggtgtgtttgtgccttgtctggggcccttaacatattgttgtctgtctactctagcaggctgtgatatcattggctaatagcagaaatcatgttttatttattgccacatcctcatgtcatgaaacttggaaaaattatatttattattcaactttaaaaagggaggaaattctgacatgtgccacagcatggatgaaccttgaggacattatgctaagtgaaataagccagacataaaatgataaattgtgtgtgattccacttatgtgaggtacctattacagtcaaatccacatagatagaaagtagaatggtggtttctggggcctagggagagggaggtatgggaatgattgattaataagcatacagttatagctgaggatgataaaaatgttctggagatggatggctgtgatggttgtacaactatgcaaaagtatttaatgcccctgaactgtatactaaaaatggttaaaatggtacattttatgtcatgtgtatcttaccacattttaaaataaatgttatacttaacttagcacaggaggttaagagcccaggctcagggttcagtactgtctgagttgaactatggctcagccacttaccagctgtgggatttggggctagtcatttcacatcaatttcatcagtaaaatgtggatggacaataatgcacatatcatgtagttgtgaggacaaagtgaaacaaaatatgctgagtgcttggcacaatggttctcatccccacaaatgggggagatttttaagactatcgaggactagactctcacagataagttaaatctggccttgtgtctttaaacgtttctatttaagaacatttcaaagatacatacaagtgatagatagttctcacataagcataatgtagactgaacatttatcaagattttaacattgaaatatatcacctttttttttttttttttttgagacagggtctcactctgttgttgcccaggctggaatgcaacggcacaacatagctcactgcagtcttaacctcctgagctgaagcaatactctcacctcagcctccttagtagctgggactacaggtgtacaccaccatgcctggctaattttttttttttttggtattttttgtagttatggggttttgctatgtcgcccaggctgatctcaaaatcttgggctcaagctatccacactcttcaacctctcaaagtgctgggattataggcgtaagccaccacacccagtagaatatatcattcttaaaggtgaaagagttattgggacaacacaatgtctggcacatagtacttgtgcaacagatttagctgttattattacttttactctaattagaaatttctttgctttaagtaccttaattttgaaaagggatgctctgaatgggagaggtgcctactgatgtcactgtaaatgtatgactcctattgaaattgtacccagagggttttcttcttctgtgaatcatcctggaagtattctgcatctcaaatggacataaatcaatttgaaccaataacaacgttatttctgaaataccatactgcagtggaatctgacagtaaggtaaaatagagagaaataaatagcatagggaatatggagaggaaatatagtctttcaggcctcaggaaaaagtgcttttaatctgggaatgttctgttatggtactcacccactgcacgcccagggcagacattactaatcaatatactctttcccactgaaccctaaagctgcattagaatttttaagacaatgctttaggtacccaccaacaatcaatgagaggtggcataggagatgagtcgtatatattattctttttttgtacccttttttgtgccttaggtaagtaatactacatacccagaaggaagaaaacgctttctgagagagcaaaacaactgtttgaacttcctcaaaatccaccaaaaacagcaaagtcatttccatggggctatcacagggccatgagccacaggtcattctaagatgtggagtcttagaatccatccaaaaacagctaaaggaaaataacaatagcctggacctggcctggatttctgccatgttggaattggtttgaaataaaagtgttccaacactcttctagttacgaaaattagctttgcctcatgctgccaagtggctaagtctcaaatgtgtatttttccaactttaagttgaagcagtgagaaaactcatagaaaagattaggaaaaaataaggtccatgaaactagtccaatagtggggctgaaaatgacaataatagtaacaatgaaaatttggtgcatattttctatttgccagactttgtgcctaggtgacatgtggttcttctcacttcctctgcacaaacaacctttgagatcagtaccattttcatttgcctttcttagatgacagtcctgaagctcagggaagttaggtaacttgcttgaggccacatgctttgcaagtgatgcagctgtgggatttgagcccaggtatgtctgatttaagacattgtactcttgaacctgtgcattggaggccagcaaggcctttcctttcagcaggaaaagatggcaactaagagtttcagtcatcttcctaacctttctttgacctcactcaaaagggcaagaactcgaatttattcatcattatcttttccattgcattgcataatacctgacatgtaatcagttcacattgagctgaattaatatttggtgaggtttctaaatccagcagtgaactctgcttgcagagcaattgtgggttcttctaaatctttagttgcttgtcttggagccaggttgagtattgttcctgtggctgtgtcccttgtattattagcacatgcattcaacactatttattgagcacctactctatgctaggcagtatggttgcaggatagcagtcaacagaaagacccagtcccagcctttagatttgtagtccagaggggaagacacacttgagcagaagatcatattagcaattgatcatatgcttaattgcatatgtcaattaagagcggatgctacagaggtgctgaagaagggtacctaggggcttacagaaaacactgatggagatggcatcagaatatctaatacatacagtgctagccatgtgtcaagcacagatcttacaatattacatgactcaccttttaaaatcctcataccaattttcaattcctaaagcaaacctctcaccacccatattcatatggggaaactgaagcccagagatgtaaggtaactcactcaaggtcaggacagtaagtggcagagatggactcaaagttgagctgtagctgtaattcaatccctctcctaatctactgtgctgagtcttcccctgggaggtctgaaaaatagttggaattagctttaaaacaggagggggactgttcgagaaagaggaggcggtggttatgaaacccgaattggacagagcttcaggagctgggaggtgttcagaactgtggtggtggcagtggatgagggcagtggtacaggaaggggtgagttgagcaagagttagatctaccaggctgccagggagtgcagctttcatcctaagggcactggtgagttatcagagggctttgcccagggagtgataagatcagatttatcctctaaagtgctcactctggctattgaggagagagagaagagaaggtgctaaggatggaggtagggggagtgtgtggcagggctgggactagggtgagacaagtgaggttcctagggcactgcacttgcacggccctgagagtaaccctctccttcaactttgtgctccagttgccaattgcgtcatccaaatcttagtcctgctatttgggctgctgctgcaagaatctaggccaaggtggtataagccaggcccacaaagcacatcaaggaagctggaaactcatagaaatggaaaatccctttttcacttcttgggtatttatgttcgtttttgactgttagcgcttatcacatgcagttcattttatcttcaacatcagaaagagtggaaagtttcctgggatggaaatctctttgaggttcaatagttctttacaaaaaaaatggcagtagagtcaggggaggtaacagagggagagggagaagagagagcagtggagagggagggggaaaagtatgacataggatgagataagaaactcctttgcaagtgtgaagccaaaggatacataataaaaacaaattccagcagaatggaaagaaaacaaaacgctaccttgaaatgaaatatccattctaaacatgtgcactgcgctttttcagcatcactacagtgtttttgaggtccttttgtgaaagacgttggtcacaaacctatgctttaatctttagccacattttatccaaaggccttgggaacccgtggggtttgctaagactccaccaacgtagacgctcgttcagcagataggatgtttgatgccgcttgctgcaagccctgggaagttcctacgaatcataaagattaaggtgttttttgaagctggtttaaatacacataacacgagagtaacaagccaagtacgagagaatttaaataagctgctctttggagttgctgacactcaggcgtgtgggctcataatttgggattctgaactggagaagattccagaatgaagcttagaagaatgaggtctacttttacctgttctcattctattcttgtcttttggttcttcatttcttaaaatgacctgctggcagcgaccctgtgttagtcccatgggaattactttgtgatttgtggtggattttgaggaaaaggcagttgttttgctctcttggaaattttttgggttctttttgggtacgtagtattgcttaccgaaggcacaaaaaaagggtacaaaatgagagctgggtcctgcagtcaaccacacctgctctgattaaccctcaacccactcgtccctttcatcgttgaatgacattttcaatatcaaccctttgctggttctaaagcacagcagcctgtatttgaatccatttctgttgcatagcttctccgtgaacttgaacaaatttctccacctcttcaagtgtgaaatgggggctaatgatggtactgatttccagggttgctggaagcattaatctaatcacgagaaagtgcatgccaaatgcttggaattagtcctggcacatgctaagcattcattaaatgttagtttttattttcatcaactattggctttcacaaaacttaacaacaacaagcaaaccaaaccctgaggcttcacttttgggaattaaacgattaaatattatgaggtctaagacattaacttttattaatgcataataaatgattacatgtcactaatagattgatatctattaatatacattaaatgattagcttaattacatttaaaaatatctgcaacaactaagaattatatgttgattgatgaaatgggttaaaattaaattaaatgcgttaatatacatgaagcagttacaacaggactcaacatcagatatacactcaactaattatttttttaatttgataatatttgaactctctggagtgactccttcaaaatcacatcatttttggggagacgactgtaagaccaaggaaaaacagtggcattttctcacctaacagtttctcctcaatccatgttccctctatcccctcaatctggtttttctgttttgctcttttctaccttcctgctggtagtcgaagcgagggagaaagagcagaagtaaggtgaggttttacctaacaaatataaatgcttatggtgccttatattttggtgactttaaattttgatataatttcaaatttacagaacagttttaagaataatataaagaactttgattatagcctttatccagattcaaccatggtttatgttgctccattgactctatcagttcctagccctccctccctctctctgtgtatttctgaagtatttgagagtgcctttgtatatgtatttctggatacttgagtgtgtatttcctaagaacaaggtcatccttttacataaccacagttcagctttcaaagtcaggaaatgtaacattgatatattactattatctattccatagtgtattttcaaacttcatcaaatgtcaagttcttttttttaatccagcccaggatccaatctaggatcacaaatgctacttatgtgttttgtctttttaatttccattactctgaaacagttcttcattctttctttgtgtttcttggccttggcatttttgaagagcacaagccagttactttgttaaattattctgaatttggatttttctgctgtttcttcatcctgtatgcaagttatgcatttttggcagaaataccactgaggcattgtctgttgattttataaagcatcttaaagctggtgtcagtaggggtacatttggtggcaagtaaaagactcaactaacactggataaagaacgagaaatctggtggttagtagatccagattggatgtggattctttccattttctactctgctaccctcttcacattgttgtatatggcagtatgtgaactgaacatgacaagaggcttaaagaaggatgaaaggagagattaaagtaatgttctacatttgtcttaacgaggccaacttgttcattagaatgtgaacagaaatgtaataaatacctccatatattacattgccacccatgactgatagctgatggattagaggctgcttccccagaagcagaacctgagacaaggatttatgtacaagtattttatgtgggaagggatcccaggaagcaccagtaagggtgtgaggcagggagggtgaagcaaggaagtatagcagccaggacagggtgtgttgttgagctggttactcctgtggataaccaggtcttggtctcactgggaacctctaggagccacttggagacatgcttcagggtcttgccaccagaaggatgagaaagctggggtactgatgttccaatccctggtatccttggctggaggctgctacagaggcatcagcgccccctgcgtgtataggctaaacagttggaaagcccttggtgggagggtctgcatgctgacagtcagaaactggccaactgcatgatgagagaaagtgatgaggggctctgggtggagcctgggcagtgtctgatcttcctctagctgaaatggacactcctttgtgtgagcactgaactccctcacttctttgttggtgcccatttttccatggggtgagagggtttatcactgtacacattaagccctggtctttctttttctctctctccttgtcccattcaggctctatttcaatctctaagacgtaaggtcatagcctttcacttaaaaaatgttatttgattacatgcacctgtcttttctgtgtttcttccatagggcaagcgtgtgggctttggaacaagccagacttggctccagttctctagttcgtgtgaatgtgagcaggtgactgtcacctttctgagcctcagtttcctcaagtgtaaaatggggatggaatagccgcctttcagggttgcagaaatgaggactaaatacaacatcatatatgagtgcttgacacatacttagaggtagttattacacagagtagcaacatgcatagtagcctgcattgcacctggcataataaatgctaggtaaatggtgagtgtttataattcggggactggcaacgtttttctaaaaagggccagatagaaatattttaagttttgaggcccatatggttcctgttgcagctactcaaatctgcggttttaggatgaaagcagccacaggcgtgtgtatgtttcaataaaactttattgacaaaaaaaagaagtggcccagaagtcgtggtttgctgatccctggtttatgtgattataatgattgttacaaccattgccaggatttgtgtacaagtttactgcccaccaatttggcaaagctcagtccgtttttattttttattttttttttatttttattttttgagatggagtctcgctctgttgcccagaatgcagtggcgcgatcttggcacaccacaagctccgcctcccgggttcacaccattctcccgcctcagcctcccgagtagctgggactacaggcctccaccaccgcgcctggctaattttttgtatttttagtagagacgggttttcaccgggttagccaggatggtctcgatctcctgaccttgtgatccgcccgccttggcctcccaaagtgctgggattacaggcgtgagccaccgcacccggccccatttttattattcatggtagttatgttccataaagccacaacgaacactgaaatagcaaataccaaaatacagctcttagaggaaatacaaggttaggttcctgggagcctctggttgaaacattttttcagccaatcaatacataacctcattttatgtgtgtttctgtttagagacaacttacttaatatatacatgtttttgattcataaacattgaactcagagccaacagcaatataattcacacctgaacaaagcttatctaacatacatattttctctgaaaggcatctcatagcctttttgcattaagggacactaaagagcacttccactctatgcttggggggttggaggagagtgtcactttaaacactgaaggtaccaaaaagagaaagaaagcacaaaaatgcgtcactaactagaccccataaaaagaacacttgtggccaggcgcggtggctcacgcctgtaatcccagcactttgggatgctgaggtgggtagatcacctgaggtcaggagttcgagaccaacctggccaacatggtgaaaccccgtctctatgaaaaatacaaaaattagctgggcgtggtggcggccacctgtaatcccagctactctggaggctgaggcaggagaatcgcttgaacccgggaggcagaggttgcactgagctgaggtcatgccactgcactccagcctgggtgacaagagtgaaactctgtctaaaaaaaaaaaaaaaaaaaaggatgattgttcactgtgtgcgagctaaaacaagtagtcagggtgttgccttgtttgacaggcttagaagtgcatcttaaatgactcaactttttgtgctctgcacatatgcatgtctgtgaataactgtgaaaatgccagaaacgttgattttggggttacagataaattttagtatgtaggccagttcaccaatacaaagaaaaatgaggattgggctgggtgcatggcttacacctgtaatcccagcactttgggaggcagaggctggcggatcacctgaggtcaggagttcgagaccagcctggccaatatggtgaaaccctgtctctactaaaaatacaaaaattagtggggcaatggtggcaggcatctgtaatcccagctactcaggaggctgaggcaggagaattgtttgaaccaggggggtggaggttgtagtgagccaagatcgtgccactgcactccagactgggtgacagagtgagagtctatctcaaaaaaaaaaaaaaaaaaaaaaaaaaaatatatatatatatatatatatatggcttaccctatggactttgcatgatatgttttttatttttattttatcttaggctttccagtttttaactctttaattatttaaataatttcatgaatatatgttcaacataaaaacattaaaatgacacacagctataaagaataaaaagtaagttattcttcacattccttttgtactagattccagtttttttctccagaggtcaaacagctcatagtgtgatctttttgagatttaaacacacatgtgtatgtacacaaaacacactactttaaaaagtaaatgggccacacaaaaacctgcacataaatgtctaaagcagctttatcggtaattgccaaaacttggaagcagccaagatgccttttagtttggtaaactgtgaagcctccagacagtggagtattattcagctttaaaaagaaatgagccattgagccatgagaagatacggaggaaccttaaatgcttattactaagagaaagaagccaatctgaaaaggctgcatatgggatgattctaactatatgacatattggaaaaggcgaaactatggtaacagtgaaaacccagaaatagcccaaatgtctatcaagtgtaaaaattgataaattgtggaatactaaaaaagaatttgctgttattactagtatcctagaagtaggattgctgaatcaaaagttatgtgcattttagatcttaatatcacaaacccctcatcccaccctccaaaaccctccagaagagaggctctttcaatttccattcccaccaacagccattgagactccctgtttgcctgtacccttgccaatactgggtactatccattaatttaccttttgccaatctgatgggctcatcctcctttacaactgaaattcttacaactgggacctgtcataaaattggtgtgtaggagcctttgagaaggctgtcggcaaatgaagcaaaaactccaaccctctaattttccacacactgatttaggctctttggaagattaacaaatggttatcagggtaattctgaaaagaagtgggggcagagattcccacacagaacctaatgttttctgggttggtgggggtgggggggctttgatttgaatggctccaggaccccctctgccagatgtcagcaaatcacagacattcatctagctgaaagccaacctattcagtctttctgggcaacacattcagacagaacccagcattcttggctcagggtgatgaaataaataggacttaatttatattttaaagtctttttatctctctgtaagcccctgtgcttcattgaaagaaaatttgatcgagatgtagagaggtcagaatgcagctttaataattcacgatctgtaatcttggccctttcttactttgccttaacatttatttggaggtttgccatttccctctgcttcccctacatgattcttgagcgacagtcttgtccttcttctaaactctcttgcctcagcattcagaccgtttcgggtaggatcggaaggtttgatatccactttgaccaatgagagactttgggggcaaactggggcccctgaccctctctccaggagccttgatctgccagttagaatatcttatattgataagattagttggtaattaacagcccagcccagtcaagcagaggagatgactcaattagcagaatgtcactccatctaatttactttgcttatcagagatttattttctaatgactacaggaagaagaacagggcaccttcagaggagggatcagaaagggtttaaaagcttcagtgtgctctaacctctctttttcagctggtttgcctggcagtgaggaggctgataatgccaatttggggaattggctggtctgatacacctatctcaaacttgggaaaaaagaggttgaatgtttctgttatccctctatctgattcttttctttatttttaagttttgtgggtacatagtaggtgtatacatttatggggtacatgggatgttttgatacagacatgcaatgtgaaataatcaaatcatggagaatggggtatccatcctctcaagcatttatcctttgtgttacaaacaacccaattatactcttttagttattttcaaatgtaaaattaagttattgtctattgtcacccctttgtgctcacatagtaggtcttatacattctttctaactatcctctatctgctttatattttttgagctaatcctgtttgtcatctttgtttgatgagaaaactcctcccacagctacttagctttagctagagtagtagtagcaataacaccacctacaataatactagacaaggtatttattaaagcctcttgataccccaggcattgtgttaaagactttacattggacacataacattgaatcctctacaccacagttggcaaacattttcttaaagggctagataatattgtagttctggggaccggtctttgttgaaactgcccaagtttgattgtattaagaaagcagtcatagactataggcaaataactaagtatgacttgttccaataaaactttatttacaataacagtcatttggccagatttcggctgttggccatagtttgctaacgcctactttaaatcagtgtttctcagacttcatattgtgatttatttagtcacagaatcaatgtagatggttgcaaaactcattttttaaaaacatgaaatagaataaaaactatgtggctgggcatggtggctcacacctgcaatcccagcactttgggaggctaaggcaggtggatcacttgaggtcaggagtttgagaccagcctggccaatatggtgaaaccctgtctctactaaaattactaaaaaattagccagccatggtggcatatgcttgtaatcccagctactcaggaggctgaggcaggggaatcccttgaacctaggaggcgagcctgcagtgagccgagattgccccactgcactccagcctgggtgacaaagtgaggctctgtctcaaaagaaaagaaaaagaataaaaactatgtgaatgcatcacctctaatatggataactcctatttggtgaaattttaatttcagatgtgcgtgtatgtaaaaccatatatgcatatggatataggtgtgtatgtatttgtgtgcgtgtgagtactgggtttcaatgtgaagtgtgtatcttattgcagattataagagtttgaaaagtcctgctcttaactacctaaagtaagtctcattattacatgcattttacggttgaggaaatagagatgtggaaagacattcggtgacttgccccaagttacacagcctgaggagccagattttttgataagacagcaagcctctgacatacagcattttcccatgcccactttggaatgggttaatagcagtgaaatggttaaaattccttccagtggaaggaaaataaaacaagggacaggcatagtccacaaattgaatggcttcttgctgaagcgaacagaaacgtctctttttccttcttggtattttcattgcaaatactatttatcacaatgtatttttcccccaacgcattttagaaagtcagttggaattgatttgaggctctaaacagtctcctgaatgaaaaagcaaagtgtaacctattctaacagcccctcttccttaatctagaaacatggggagatgcaatttaaatgataatgttaaccaaaacgggagaatgcaatgctatagtaggagtgtttgttttgttgtttttttaacccccactgaaagacaaatggctgagacatttatatctgcagcacttattaaggagaaaatgctcaacccgttaatttcattgctgtggtgctgaatatgaagaaagaatgtagtttctgagtgactgctgaggactcccacagtcctacaagatggcggccagggagggggattctgtggcaacgttcgagaagtcctgaaatgtcgtccgttatctaacatttatctgggtgttgcagaataagtgtttctcgaagtgagacttcttggaacattttctcttaaactgaggctttggagtcactttgtaagtttgtgttttaaagccaaccctctaaaacttgtttgctgatcaatttaaagacaggtctccctggcaaccatgttgtacacagggtatggattatgtatacagaagatagaacgtagagttatctgaaataatatgttagtttcagtaagaaaagaattagtcagaaataaaataaagtaagcatattaggattttttttaaaagtgtgccccaatttaaaaacacatctataggaaataaggaagaatatacactttgatgattctgctacctaacaagacgaccattactattttataatgggttttgtttttccatcttttttctttcttttttttttttttaaagtgctttggttaagaagcctcacaactctccccagttaacaccttcataaggaaagcaaaattacaagacggcaaatgtaccaattaggactcagtttacctgtgttttcatgctccagagtgtttgatacacatttaacaacaagcgatgtttagaggagggagcccaaactacctctacccataagactcctctaaagtatctagggtatttataccatgccctaacatcttagctgtgccttgcaggtttttgcataccaaggctttgtgggcaaaagatccagaactaaacgacatctacctagtctatgttacaggctgtgccttcaaatgtcaagctttgctaaccatgtctcattatccaacaagcttagtttttctgatggctaccatgtccagtgtcgctcagagaacttccaaaatttcctatactatgtacgcccattgattgaatatatatacacatgcatacacacacatacatacatgcatatacatatacacacatattattttgcatatgtttatatatcttcacatacataaacatacatatgaccaaaatttatacatgcatctactttaaagagccaaggttctaaaaagcttgttataaagagcaataacttgcttctcctcatttccttccatttctctcccttcggaggcaaccactgttgtctcttgtagctgattcttttggtaccttcggatacttaaatggcatgtttataatgtgatgtcttgatttctcatattcaggtattaactgttgttttttttcctcaaggaaaatgagaatttcgctttcttgcccctccctccctgcctccacgacctctacccacaacgcacacacttcctgtctgagtcttttgcaatgatttttgatagtttaatattcgttatttccctgtgtcatgaccatgccaaatgccttccacagttgcatcatgttctgtgatatttttttcctttactgcacaactttttgttttccatgaagttaataatagttgccttttaaaaatttgcttaacgttttgtatgatctcaaccctggttcagtctccaatttttggctagttctgtaactctcctctgattgtatccctctgtatcacaaagctattaattctactttccaggagtatgaagatcctggggcttcaagcctgctctctgctccctacaccaggggagcaaactcattctgggcaatcccctctgtccatcctctgtagtggagatcctatttctcaaagaaccatatgttctatgttcttggtttatcccctcaatttcgttgagtacttctcttactagccttctgaaaaaggacttattattattattggagatgttgcatataggtgttggctatagaatcctaggttggaaatataaacctcaaatatttgagacaggtcccagtcaatttagaaagtttattttgctaaaataaactttagcaaaaaaaggttaaggacgtgtgcccatgacaactcagcctcagtaggtcctgatgataggtgcccaaggtgcccagggcacagcctggtttttgtacattttagggagacgtgagacatcaatcaatatatgtaagatgaacgtgggccaggcgcggtggcgcacgcctgtaatcccggcacttcaggaggccgaggcgggtggatcacctgaggtcaggagttcaagaccagcttgactaacatggtgaaaccccatctctactaaatacaagaaaaaaaattagtcgagcggggtggtgcatgcctgtaatcccagctactggggaggctgaggtaggagaatcacttgaatccgggaggcggaggttgcagtgagccgagatcgtgccattgcactccagcctgggcaacaagagcgaaacaccatctcaaaaaaaaaaaaaatgttgaaagctggttgggtccagaaaggcaagatgactcaaagtggggaggggacttccaggtcataggtagataacagacaaaaggttgcattcttttgagtttctgattagcctttccaaaggagacaatcagataagcatttatctcagtgagtagaggggtgactttgaatagaatgggaagcaggtttgccctaagcaggtccaagcttgacttctccctttagcttagtgattttggagtctcaagatttattttcttttcacagaaatcgctttcctcaaaattttgaagacgtgactcccctgtcttctagcttttagaattgctgctgagaagtctaaagccactctgattctgactctttgcatataatctgctttttctcttggtaaatgtgtaaaatttctttgatcctggattttgaaaatgccacagcaatgtgcctcagtgtaccttggtcatggtgctggtcttttgaacctgggaacacacgctcttcaattctggagaattttcttgagttatctaatggataattttctcctctccatttttttttcttgttttctctttctaaaactcttgttattcagatgtcagttcactattttttaaaaaaaattcttctctcttattttgcatccctttgtctttttgctctcttttggaaaaatttgtcagtctcatcttccaacctttttacttttactcatcttccaacctttttactaacgcattcatttgtgcgttagcttctgagggcttcttttgcatccctttgtctttttgctctcttctggaaaaatttgtcagtctcatcttccatcctttttactaacgcatgtgcgttaacttctgagggcttcttttggcttttcacgtgttcctgtttacagtcccaagtagagtatttggcacaatgccctaaggcatggtagagtaacagcaaggaggatgatgtgcttggaacaatgtgagcaagagtgactgtgggagccaacaaagctatgaaagataattggaggaggcacatcacatagcacattatggaactctgactccaagtggtgaagctggagtctaagcctagctttgtccctgctttggaaaactcagtctttctgatcctcagttttcctacttgtaaaattaactgtttgaatttctaagaaaccttacaactcaaatatgctcatgaatctttgattacatcaatgttctctccctaaagcaggcaaatcacaacacttaaatttgtgtatatatatttatgcttttctagatgcccaagtatatatgacttctaccatccagtaaaacagaccttttaccctttaggaaattacaggttgagagttaaattctataattagtaagtattgttttattggaacaaagattaggtttccccaaagtcgtagaaattaatggcaaggtcagattagcatgagggtctttggtcttctagcgttcccaactccattgcagaagctctgagcaagtcaactctctcagccatgaccaagaagaagctaattcatctgaaggaaaatgctgagcctgccttcagagtccttcagagtaaacctgctgcacaattagctgaaggaaagggccttgcagggagtcagcacatcagaaatgcaccattactcagccaggggctgacattcagccaatggcagccccttgtgtagatactggagtggatcccacggagaatgagcccgctcacccagcatggggtttacagccgccatgaacctggaggagaggacatttgggccagagcattttggcttcctctgctgtttgagatgggtttgtcaccaggagcaagcctttgctgagttctccctcctttaaagaattgttttctctaaattaattaaattgatgagaataaagagggccaaattgatggcacccaaatgcatttgaaagtgatcagaaaccgccaggaacaccataaattccataattagaaagtattttcttaaagggacaaagatcggatttccccatttcagagttggaaatgccccttgattaatttcctccagcctgtctcttaatgatatgaaatgcaatcaagataagtaatcaagaaaatcaaagtgtcctaagtactttaggtaataatgacaataacattcaaccactgcaataaccagagttatatattatttgtgcgtttttaaacctcatactagacactgtactaaacatgtcaaaagccttgtcccatttaatacctagaaaacaccatgaggtagaaactattcttcttgccattttacagatgacttcaggtgacctgcttggaaagctttgtcagttgtccacagtgatgcagcaagtgaggggtggagctggaatttgaacccaggctgtcaaaatgcaaagtccagtcctctgaactattatgctataatgcctcttaaagttttttttcctattgtcaactctgaatgtcatgttgagtataggagaggaagtgtatcttttctttctcagtcatcagggaaagaacattcattttgctgttgtttttaacttctttttttttttttttttttttttttctgagacaaggtcttgctctgtatcccaggctggagggcagtggtacgaacttggctcactgcaacctctgccccccgggttcaagcgattctcctgcctcagccacctgagtagctgggattacagacatgtgccaccatgcccagctaatttttgtatttttagtagagacaaggtttcaccatgttggccagtctggtctcaaactcctggcctcaagtgatctgcctgccttggcctctgaaagtgctgggattacaagtatgagccacaacacctggcctattttgcaattttttcaatgtggcaaaatatatacaacacataattgaccattttaaccatttttaagtgtacaagtcagcattaagtacattacaatgttgtgcaattatcacactatttccagaactttccatcttcctaaacagaaattctgtgcctattaaacagtatctttccattcctctcttcccctaatccctggtaacttctattttctgtctctgtgaatttgcctattctgggtatcttatacaagtggagtcatacagtatttgttcttttgtgtctgacctcttgctcttagcataacgtctccaaggttcttcctcctcctttttttttttttttttttttatgagatggaatctggctttgtctcccaggctggagtgcaatggcacgatctcagctcactgcaacctccgcctcccaggttcaagcaattctcctgcctcagcctcccaagtagctgggattacaggcatgtgccaccacgcctggctaattttgtattttttttttttttttttgagacagagtttcactcttgttgcccaggctggagtgcaatggctccatctcggctcactgcaacctccggctcctgggttcaagcgattctcctgcctcagcctcctgagtagctgggattacaggtgcacagcaccatgcccggctaattttgtatttttagtagagatggggttttgccatgttggccaggctggcctcgaactcctgacctcaggtgatctgcccacctcggcctgccgaagtgctgggattacagacatgagccactgtgcccagccttttattattattattattattattattattattattattattatactttaagttctgggatccatgtgcagaacatacagttttgttacataggtatacacatgccatggtggtttgctgcacccatcaacctgtcatctacattaggtatttctcataatgctatccctcccctagccccctacctcccgacaggccccgatgtgtgatattcccctccctgtgtccatgtgttcttattgttcaactccctcttatgagtgagaacatgcggtgttaggttttctgttcctgtgttagtttgctgagaatgatggtttacagcttcatccatgtccctgcgaaggacatgaactcatcgttttttatggctgcatagtattccatggtgaatatgtgtcacattttctttatctggtctatcaatgacggacatttgggttggttccaagtctttgctattgtgaacagtgctgtaataaacatgtgtgtgcatgtgtctgtatagtagaatgatttataatcctttgggtatatacccagtaatgggattgctgggtcaaatggtatttctagttctagatccttgaggaatcaccacactgccttccacaatggttgaactactttacagtcagtgtaaaagcattcctatttctccgcatcctccccagcatctgttgtttcctgactttttaatgatggccattctaactggcatgagatggtatcgcattgtggctttgatttgcatttctctgatgaccagtgacgatgagcattttttcatgtgtctgttggctacatagatatcttcttttgagaagtgtctgtttatatccttcactcactttttggtggggttgtttgtttcttgtgaattttagttcttgtagattctggatattagaccttcgtcagatgggtagattgcaaaaattttctcccattctgtaggttgcctgttcactctgatgatagtgtcttttgctgtgcagaagttctttagtttaattagatcccatttgtcaattttggcttttgttgccattgcttttggtgtttttatcatgaagtctttgctcatgactatgtcctgagtgatattgcctaggttttcttctagggtttttgtggttttaggtcttatgtttaagtctttaatccatcttgagttaatttttgtgtaaggtgtaaggaaggggtccagtctcagttttctgcatatggctagccagttttcacaacaccatttattaaatagggaatcctttcctcattgcttgtttttgtcaggtttgtcaaagatccaatggttgtagatgtgtggtattatttctgaggcctctgctctgttccattggtctatatatctgttttggtaccagtaccatgctgttttggttactgtagccttgtagtatagtttgaagtcaggtagcgtgatacctccaggtttgttctttttgcttaggattgtcttgcctatgcagcctctttttttggttccatatgaaatttagtttttttaaaattctgtgaagaaagtccatggtagcttcatggggatagcattgaatctataaattgctttgggcagtatggccattttcacgatattgattcttcctatcaattagcatggattgtttctcaatttgtttgtgtcctctcttatttccttgggcagtggtttgtagttctccttgaagaggttcttcacatcccttgtaagatggattcctaggcattttattctctttgtagcaattgtgaatgggagttcactcatgatttggctctcttattggtgtacaggaatgcttgtaatttttgcacattggttttgtatcctgagactttgctgaagttgcttatcagcttaaggagattttgggctgagacaatggggttttctaaatatggaatcatgtcatctgcaaacagagacaatttaacttcctctcttcctatttgaatacactttatttctttctcttgcctgattgccctggccagaacttccaatactatgttgaataggagtgatgagagagggcatccttgccttgtgctggttttcaaagggaatgcttccagttttttcccattcagtacgatattggctgtgggcttgtcataaatagctcttattgttttgatatacgttccatcaatacatagtttattgatggtttttagcatgaaggggtgttgaattttatcgaaggccttttctgcatctattgaaatacgtatgtggatttcgtcattggttctgtttatgtgatggattacgtttattgaatgcatatgttgaatcagccttgcatcccagtgatgaagccaacttgatcgtggtggataagctttctgatgtgctgctggatttagtttgccagtcttttattgaggatttttgcatcaatgttcttcaaggatattggcctgaaattttctttttttgttgtgtctctgccaggttttggtatcaggatgatgctggcctcataaaatgagttagggaggattccctctttttctattgattggaataatttcagaaggaatggtaccagctcctctttgtacctctggtagaattcggctgtgaatccgtcaggtcctggactttttttggctggtagagtattaattactgcctcgatttcagaacttgttattggtctattcagggatttgacttctgcctggtttagacttgggagggtgtatgtatctaggaatttatccacttcttctggattttctagttcatttgtgtagaggtgtttatattattctctgatggtagtttgtatttctgtgggatcagtggtgatatcctctttatccttttttattgtgtctatttgattcttctctattttcttctttattagtctggctagcggtctatctattttgttgatcttttataaaaaaaacaactcctgggttcattgattttttgaagggttttttgtgtctctatctctttcagttcttctctgatcttagttatttcttgtcttctgctagcttttgaatttgtttgctcttgcttctatagttcttttaattgtgatgttagggtgttgattttagatctttcctgctttctcttatgggcatttagtgctatgaatttcactctaaacactgctttagctgtgtcccagagattctggtacattatatctttgttctcattggtttcaaagaacttatttatttctgccttaattttattatttacccatcagtcattcaggggcaggttgttcagtttccatgtggttgtgaagttttgaatgagtttcttaatcctgagttgtaatttgattgcactgtggtctgagagagagtttgttatgatttctgtttgtttgcatttgctgaggagtgctttacttccaattatgtggtcagttttggaataagtgtgatgtggtgctgagaagaatgtatgttctgctgatttgggtggggagttctatagatgtctatttggtctgcttggtgcagagctgagttcaagacctgagtatctttgttaattttctgtctcattgatctgtctaatattgacagtgcggtgttaaagtctcccactattactgtgtgggagtctaagtctcaatgtaggtctctaagaacttgctttatgaatctgggtgctcctgtattgggtgcttatatatgtaggatagttagctcttcttgttgcattggtccctttaccattatgtaatggccttctttgtctcttttgatctttcctggtttgaagtctgttttatcagagacaaggattgcaacccctgcttttttgttttttgttttttgctttccatttgcttggtaaacatccctctatccttttattttgagcctttattttgagcctatgtgtgcctttgcatgtgagatgaatctcctgaatatagcacgctgatcagtcttgattcttcatccaatttgccagtctatgtcttttaattgggacatttagcctgtttacatttaaggttaatatcgttatgtgtgaatttgatcctgtcattatgatgctagctggttattttgcccattaattcattcagtttcttcgtagtgtcaatggtctttaccatttggtatgtttttgcagtggctcgtactggttgttcctttccatgtttagtccttccttctggagctcttgtaagacaggcctggtagtgacaaaatctctcagcatttgctcgtctgtaaaggattttatttcttttttttttttttttccttttttgagatggaatctggctttgtcacccaggctggggtgcagtgtcacgatctcggctcactgcaactctccgcctcccaagttcaagcaatgctcctgcctcagccttccaagtagctaggattacaggtgtgcaccactacgcctggctaatttttgtattttagtagaggtggggttttgccatgttggccaggctggcctcaaactcctcacctcaggtgatctgcccgtgtccgcctcccgaagtgctggggttgcaggcatgagccaccacgcccgcccggccttcttttttttttttttttttttacatagcaagctgctaagtgcatctctgtttagaaattgccttaacattgggtttctattgacagaacaggggaggagtttgcctctgacttttctgaagctcccatggtacctgaggctaagcagcccacagttaattttaattggcaaaagaaatgagaacaaattcctccaggatgagaagtacatttctgctaaaacagtgctctcccacagggtatatgaacacattcagtcccctctagaaaagaaccagagggcaggcacggggtgccagctgctagaaatcttgcagttagattagaatagaagagtgtctgagtttttagataattttaggtgccaggatatggttaggaggctatgttcagggctactcttgctactgttgaaataaaaaacaaaaataactgcctagagaacatccacgccctaaaagacaaaccatgttttctgggtgaagggatgatttaactcaggaaactcaagaacacaaaacaacaacaacagaaataatctccttgaacatattcaactagaatggcaaggcattttccaacataaaacactgtaattttcctgctactccaaaggaatccaataaataattttacaaaattataatcaaaactggaagtcatggccaggtgcgttggctcatgcctgtaatcccagcactctgggaggctgaggtgggtggatcacaaggtcaggagttcaagaccagcctggccaacacagtgaaaccctgtctctactaaaattacaaaaattagcaggtgcctgtaatcccagctactcaggaggctgaggcaggagaatgggttgaacccgggaggcagaggttgcagtgagcccagatcgcgccactgcactccagcctgggcaacagagctagactccgtctccaaaagaaaaaaaaaaaaaaacctgaaagtgacaccagccccctgacaacacaagtcacaggtccttgtgcagtcccagggttgagtggtccaagaaagccactccctgagcccagcctgaggtttcatctttcccgaatgggatcaggtagagggtccatgctgctttgcagaagatttgcatctggtaagcccaggtggtgaatgaaggcaaagaagacaacacgagaagatgtcaaagccaaggtttcctcgcgctgaagccaggccttaggaggcaagttctttggtggggcctctttgcccaagctggagcaagtaccctgtacctgtcatgcagggaagagtttgggtgggctttctacttagcaggactttgctatggagtcctggtaggtgttctcatgttgcatgctctgagatgaggtcctgcatgtggccaggcacaactcaaagtgttcttcgactgccatgaagaggttctggaaagccacagctgcccgacggaggaagcactccaagaaaagctgcttgttgggcagcagccgcgggaccagcagccatcacagcagtattgctttgtgccagagacattgatgttacagcagccgctgggccagcagccatcgcagcagtactgctttgttccagggacgttgatgttgcagcagcccctgggcgagcagccatcacagcagtattgctttgtgctggggccgttggtgttacagcagctgctgggccagcagccatcacagcagtattactttgttccagggatgttgatgttgcagcagctgctgggccagcagcggttgggccagcagctgtagcagcagtattgctttgtgctagggacattgatgttgcagcagcagttgggccagcagccatggcagcagtattgctttgttccagggatgttgatgttgcagcagccattgggccagcagccatggcagcagtattgctttgtgctagggtcgttgacgttgcagcagccatccaccagcaaatccttcctctcacaaacatagttcatctatgatgtggtgctcccctcaaatggagtggtggcactgattgctggggtgactgccattgcccgagttaaactgcactttacacggaatgggctgatcatggtcttgaacctagaggagattcctctctttcactgtcctctcctcctgcttgaaggtgctcctgaggaagtagatgagtgacagcccaaagaccagggcgagcacccacctcctccgcagacatcggtgctaaaccgtggcctcctggttcaccatcccgtgttgtggaacatggcaggcccgaggctcctacacaccccgcagccccatcccttgaagcaggcactgaccccgtggcccatggccgagtcccaggtttatttttcttaccccatatatcagaatttaattcctttttatgatgaatgatattccaaggcatgttcctttctttggtagccgtcctaattggtgtgaagtggtgtcccattgtggtttgttttgttttgttttttgtttttttgaattattattatttttttgagaggagtgtcactctgtcaccaggctagagtgcagtggcgcgaccttgtctcactgcaacctctgcctcccaggttcaagtgattctcctgcctcagcctcctgagtagctgggatcataggtgcctgccaccacacctggctaattttttatttttagtagagacagggtttcaccatgttgaccaggatggtcctgatctcttgaccttgtgatccacccacctcagcctcccaaaatgctgggattacaggtgtgaaccaccctgcctggtccacattgtggttttgagttgtgtttccttaatgatgaatgatgttgagctgattggccatttgtgtatcttctctggagaaatgtctattcaagtcctttgttcatttttgaactgtgctgtttgttttttgttgctattaagttataggagttctttacatattctgaatattaattcttatcaggtatatgatttgcaaatatttcctctcatttggtgggttgtcttttcactcttttgataatgtccttcgatccaaaaaaattataatttgatgaagtccaattcatgtattttttctttgttgcctgtgcttttgctatcatatttcagacattattgccaaatacaatgccatagaaattttcctatatgttttcttctaagaggtttgtagtcttagctcttatatttaggtctttgatccattttgagctacattttgtaaatagtataaaggagccaactttatgtttttgtatgtgaatatctagttttaccagcaccatttactgaaaagatgacccttttcccctattaaaaatcattaggccatatatgtaagagtttatttctagggtccttattgtattcctttggtgtagatgtctgtccttataccagtactacactgttttgattactgtagctttgcagtaagttttgcaatcagaaagaaacttttcttccaagaaaagttggtttaattcacatgagatgaaaattaaaatgtgggtaagtcttagattggttaacgcagaggaagtagcactcaagctattttgaagaccaaagttcatcatctaagccacagtcctcctcagagctcatgcccaccaatctttaatattacaaatggaggaagggtagggatggagatcaaggatagtgctggcaagggtatgaattggtccgacctttttggagggcatttgggaataagaatcacaacacttggatatgggttactgtttgacccaggaattatgttttcaggtagagtaataacaaatggacttgcacagaaattttcctgcaaagatgttcaacccacattgttagcatagcaatgaacaacaaaaaaagtttgagtggcactggctaaattatggtgcaaccatacaatgggatacccgttggctgttagaaacacgtgttgaagcctatttgtagacatgaaaagatgataagtatttaaatttgaaaaaaaaaacaccattatatgtactatgcaatttcacaattgtcagatttggagatcataaaatatccaaacacacacacacacacacacacacacacacacccacacacactctggaagggtagatgctattactaatcgtcgttatattaggtctggctttccaaaagcaggtcctaagagaaggattcacgtgcaacagatttattttttattaattaattaattaatttactttttgagatggagtcttgctctgttgccaggctggagtgcagtggtgcgatctcaactcactgcaacctctgcctcctgggttcaagtgattctcctgccttagccttctgagtacctgggattacaggcgcgcaccaccatacctggctaattttttgtatttttagtagagatagtagagacggggttcaccacattggccaggatggtctcaatctcctgaccttgtgatccacctgcttcggcctcccaaagtgctgagattacaggcgtgaaccaccacgccggccacaacagatttattaagggagtgcttccaggagaaactggtaagggagtgggagaaacagggcagaaaaggataggaagcaaagccagcatgcaattttaggccaagtccgatacagcaggggtccccaactggtctatgggaccaatacctgtccatggactattaggagctgggctgcacagcaggagatgagtggtgggtgaacgagtaaagctccatctgtatttacagccacttcccattgcttacattgctgcttaaactccacctcccgttggatcagtggcagcattagattctcataggatcacaaatcctactgtgaactgcacatgtgagggatctaggctgtgagctccttatgagaatctaatgcctgatgatctgtcactgcctcccatcacctccagatgtgattttctagtgaaggacaaacaagctcagggctcccactgattctacattatggcgagttgtacaattatttcattatatattacaatgtagtaataatagaaataaagtgcacaataaatgtaatgcacgtgaatcatcccaaaaccatgcccccaccatgcatggaaaaattgtcttccacaaacgtggtccctgatgccaaaaaggtggggacccctgccatagaggataacttcagcctgatctcacagagaaattctaagtgtaaattacaccttaggtttattctaacccaaggcaaggaagctgggctttcaaactccttcactcagcagtcattggttaaaggccaccctggacggggatgtaaaaatcccagacatgatgaatgcagctgctccagtagcctgaaggcaggccttcgaggcaaagccacaggtgcaggccattgggagcaaaagcttaccaatgttgaggaagagatgtgaagaaatggtaaagggattttaggggatgtgagtggagcatgccatttagcattctttaaatttttgtagatgaggaaaatgcattatttttgtaataacaacatgtcatttaaaaattactgttgaacaaatacctttcaaattcctctacaatctcacatctatttcacagaattatgtttggtattctgtgggggaaaaaaggctttttcttcttggctgagtctgtatattaaaaataaagaaaaaaaggctttttctcatagccctgcttcagtgactgtcttggcaatattctaataaagctatgaggcttcaaaatccttaccccagagaccaacctatatcattaagggtaataaatacagtcaaaacaatcatgacaacaatgacatgtggaactatcctgtacattaatattgataataatagtgacatgtattggagtgctgtatgggctgggtcctgggtgaagcactttacatgcattctctcattaaattatctgaataatcctattagttaattacagtgattatgcccatttcccagatgtgaaaactaagggccaaaaaacgttaagtaatttgctccagcaaaaccaataaaaggcagagtctggactcagctcaggtttgccttgtgccaaagctcatgtttgaaatctctgcactgtgatatatcccaatccatgtgcttctcttatattttaaggaacattaagtcttgaattctgatcatgggccagttcttctgttatattgtactcctttttacatgtaatcctgagaatatttttctgctggttttcccagccttattggacaattcatttgaacttctttctatttataatctcataggaaaagggctgatgtatttgtaaaattataagcaaaaacccgtcattgtccatggagaatacctgccccagtgcaggctgtgttgaacattttataatattcaaacttcaatcactgcattccccaaatgatagctttctctgatctaaggggaaaccttacctttttgtctgctgcaaatatacatgttaaaatggacagaggccaacaggtatattataatgtgagaaaagcactttctaggacagtagaataagggtgataattttagaaattgccaaataggatagatgggtggcttctttcttttccttaactgctttcttttcatcttcagcttcagtctaaattcctggtatagaactctacatgacacaggttgaaagaaatagaaacaagcatatagtttaaaagaaataggatttcttcccaggttaaatttctagctaaggattaatttgcttgcaccagactcataactttccagatttctgtttgcttatgtatgagggggaaaaaaagctcagctaggctgaatatagcgattagttaaattgctcagacattcattattgaaaaacctcaattccacttgaagttggggtttgtttagcactcactgacaataactttctgcttgactgatggctactaattttgatagtggtatgggaatgtcagtcacaaatagaaatagacacacagactctaggacccattaagctggttaccatgctcacatccccaaatgtgtgttgtttcaaaatataggctaaagagatttaattacattctgggataggaaacatttacgtttcaagtttgcactggttgggggatgctaacagagaaaagaagagtaatgaagcagagagatctcggggaatcaggagagcatcacacctgctgacaggtgcaaagaacagacctaacatctgtgaaggaaaagtcgagtacttcaggaacaaggtggtgggaaattaaagcaccaagagatgttaagctgctccaggaaacaggctgggagactgattgtttgtctcaatcaagagatggctgcacctaaaaataaggatagagcccatcagactttcttttctccctcttctttcagcccattggccttgatttggtcttaaggcatgaaaggaagcctcacggagcccagctacattttcatgccgtgaaaatgagcacttaaaatgtaaacagttctcccaactgcatgtgctgaaggcaaatggattcggaagaacttcacccactgttctcagggaatggttgctctgtggggtgtctctgagacccacaaggctaaggttctcattgtgtttgtttattttattttagttttcagataagcaaaccaaggcttagagaggacagagagcttgggttggcagtccggtgccacgcttaaacaaataggctcaaattctggatctgccgcttctcaaatcactgggtgatttgagcaaatttcagtctccctgagcctctgcttcttctatgaagtgggaagaaaagactattgatgacttagcatcaactattaggactagcgggaaggaggcatgtaaaaggtactacatgtatttaatgcagatttattgagcactcactatgtcccaggcaatgttctagttgctgtataacctggcttttttctgttgtggaatttctttttattcttattttttgattaaaaaattatttttatattttgtgggtacataggtgtatatatttatggagtacacaagatgttttgatacaggcatgcaatgtgtgaaaatcacatgatggagaatggggtatccatcccctcaagcattgatccttcctgttacaaacaatccagttatactcttttagttattttaaaaagtacaattaagttattattgactatagtcaccctgttgtgttatcaaagagtaggttttattcattcttttttgggggggtacccattaaccatgcccccgcacacaacccttcccagcctctggtaaccattgattgattgattgattgattgatagagacaaggtctccgtctgtcttccaggctggagtgcagtggcgcaatttcagctcacagcagcctccgcctctgcctcctgggttcaagtaattctcatgcctcagcctcctgggtagctgaaactacaggcaagtgccaacatgcctggctaattttttttaatttaaaaaaactttttttaatttaaaaaaactttttttaatttttagtagagatggtgtttcaccatgttggccaggctggtcttgaactcctgacttcagatgatccgcgcacttcagcctcccaaagtgctgggtttacaggcgtgagccaccgtgcccgaccaccatcctttacataaccttgctttttcccattgggtgagagatacagctaatagtcacagcaactgacctttatcaaatgtctattgtgtgccaagccactgtgtttatctttttttttttttttgctttttgagacggagtcttattctatcgcccaggctggagtgcagtggtacaatcttggctcactgcaacctctgcctcccaggttcaagcgattctcctgcctcagcctcccaagtagctgggactacaggcgcacaccaccacagccagctaatttttgtatttttagtagagatggggttttgccatgttggccagaccagtctcaaactcctgacctcaggtgatccacccaccttggcctcccaaagtgctgggattacaggcgtgagccactgcgcctggcctgtgtttatcttacacacatatctcattctaatagacagaaaccctaataagaggcaggtgctgtttttttgtttctttgtttgtttgttttgttttgttttgtttttgagatggagtctctctgtgtggcccaggctggagtgcagtggcacgatctcggctcactgcaagctccgcctcccaggttcaagccattctcctgcctcagcctccccagtagctgggactacaggcgcctgccaccacacctggctaattttttgtatttttagtagagacagggtttcaccgtgttagccaggatggtctcaatctcctgaccttgtgatctgcccgcctcggccttgcaaagtgctgggattacaggcgtgagccaccgtgtccggcaggtactgtttttatccctattgtgtcgataaggaaactgaggcttaaagagagacattgagtcatttgcccaaggtcgcacctctagcaggtgtggggctgggattcattccattatcccttacaacaaataattattgaacatctactgggccacacactgcactagaaacagagaaggcaacaatgagtaaataggtaggacaagctttctgtcctaatggcacttacattccagtggagacacctgcaccaattcctggtgcaactaagactttgttcggatggtggcggtgtgtgagggctaagggtgaggatctgacctggttgggaggagtgacatttaaactgagatctgcaaggtggggtgtgtgaagaatgctccaggctagaggccattttcacagtgtcctcactcctcatgcctgtccctcctgcctattcaacaacagcattggctccaaccctggttggtggtaacttccattctctgctttgccaatttgtctgacagccctgggtcctgacagatgtgttttctctgtaagagggattttgacatcatttcctagaatctttttcttgaccaaaggcttgtgattggcccttggcaaattgtaagactaatgacatttgtgtgtgtgtgtgggtgtcttgtagctgtaaaaatcccatcttcaattacatctcttcactatgccaattctctatccttattcagtgggcaagcaaagatggttgttttgagtgacaggaagaaaaactggtgaactcttggcgtgaaacctgaataaccctcttccctgcttaaccacaaacagagaaacccacttagcatcatggcggggggacaactgagttgtcaaacatgtgcaggagaattaatgagaccgtttttatgtttttccttggggaagaggaaggacaggcagcattctcagacctggaggactttgaattaaaaatgaaagaggcgtgagaattcttttcagttttttcccattcaatcctattacacattttatgacccttggcttgggggcccaattttaagcttgccttggctaagaactagggactcaagaaattaaagactcctcttccccatcctcccaggggctcttaatttggtgcaggaaataggtacgtttaaataagccactttaatacaaagtaaactgtgcttaggactcagcacagtgcctgccccatcgtgggcactgtattagccgcacctcttcagagaaccagaagaaatgaaatttataaaagaaaaaagtgtaggaagaaatgtattgtaaggattggcttacctgattatgagggatgagaagtcccatgatataccatctgcaagccaaagaaccaggaaagccagtggtgtggttccagtccgagtctcaagtcccaagaaccaggggtgcttatgtctgagggcaggagaagatggatgccccagctcaagcagagagagcaaattcactcttcctctgtctttttgttctcaacagatcggatactacccacccacattggtgatagtaatcatctttgctcagtctactgattcaaatgctaatctcttccagaaacactgtcacggacacatccagaaataatgttttaccagctatctgggcaccacttggcctgatcaagttgacacataaaattaaccatcataggcacttaataaagttgtgtggaatgattgaatgtttgcaggaatggatggatggatggatgggtggatggatggatggatggatggatggatggatggatgaaggaatgaatgaatgaaggtccatgagaaagtgccagacacttgggtgtgtttttagtgaagtatattgttaggagttttacggagaattgggggttgatgtatgcaggacttcactgagtgaaagagaagataaaaaaagagataaggggtcatggaaaaaccttaagactcagatttgggggcccaattttaagcttgcctgcatccccacttcccttagaatactgtggtgggtagggcaacattctgcagtgatgctcaaacttgagcgtgcattggaatcacttgggaggtttcttaaaacccagattggccaggcgcagtgactcacacctgtaattccagcactttgggaggccaaggcaggcagatcacttgaggtcaggagttcgagatcagtctagccaacatggtgaaacccagtctctaataaaaatttaaaaattagccgggcatgatggtgggtacatataatcccagctacttgggaggctgaggtagaagaatctcttgaacccgggaaccggaggttgcagtgagccagggtcactccactgcactccagcctgggagacagagcaagattccatctaaaaaaaaaaaaaaaaacacccagattgtggggccccaaccacagagtttctgactcagtaagtttagggtggagcttgagaacctgcatttctggcaatttctcatgcgatggtgacgctgatggtccaggtaccacacattgagaaccaccagccaattggcttagaacaaggactctggattcaaacaacttgagcttagggttgccaggtaaaatacgctcagttaaagttgcatttcacagaaacaacaaataattttttagtataagttccatgtcagaggcatcctgtatttttacttgctatgtctggcaaccctgttgggtttaactctcagtgctgttactctggagccatgctgtttaaggcccatcatttggctctccgagtttcagtatcccccacttacaaaatgggggtggtaacaataccagctgtctcctaaagtaattatgacgatcaagtaatcgtataaaggatttcacacagagccttgcctgtagcaagcacgcaggaaatgtcagctgttattattcaccattatcctcaggtgagtaacttttggggtgaaaaaagcattataccgagtgttttttttttgaaaggattttatgattcagccttttaaattttaaactagggaatatttctcctctttgaaaaggtccttgaagctgccctctctcatttctttaatagtagattataaagaatggattggttgattgcatctaaaatctcctcttccaacaactcccaaccccactcagggccagatttgactgatctctgggtggtgtatctgggtgttaaatttctgaggggccagtaaaggcaggtcgctgggggtagggctgagtcctgcctctaggaaataggcacagctcctttcaaactgctgcttgctatgaacaaaaacagaatgagggtcaggcgtggtagccagtaatctgtaatcccagcattttgggatactgaggcagaaggatcatttaaggccagaagttcgagatctgtctgggcagcatagcgagaccctctctctacaaattaaaaattaaccaggcatggtggggtgcacctgcagtcccagctacttggggggctgaggtgggaggatcgcttgagcctaggagtttgagaccagccagggcaacataaggagactccatgtctacaaaaaaataaaaagtcaagccacacatggtaatgcatgccagtactcccacctactcaggaggctgaggcaggaggatcacttgagcccaggagttcgaggctacactgagctatgatcatgcagattgcagctgcacatcagcgtaggtgacagagtgagaccctctctttaaaaaaccaaaaacaacaacaacaacaaaaacaaacagaatgagagggagagggagagggagagggagagggagagggagagggagagggagaatgctttttaatatagaatcaattcagggctgattctatcctttggaattaaatttttcccctcaatatttcaaacttatgtccattttgaggtttgggatccccatttcccctgcacttcatggaatgccagcccattctggaagttggagagccagtgagggtcagtgtgaaatgttcatgggcaggctgagctgtgctgggggctaagcgttggtctgaaatgcctgaacatttctttataaagttgaccacatcagtatctttcaacctgtaggttgtgacctgtaaatggatcatgaaatcaatttgaagggtcataagtagtattcttgtttttcaaaaagaaatagaatgcaacacaatggaattgaaactgtcaggatgcaggccgggaatggtagctcatacctgtaaccccagcacattgggaggccaaggcgggtggatctactgaggtcaggagatcgagaccagcctgggcagaatggcgaaatcccatctaccaaaaatacaaaaaaattagccaggtgtggtggcgtatacctgtaatcccagctacccaggaggctgaggcaggagaatcgcttgaatctaggaggtggaggttgcagtgagcagagattgtgccactgcacattccagcctgggcaacagagcaagactccatctcaaaaaaaaagaaagaaagcaaagcaaagcaaagcaaatatcaggatacattgcagtgcacatagtaagggtaaatgttgtaaacttttgatacatatgatatgtatgataaatatgtaacatacactatttacaggtgtaataggtcatggaatatggtcaaaagaacgtggaagtcatgagagcaggtaatagctaaggccccttgcaattttgcaatatggtgtcagtaagatggtggtttttaagcaggggcaattttgcttttcaagggagatttggcaacatctggagacgtttttgatagtcacgactttgtggagaaatcgtgtgctaccggcgtctaatgggtagaggccaggggtgctgctaagtgtcttgcattgcacaggacagtcccccaccacagggaattacccggccccaaatgtcaatagtgtggacgttgagaaaccctgctctaagggtacgtgtggatagaatcacttaccagtagtagccttattactactaactaggatttacggagcacttactatatgcaggcatgcttctaagtgctcacattgatgaactcttttaatacttacaacaggtgggagataaaagtgtgtttccttcccccttttcagatgaggaaactgaggcataggatgatcaagggttgcccaaagttacaaagttagcagaattaggattccagtgcaggaattctggctttaattccttgaatcagcgttttatgcttccatagcacttcagtctccaaagcctttttttttcctgtagcaaaacacatgtaaaatttgccatttcaaccatttaaaaatgtgcgattcaatggcattaagtatattcacaatgtcgtgcaaacccgttcaacaccaccatcaatttcaaaatttttgccaccccaaacggaagccctgaaccagttaagcagtcattccacacattctttcctctcctcggcccctggtaacctcccatcttttctctgtgtctatgaatttgccgattctagatatttcatatgaatgaagttatgtgatctgtggtcttttgtatctggcttctttctcttagcataatgttttcaaggtttctacatgacgtagcctgtgtcataatttcattccgttttatggctgatttatattccattgtatggatagatcacattttgtttatccatgtgtctgttgatggacactttgtttgcttccacattttagctattgtgaataaaactgatgtgagcccaaagctttttttttttatactgaaggtggagaaggattgtatcactgaggacaggggagaaatccagattgttttggtgacagacactgttcttagtcatctcacatatattatctcatttgatcttcacagtaaccccacgaagctcccccatttttacagatgtgaagaacagagagggtgagtctcctgcccagggtcacacagcaaatcagggcacattactctttgtcacgaagaggagaagtgtgtgtatattatgcagcagaactctgagcagtggctgccttctagaacaggagctgaacttctgatttgcacagaaatctagataggcaaaattccctcaatactcatattgcactatttctaggtgctgtatttagacatgtatgaagaagcctcaattgagaataaagatagttctccttgtgcaagaaaaaaaaaactacttttaatctctgagattcagtgccatgactttcactcattcttgatttgttgaggcttccttcacagtcaatttattccctccgtctgcattgatgaagaacttactatgtgcaaggcactgctccagacatgcaatatggcagtgaacaggacagaccaagtccctgtccatgtggagtttatgttctagtgggggagacaggtaataaaccagtgagcaaacacacaagtggtccagacagaggtgagggttaagtattgcaccttcctcttgaaacatatctgttggctctaacgacgtccacaaggagatactgaaccctgaggctggagggtaaactcagcttcccaccctcaactcactctgttcccaggaatgaccaagtgtttatcatgatgaattgagcgtaacatcttcccatcatccttggggtccctattacagacagagacagagctgaaagctagattcattcatatctgactttttccactcacttttttttctctggagtggagtctatttaggaaaacaccttcaggggtcaaggtgatctcctatatcagaaatcagcagactttttcggtaatgagccagacagtacatagtttagtctctgggtcacacggtgtctgtggcgccttctcaactctgttattctaacacgaaagcagccagagactatcagtaaatgaatggatgtgtttgtgttccaattaaactttatgaaccctgaaatgaaatttcatatagtttttacctgtcagaaaatattcttaataattttttcccagctatttaaaaatgtaggaaaacatccttagctagcaggaggagggctggacttgacctacaggccatagatcatcgactgtgcctgtatcattcctcatcaatggtcctctggcatctgaatctttccttttttaactccagccaacagactgcatcctaaggcagattattctgctttcagaaaggtgctgtttttagaaagcatcaatcatgtattgagtcaaaatatgccttcttgtatcattcatccaacaaacactttgtaaagaaatttaaacatttcaactttataggatggaagtttggggatatacataaagttagagagaacagtgtaatgaccctctaggtgcccatcacccagtactgaccattatcagcgcgtggccaatcttgtctcatctccacctgccaccctgcatagattctttgaaaggaaatctcagatctcatattactctatcagcaaatacttccatacacatctctgagggataaggactaaaacattttaaggtgacctgattttaaaattaacagtaattccttaaaatcattaatgttcagccagtgtctaaacttccctgacttatgttctttgattgttaatttctttcaacccagatcaaaataagatctgggcattgcatttagtcagtaaatctcttaagtcttctttttaaataataggtttattgaagtgtaatttggcacacagtatttaaagtgtacaatttgataggctttgccttatgtttataaccatgaagccatcaacacgatcaagataacatttccgtcaccccaaaagtttctctgtagccttttgaaattcctccttcccacctctccccacctcacctcacctacctgctagccccatgctgtcagtaatttgctttctgtcattttagattagtttatactttctagaattttatataaatggaatcatataacaggtactgatttttatctgaccttcttttataattataattagtttgagattaatccatgttgttgggtatagatagcttattcctttgtattgttgagtaacattctgttggatggatataccacaatttatctgttcatctgttggtgaatatttggatcattcccagttttttgctattataagtaaggctgttagaagaatgaaaaaaaaataagccagagactggaagaaaattttgcaaagcatagatctaacaaaagacttatatccagagtatataaagaaccctcaaaattcaatgagaagaaattgaacaacctaattaaaaatgggcaaaagatttaaacagctacttcaccgaagaagatatacagatggcaaataagcacatgaaaatatacttagcatctttactttgggaaaatgcaaaataaaaccggaaataagataccactattaaaatggctacaatataaaacgctgtgtcgggcacagcggttcatgcctcaaatcccagcactttgggaggctgaggtgggaggatcgtttaagcccaggaattcgagatgaacctgggcagcacagtgagaccttgtctctacaaaaagcaaacaagattagcccagcacggtggtgcacacctgtagtcccagctacttgggaggctgaggtgggaagatcacttgagcttgggaggttgaggctgcagtgagcagagattgtgccactgcactctagcctgggtaacagagtgagaccttgtctcaaaaaacaaacaaacaaaaaaacaaaaaacaaaactgaccataccagatattggaaagatgaggagcaatgggacctctcatatactgctggtggggatgtaaaatgatacagctactttggagaccagtttggcagtttctcagagttaaataaacactgtggtaggcagaataatgtcccacctcccaaagaagtgcatgtgctaatccctgcaacctgtgaatatattacatagaaaaaggagctgggcacggtggctcacgcctgtaattccagcactttgggaagctgaggtgggcggatcacctgaggtcaggagttcgagacgagcctggccaacatggtgaaaccccgtctctactacaaatataaaaattagccgggcatggtgggatgtgcctgtagtcccagctactcgggagggtgaggcaggggaaatcgcttgaatccagaaggtggaggttgcagtgagccaagacggcaccactgcattccagcctgggcaacagagagagaccctgtctcaaaaacaaacaaacaaacaaaaagggacattgcagttgtgattaagttaaagattttgagatgggaagattatgtggattatctgtgtggtccaatgtaattataaatattcttataagaggatggcaggagggccagagaaagaaatatgaagatgctacattgttgactttgatgaggaaaaggggccatgagccaggaatgcaggtggcttctagaagctggaaaagacaagagaatgagtcttctctagagctttcaaaaggaatacaggtctgcctatgccttgattgcagcccagcgaaatgagttccaaatttctgacctttacaactgtagcatagtaaatttgtattgttttaagccattaagtttgtggtaatttgttacagcagcaacagcaaactgatacatattcctacatataatcctgccatctcatttctaattatttatccaggagaaatgaggacttacgtacattagcacataaatgcttctaaatctcttaatctgttagaggtccctctttctcatggatttctgccatttataacaaacatctgttgagtgtctactgtatccctgagcctactctttagagagatacagtaaataatactatttttctttctttcttgttttttgagacacggtcttcctctgttgcccaggttggagtgcagtggtaaaatcatggctcactaacagccttgacctcccaggctcaagtgatcctcctacctcagcctcctgaatagctcggattacagtcacgtgccatcacgcctggctaatttttgttttttttgtagagacggggtctcactatgttgcccagcctggtcttgaatgcctaggctcaagcggtctgcctgcctcagtctcccaaagtgctgggatcacaggcgtgagccatcacgtttggcctatttatctttctttatggcgtgttttttaggtggttcacacaccgtgaggttccttccctgacatctagtttaaacaatctctgttcttccacacagtctgagtgtgtgaaaattcctcttaagggactgtgatacagagaactgtacttagaaatgcaatgcgatttgcttagggtggttcaggatgttatgtgaacctctgttttttatcttcccaggatccttcaacatctctggacaaagtcatcccagctttaattgggagcaccatcttccttcagtttctagattatgtgactttgttgtgtctgtgactgacctcactccatgacaacagggcagtcacatgtctttggctggccaatcagggaacaccattgccctggccccaagagactggttcagtgatgggcacttggctcaagctggatcattgtagaaatccctgggctgtcaatcactcctcaacaggttgctgggtaagcacaacatcagagtaaagggaattaggtgatcctcaaagatgttcactcatgctggaaagacaagacaagttggcagcaaattcttctaaagggacacatatctagttttgtgagagaggcagtgtttctcatttggggacattttggagactcttggaaaaaccctggcaatatcaatgcttttgctcagctttttgagtggtgcatggagacacatggcctcagtgtatcagttggccgggctactggcaaggaattgggattggctttcagcttgttgcatgtgccctgcttagctttctaagcttgaacctgatccttccttacctatccaactgctactgtcactctttcctcccttaaatagaactcatctctctgctttatcaaatccacaaccctgcgaatccctgatcagctttgttttcttcactgagagctttctggcttcttcggtcttctaaccagattgcaattaaagacagaaatcatggcaaatacttatttcttactgtttcctgtttctaccctggtctttccaaccacattttaggggctgtatatcagatgtgcctcttgtttatatagagagtccggtagtcatttgataaatgtctgttgcgtgctgagattcgagatggacaaggtccctgccttcgtgaaggttgcaatatagtgggtgggaaaatacaataaacaagtaaatagatactatgtaaggatgaaaacaagaacaagatcagataatgggcaatgggaagagaggaaaccctaataaggtagccaaaggaggcttctttgaaaagatggcatttgagtagacacttgaatggactgactggcttctctccctctttttggtgttagcttggtggcttgtgataaaaacaatggacagtagaatttttaacttccttgctttctgtgcttttttgccaaatctcttccaaattgcctgaaatgatccaacagaccacagtagacacagtaagagagcccctcaagaattcctacatcctgatattcatgctccatggaatccctacaccttgagtgtgggctggatttattggcttacttcttgcaaatgaaatatggcagaagggaggtcaggtgtggtggctcacgtctgtaatcccagcagtctgggaggccgaggcaagtggatcacctgaggtcaggagtttgagatcagcctggccgacatagtgaaaccccgtttctactaaaaatacaaaaattagctgggtgtagtggtgggtgcctgtaatcccagctactcgggaggatgaggcaggagaatcacttgaacccaggaggcagatgttgcagtgagtcaagatcatgccattgcactccaacctgggcaacaagagtaaaactccacctcaaaaaaaaaaaaaaaaaaatggcggaagggatgagctgtcacttcaacgtttacatcataaaatgaccatggcttctaccttaggtattccctgtcttgctttctcttagatcactcactccaggtgaagccagattccatgtcatgaggcaggtctgtgaagagacccacgtggcaggaacagaggcctgtggcctgcccaaatccacctgcgtggctttgaaagtgaattctctcaagttgtgtcctcaagcgaaatttcggccctgacaactgcaactgcctaagtggccttgagccagaggcacccagccaagctgctcctaaggtttcagacccacagaaatagtgagataataaatgtttgtattttacaccattacattttggggtaatttgctacacagcaatagataactactacacagtcaaactggaatgatcatctatgggtctgtatgggtttgcctctctctactgagtggggcagatggccatggtatccagaaaaatactcttccttagataaaataggcatcccaaggccttttcacactgggtcataaatgtacatttagtggatcatttccatcactaaaatgtaagatccacaaggaaacttgcatacttgtaataactcatatactgtaagcccgtgtccagcatgtagttaagcattgtatgttcaccgacttcctttatctttcgaacaatcctatgataaatgtattattataatcgtcattttgcagatgtgaaactgaggcggagaagaattaagttgcccaaagtgatgtcatgtgtaaatggaggaggcaggatttgaacccaggcagtttggcttcggagttcttaataaatatttgggttggagtaaatgagggagtaaaactgtgggatgactcctgtccttcatttcttcattggtgttttcgtaaccccttgtgtggtatttgttgtcgacatcttgctgtctaaaatatattccgaaagcatcctgttcctttttcatctcgctgttttctttgctaagcccttcacaggaggctgggcctttctctctgtgttgggatcttttatattttaagatattctcttcgccaagcatgttgacatgtgagttgcaagcaaagcctctgagaagcaaaatgttgaacaattatcagttgaagacatcatgtcacaatgaacttctctttaaacaaataaaaaagtcccatagcaaactccttttatctgaggatctccaggggcccctctgacactggattgtcacaccgagacatttcaaacacagactctcatcatttagtctggttgctggggccccagacttctttagaatagataatgcagcttcattacggttctgtgtgaatgtgcctggaaaaggatcattgcatttcttttaaaaagcgttggcattttttttttccttccagccacttaattgggattgtgatgtgaaaaaagaagcatagaacaaaacttccaataaaaaaatttggactcagtctccataatgtcatccaggcttgctttggccttgatgaattcagcacttcagagggtatgtcaacacaataaattttatgccctcaataaaacttgtgagtgagctcagtgagaaattccaaggtctgggaagacaattaacgtttgaaatatatattgagttgtgtactgcgacattttatgtggccacagagctgtacccgatgtcacaggggaaaaatttccctaggaaatgcaaggtttgcttttcaaataacattgacatgtcagattcctccccaaatacagaggaatgtaagaaatgactaccaatgaaaatccagtgacattctctgaccacattgatgtgattctccttgttttccatttcaactggcagttgtcttcagagtgtatctgttgtcaacatctcagcaccttaattttattagactatttatatgactattctttgtagttctgtgtgcatgggggtgtcttattaattgatttgactggagttcaagccccagccctaccttttagtcaatgtatgatgttatacaaattgtattacctctctggactttattttctgttgtgagaattacagtcatgcacagcataacaacgtttcagtcagtgatggaccacatggacaacggtggtcccacaagattataatggggctgaaaaggccgggtgtagtggccaagcctgtaatcccagcagtttgggaggctgaggtgggcagatcgcttgaggtcaggagttcgagaccagcctggccaacaatggcaaaaccctgtctctactaaatatacaaaaattagccaggggtggtgggcacatgcttgtcccagctactttagaggctgaggtgggacaattgcttgaatctgggaagcagaggttgtagagtgagccaagattgcaccactgcactccagcctgggcaacagagctgagactccatctcaaaaagaaaaagaaaaaaaaaaatggggctgaaaagttcctatcacctagtgatgtcatacatagccatggtaatgcaacacattactcacgtgtttgtggtgatgctagtgttaataaacctactttgctgccacttttataaaagtctagcacatacaattacgtacagtacagagtacttgatgatagtaaaagacaatgttactggtttatgtatttaccatcctatacttttatggttattttagaatatactcctatgtatttaaaaaaaaaaaactgtaaaacagactcaggtaggtgctgcaagaggtattccagaagaaggcgttgttgtcataggagacggcaggtctccatgtcatggagatgaacacatgcctgttattgcccctgaagaccttccagtgggacaagatatggaggtggaaggcagtgattgtgatgatcctgacccagggtaggcccaggctaatgcttctctttgtgccttaatttttaacacaaaagtttaaaaagagaaaaaaaatacattttaaaagtagaaaaaaaatatagaataaggagatatttttatacaactgtacaatgtgtttatgttttaagctaggtgttattacaagagtcaaaaagttaaaaaaattagtttataaagtaaaaaagttacagtaagctaagattaatttgttattggggtaataattttttttcttttgagacaatgtctcactttgtcacccaagctggagtgcaacggtgtgatctcagctcactgcaacctctgcatcccaggctcaaacaatccccctgcctcagccttccaagcagctgggattacaggcatgcaccaccatgcctggctaatttttgtattttttgtagagatggggttttgccatgttggccaggctggtctcgaactccgggactaaagaaattcacccgcttcagcctcccaaagtgctcacaggcatgagccaccatgcgcagctagaaataactttttaaaaaataaatgtagtataactcaagtgtacagtgtttatcaagtctacagtagtgtacagtaatgtcctaggccttcacattcactcaccactcactcactgactcacccagagcaacttccagtggtataggctccattcgtggtaagtaccctgttggggtgtacctttttaatcttttatactgtatttttactatagcttttctatgtttaggtaaacaaatgcttatcactgtgttacaattgcctgcagtattcagtacggtaatatgctgtacaggtttgcaacccaggagcaataggctatactatatagtttaggtatgtagtaggctataccttccaggctcatgtaagtatactctgtgatgtttacacattgacaaaactgcctaataatgcattttccagaatgtattcttgtcattaagctacgaatgactataaatgcaacaacaggttatcatatagtctgttaattataatttaagaagtcgctatcatttctttgtgtaagattaagctctctttgaggagggtgctaaggcacagattgtgagcagataaaaaaatgtcagttaacatgtattagtcagttattgctgcctcaatgctgtgtgacaaataacctcagaatttcattggtttacaacaatattaattaaatagtatatttgtcatataaatttacctacttgtttatttttgctcataggcctgtgggttagtcaatacagctcagcttcaggctgcaaattgggtttaggtctactccctgtgtaccacccggggtgtgctctttcatgggcaatgacagtggtgccagaacagcaatcagaaacatgactgggcgcggtggcgcatccctgtaatcccagcactttgggaggccgacaagggtggatcacctgaggtcaagagttcgagactcgcctggccaacatggtgaaaccccgtctctactaaaaatacaaaaatgagccaggtaaggtggtgcatgcctatagttccagctacttgggaggctgaggcagaagaatcacttgaacccgggaggcggaggttgcagtgagctgagatcgtgccactgcactgcagcctgggtgacaaggcaagactccatctcaaaaaagaaataaaagagaagaaacacaggatgcctcttacgttgtaaactctaacccacactttgacaccttttcctacatactattggccaaagcaagtcacatcgtcaaaaccaatactagtggggcagagaagtatagtccatttagcgtaagagacaagacagatttggggaaaaataatgtcacctaccatgcaaagtaagaagaggtaaagaatctgagaccacttatatatacaaaaggtacccaagaaacatacagttttctctcttttggattcatatctcaaatcttttgaattgaccttattttctacaatccaagtaaagattgagttctttcttttccttctatttgacaaaatcatagatttgttccaccagtgactcatttttcctttcagaaaatcatgtactttttattcaaggtctccagaaactctttggctgaaggtgaaatgtgtattgatattgactcatctttaaatgtcaatgaccagtcaagataattaaggagttaagtattggttgcagagaaaagggaacgcttatacactgttagggggagtgtaaattagttcaacccttgtggaaagcagtgtggtaattcctcaaagagctaaaagcagaactaccatttgacccagaaatgccactactggatatatacccaaagtaatagaaatggttctatcatagagacacaggcacatatatgttcattgcagcagtagtcacaatagcaaagacgtggaatcaacctaaatgcccatcaatggtagactggataaagaaaatgtggtacatatccaccacagaatattatgcagctataaaaaagaatgagatcatgctctttgcaggaacatggatggagctggaggccattatccttagcaagtgatgtgggaacagaaaaccaaataccacatgttctcacgtgtaagtgggagctaaatgatgagaacacaaggacacacagagggaaagaatagacactaggcctacttgagggtgaagggttaggggagggagaagataagaaaaaataactattgcatatcaggcttagtacctgggtgaccaaataatgtgtacaataatcccctgtgacatgagtttacctatgtaacaaaactgcacatgtacccctgaatctaaaagaaacgttaaaagagtaaagtgttggccaggtacagtggctcacgcctgtaatcccagcactttcggaggccgaggcggatggatcacgaggtcaggagatcgagagcatcctggctaacacggtgaaaccccgtctctactaaaaatacaaaaaattagccgggcttggtggcgggtgcctgtagtcccagctactcgggaggctgaggcaggagaatggcgtgaacccgggaggcggagcttgcagtgagccgagatcgcaccactgcactccagcctgggcgaaagagcgagactccatctcaaaaaaaaaaaaaaaaagaaaaaaaaagagttaagtgtttactcatctattcaaatcaagtgacactatggtgtgcacgagactggaaatcaggaagaagtacaagattctagtctcagctctgtcactaagtgtggacaagacagtgatgttctctgggggtaatctacaagaaaaaaggctgaggaagccacagggcaaatcatttaatgacgttaactattttcagtaatctctcaatgcagaagtcatcgtctaaataagcattcctttccaaatgcagtctagctattttgcctaaaagttggcagatgtgacttgccccagggtagagaacatcttaagaaagatattttaaatgtggtgtttaaacaacctataacaattatgcaggggttttttaagttcatataacaattctactgctttttgctcattcattgtttctgtttttctcattgttgatccagtaatttcacttttaaggaaatagagatgaggaaaaaggtttatgtacaaaaatgttcattgtggtacttaaaaaaattaaagtaaaaaattggacagaacttaaatgtctaatcataagggactgattgagtaaattattgtaaatctatttaatggactataatgcagatgttaaaatcatgttttaaaccattttaatgacttgacaacgttcttatggtataatattagatgaaatatgtaaaataagaaaagcataatattttatgaccatcaattctttaaaaatgcaataataagtttgtaaggaaattcagaggaacaggaatggtgattatctcaggattgtgacattctaagtactttgcatgttctttacatttttctacgttttctatttttgacaacaaacattattactttttttgggggggggggcgacagagcaagactctgtcttgctggagtgcaatggcaggatctcggctcactgtaacctctgcctcccaggttcaagtgattcttctgtctcagcctcccaagtagctgggattacaggcacatgccaacacgcctggctaatttttgtattttttgttagagacatgttggccaggctggtcttgaactcctggcctcaagtgatccacccgcctcggcctcccaaagtgctgggattacagttgtgagccaccacaccagtctatttttcatttttgttaaagtaatacatttacatacacacataggcatgccctaccgtttttacattctgggttcaggattcagggtgtcagaggaacaggaattccagtggaggtaagctctgatctggggagagactctggggacacgggtgtgctcattcctggatttggggtcatcctgtttggatggctcccagagggaattaagaagcctttggcagaaccacttctgatcgagacagacaggcagtagtctttgaacccaagcactggcttacaacttggacttgatgaaggcattacaaaatcactttatattgctcattctttccagcaacttctctgtgaattctagttggaggaaaaaacaaacaaacaaaaaacaaacacagactttagacacaagacgttttgcagcctccagatctgctcacactttgccaccggtgtctgtaggggataaagtcaactctgcagggttggcaaatggcaagatttgcatacacccagaaatcaccattgtgatcttcgtttagacagcagtgcccccagaacccgcctgctagccctattctcccaatgacatataggagagacttccaaagaggtttgggtctgaggtcacaagtggttttcatactgaaagtaattttggtggaaaggagacggcttcaaaactcctgatgctctttattgtcttcaaacagcttaaacagaatgtgcaggaaatataagctcctccctttaaaacactgaccttttttcacattagtttccctggaagtttgaacaaagaatcagtgggtaaagaaaatgatttgggatcccagttgtacagcgggcattttttgaagtgttttatcatcttgccagagtggatatgcttggctggagttagagcccgccagtgaggatctcaagctcaagaactcaacactcctgcctttctagggtttgatttactctaacacatacgcactgccaaggtcattgccaccctttagaggatgatgcgacaatatggtgtttaagacaaacttgcaaataggttaccagcccatggaagaatttatttttatttttattttttaaccagactcaacctggtttgtttgtttgtttgtttgtttgttttgagacggagtttcgctcttgttgcccaggctggagtgcgatagtgcgatcccctttcaccgaaacgtccacctcctgggctcaagcgattctcctgcctcagcctcctgagtagctgggattacaggcatgcaccactgtgcctggctaattttgttacttttagtagagatggggtttctccatgttggtcaggctggtctcgaactcccgacctcagatgacccaactgccttggcctcccaaagtgctgggagtacaggcgtgagccactgcacacagcccgccttaacctgtttttaagataaacccaggtacaaacatgcaataaagcaacattcctttgtttcctcaacgtgaagctcagttgtgacaaggtgctctattgttaccacaaaggggtcccgatccagattccgacaaagggttcttggatctcacacaagaaggaatttggggcaagtccatagagtgaagtgaaagaaattttattaagaaagtatagaacaggttgggagcggtggctcacacctgtaatcccagcattttgggagactgaggagggtggatcacttgaggtcaggagttcgagaccagcctggtcaacatggtgaaaccctgtctctactaaaaatactaaaattagccaagcatggtggcaggtgtttgtaatcccagctactcaggaggctgaggcaggagaattgcttgaacccgggaggcagaggttgcggtgagccgggatcgcaccatcgcaccccagcctgggcaacaaaagtgaaactctgtctcaaaaaaaaaaaaagtaagtaagtaattaaagaaccaagagaatggctactgcataggcagaatagtgacgtgggctattcaactgagtatacgaatggtaatttcttgattatatactaaacaaggggtggattattcatgagttttgcaggaaagggacaggaaattcatggaagtgaggtttcctccctttttagacgacatagggtaacttctagacattgcatggcttttgtaaactgccatgagactggtgggagtgtcttttagcatgcaaatgcattctaattagtgtgtaatgagcaacgaggatgacctgaggtcacttttgttgccatcttggttttggtgggttttggccagcttctttattggatcttgttttatcagcagggtctttatgacctgtatcttgtgataccagtcctgccgacctatctcgtcctgtggctaagaatgcctaacctcctgggaatgtaatccagtaggtctcagccttgttttacccagcgcctattcaagatggagtcgctcaggttcaaacacttctgggaagatcacacattttaactaggtccctgttgtgcactgaattacttaggagatcatcaggggttcctaagatggtctcaggtggtagaaacttatgagcgagaggataaactagaagagagtaaaaaatattactctgtggtgggagaacagggaattagggtaacggaggttcagcaggtgcagccagttcacataagcaaaagaacagcaggtccagccagtttgcataagcaaaaaaacagcaggtgcagcacataggccacatccttgctcccatgataacaagccacttcagcttcccattggtcacgggccagtccttcaaagggtgtaaccaactggagacctctaaaaggcacctaggggtgttgccaagttcttttggctttataaaaactcttgggaggattgcagtaagcaggcacttgagttgcttgttcgagcctgctctctgtgagttgtgttcaatatctctgcccatcgtgtggcattttgttcaattccttgtccaatacgccaagaacctggacaactcacgattaggaccttctgataacatattttggcgaaccagtcaggaggtaagacaatattttgggactttttaatattcctcttctctgagtggggcgagggactctcatttcatgtatgaattctttatgcataagagcgtggaattttccattgtttgtagggataaaccccataataatttcacagtacattgcaagattgcttgtttcatgagtttcaggccgaagaagcttatttcacttggtgagacgcaaagagctgagcgttgcatccgttgaccaagggaatcatagaccattccattgcctatggaggaaaaacatcctcagagatgcctgaccccctagggtcagaggcatcagcaacagataggccctccttaggccagatcactatgggaaacaatattcagacgagttttcgctagtaccaatagacgcctttgctggcttggttgaagcctaccctaacagaacagagaaggctaagaaggttataaaggttctcttgaaggaaatcatctcctggtttggattaccccaaagcctccaccacaaagtctccaaagtaataacagcccatcttttatctcccaaataactcaagcggttgctaaggctgttggaatacaagctacttcaggccctgattgactgcgggccaggtctccacttcagcctctgattggtggcaggccaagccttcatggggtgtagccaactggaggcctctaaagggaccgaggggtgttgctgggctctggcttcatgaaaactctaaggaggctcttgagccgcttgctcaagccccctcccactctgtgagctgtcttcaataaatctgtgctttcatcactccattctgctgcgttgtcctccattgcttcgttcttttgttactgtctgtgttgttcaatacgccaagaacctggacaactcgatccagtaacccttcgtactactatctccattactaccatgataactactgttgctgctgcttctattttattactctgactgccgctacgttactactattactacctttagtattgctgctgctgctgctactattactattattgccaccactacttttggtattactaccactaccgtgatggttactgctcttactgccgcggctaccagcagtcgccgttttatttttaacacctcctgagtgcacatcagtttatatgtgtgaagtcacttaatacaaatgccggccaggcgcggtggctcgcgcctgtaatcccagcacgttgggaggccgaggcgggcagatcacctgaggtcgggagttcaagaccagcctggccaacatggtgaaaaccccgtctctactaaaaatacagaaattaggcgggcgtgatggcacgcgcctgtaatcccagctacttgggagctgaggcaggagaatcgcctgaatcccggaggtggaggttgcagtgagccaagatggcgccactgtactccagcctgggcaacagagggagactctgtctccaaaaaaaaaaaaaaaaaaaaaaacctgccaaccagtgtgaggaatactaactctgttgttcagatgaagatcttgaggctcaaacattatggtaacttgtttaatatcacccagtgagtgacagaactggggtgtgaagccagatttctgactctatttctcaaccaggatgctctactgggggtggcggtggggagagaagaaaaccatagcagacgattcacctgctgaatggctgtaattcccatgtgaggagatatgaatagtgtgaaatccaacaaggagacccttgttataaggatgcaggtacagggcgccctccccttctaagcttcctggctagatctcttgctttttctctcatgcattcacacttagatatacacacagcatatctttgagcatacaatttcacttagctgacctattttattttaaagaggaaatgagctaatgccctagatttcagagaagactgacatatccccgtttatctttctgctcactgctgttattctaaatcccaaacctaagtcgacaggttttcttaataggctagggtaaaggaaacctgggggcttctctctgccttcccctctccttccccatcctagcctcaacatttactcattatccatttgctgccaaacagagctcaaaaaagggagatctgctaattatttcatttgataaacacatggattgagtgcctaataatagctaatactttttgtgctttaaccataagctaggcctttgcacatataatgcatttcattcttacaatggccctatgagatgagaccattatcatccctttagagaggccagacaatgaaatctcaggttaagcaactttcccaaggtccctcaactttagcagaattagggcttcactacattgtgcaaaataatgatttggaaacagtttcatgccatgggagataatatacagataaataaggctcaactccttgtgtcaaagatgctgaaagcatggttatggctaaagatggggaaacaagcaaacataagcttgaacaaaggacaagggtggactagcaggttgggggaggagtaagaaaaagggctgaatctgggctgcataggaaactaaccagcttcgagaccctaacttgtatagtgggtttcagtgttgaagggccagtgagtttgaggcagaaataggcaggacagaggggcctgcagactgattgtatacaatctgctgctgcagtattcacaataccaaaggcaggaatcaacccaggtgcccatcaatggtagactggataaagaaaatgtggtacatatacatcatggaatactatgcagccatgaaaaagaacaaaatcatattctttgcagcaacataaatacagctggaggccattctcctgaatgaaataacacaaacggaaaacacaaaatactgcatgttctgacttataagtgggagctaaatcttgggtacccacagaaataaaaatgagaatagacactggtgactccaaaaggaggaaaagaggggggcaaaggctgagaaacttattaggtactatgttcactatctgggtgatgggattaatagaggcccaaacctcagccttgcacaatatacccatgtaacaaacttgtacgtgtaccccctgaatctaaaatcaaaataataaaaactgctacagtttgaaatgggccagctccaagtctcaccctgggtgctatattttcttcaatataatgaagtgctgcctgtacccatgtgcaaaggagaagtaaagggcaacagctctttgtcttagcccagaaacctcaggatataagccctgggaggagacagtctttagtaagaagaccctcacagaggtctgatgagctacttcaaattatacctggcctgtgcttgcttttgaggtttgaataagagttaattggctgggtgtggtgcctcacacctgtaatcctagcactttgggaggctgaggggggcagatcacctgaggtcagaagttcaagaccagcctggccaacttggtgaaaccctgtctctactaaaaatacaaaaattagctgggtgtggtggtgggtttctgtaatcccagctactcaagaggctgaggcacaagaatcgcttgaacctgggaggtggagattacagtgagccaagatcccaccactgcactccagcctggaggacaaagctagactccgtctcaaaaaagttaagtcaaaagggaaagttgcatcaggcagaagaaacagattaactccatgccccattatttcccctatgtcagggatggagggaatagtacctttctcttcttgtcttcctatacctatctgccttctcttaccctctctacctattcctttcttcactgcttttggagggaatggaatgccagctaggtttgtttgagacattgtttaccagtgggtggcgatgctactgaaaaactgggggtttggtctgggtcctgttgctcaccacacagaaagcccatcactgagatgaccagtattgctaaggacgaaagctttgatccagtgccaaggagatgggaactcattctcaaacccatctccctgaccaatgaaaactaaggggtttatatagcagggaagaaatgtaacaatgtgtgaaaaagcagttatagtgaggggcaaggaagcaatctcatgaatgagggatcccacattttgctgtctgaatgtggtgatctggtgagtttcagttctttaatagttttttaaaaagaggcctgaaggtcttttcctgaggaagaaactcagataaaagaaatgtaagagtggggcctggtggctcatgccagtaatctcagcactttgggaggccaaggtgggtggatcacctgaggtcaggagtttgataccagcctggccaacatggcaaatcccacctctcgcttgaacctgggaggcagaggttgcagtgagctgagattgcgccaccgcactccagcctgggtgacagagtgagaccctgtctcagaaaacaacaaatgtaagtttcaagctttaagaacagaaggatcaatttctgtgtttatccaaaaaaaactagttgactattgggtcagtttcagtgatgttcataaaaagctcagacctaacccttttcattcccctccctctctggtttttctcctacaccatctggccagctcccaaactaaggtccttattgtaccctggccacgaaaagcctgagcgtgaagatcattgagtgtgagggcatcttgcagccgcatagaaggtagtggggatccaagtgcaggatttgggctgaggtggggcctccagacccttgcagtaagctccaactgagccatgtcagagctctgcactggggtcaccaggtcaagctgttgataaaatggtgctttgatgttttcctgcaaaccttccatatccagtccccttgggaacattcagggtggccaggatgactgttgacagcacatgaaaactttcccttgatttttattttattttttattttattttaagacagagtctcttgctctgtcaccaaggctggagtgcaatggtgcgatctcggctcactgcaacctccacctcctggattcaagtgattctcctgcctcagcctcctgagtagctgggattagaggcacctgccaccatgcctagcttatatatatatatatatatatatatatacacgtgtgtgtgtatatatatatatatatacacacacacacacacgtatatatatgtgtacatatatatatatatacacgtgtatatatatatatatatatatatatatattttttagtagatatagggtttcagcatgttggtcaggctggtcttgaactcctgacctcaggtgatccacccacctcagcctcccagagtgctgggattacaggtgccagccaccatgcctagttacgttcccttgatttttaactttcagcatcttcccatccttgtatcttttcttaatcttctgggtcattctctcttcctcattatccatcaagattcagctcatctgctgttctttttccaattccctctatgaaaaaaaaaatgagaaatcccctcctcttgcctgtaagctctaatggcactgttgtagctttttgtttctgtcattgccttgactggtttgtgagcttcctgagaaaagattttgtgtatctgattcatctgggggtgtccagtgcttagtgaattgcctgtcattaaataattcattcattaaacaaaaaatgtaaggggtgcctctatgtgccagatgctatgttagagtctgggatacattaataagttccctgtcccaagaaacttggagtctagtgtgggagagaggcatcagtaaaataatcacacaaatacatttaaactgacacctgaggtacataagcctttgaaagcacatgggaggggactagagcttgttggaaaggtcagtgaagcctcaggaggaagtaatgttagagctgagatctgcagggagagtggccctaaccaggtgaacattccaggtagaagaaacatggtgtaaagccccgggctggagatgagtacagcatgctaggggaagtgagagaaagctcactgtagccaaagcaaaaggggctagagtcaaagagagacaaggaagtagtgcttctgtgtctcagaagctcagaattgatgagccgtggctaaaagatgggtcttcatcccacaattgtgtgctcggcacaacataaggggctccctgaatctcctcagattcctgaatgctggaggctttggtcttccacacagataaactggcccctttctgccctcatggcatgtgcattaatgatgtgggtgtggatcagtgtttttacaagttggatcacccggaccaccctgggatgcagcggaagatgtgacagagaaaagtcgatcatgagggcgtctttgtgtagcctgttccaggagagaaggaaatacaatccagaactggaatgtctttcaatttccataagcaaatggaaaggatcttaattgagccaggatatcttcagtgctgtgcctgttttcatgatgctgttctctttcctggatctctgcccatgagtgtagggtgttctgtctggcagagaaagcatctcatacaaggagccctcatacaagctacataaaatctcagtggtctcagagctttagagtaaaatgggagaggaagatagacattaaagtaatgatatccaaataattatttaaaattgcatttggcataaacactattacttattttttgagagatggagtctcgctctgtcacccaggctggaatgcagtagcatgatctaggctcactgcaacctctgcctgcagggttcaagtgattctcctacctcagcctcctgagtagctgggattacaggcacccaccatcacgcctggctaatttctgtatttttagtagaaacgaggtttcattatgttggccaggctggtcttgaactcctgacctcaagtgatccacccacctcggcctcccaaaatgctgggattacaggcgtgagccactgtgcctggccatgtttggcataaatattataagaaagaagtacagggcactgagacatatagcccagtctggtctcggtgtctgggtagagtgatgccattttctgcaacaggaaacccagaaggatgaccaggtttggagcacaggatcagatccctgcccatgagcactgggttttctgtctggcagagaagggaacccatacagggggccctctctttggggcaaactgcccctacctcccatctagatattttatgaagagctctagttactgcttccaatctaatatcacctctgcaagaagaggttgagaaagagggaggaaccaaggatgacttccttgtttagggccaagtgactaggtggatgttaatggcataaacacaagaagaggtttaggggagaaaccaataagctcaatttttgtcttgatttgtttgaggagctgaagaacatccagttggatacccaaaaggtagctggagatcggagcctgggcttgagaaagttgggtgcttgaagactcagaaatgtttgagcaactttgtctaggaaacctttctcttcttggaaacagccaatttcccatctttaaaatctccctggaagataggtagaaatacctagtaccagccgggtacagtggctcccagctataatcccagcactttggaaggctgaggcaggtgaatcacctgaagtcaggagttcaagaccagcctggccaatatggcaaaaccccgtctctactaaaaatagaaaaattagccaggtgtggtggcgggcgcctgtagtgccagctagttgggaggctgaggcaggagaatcacttggcggaggttgcagtgagccaagatggcaccactgcactccagcctgggccacagagtgactctgtctcaaaaaaaaaaaaaaaaaaaaaaattcctagaatacagcccacagctccaaattacatttttaggcagttttcacaccatcctaaagaaaaagtcaggcagcctagacaaaggtattcctagctgcccacacaatccttctttaccttcttctgctatgtcatcaagccaagcagcacaattatttttctttcatatcatcatggatttcaatttttgtaacttctttaaaatttctaatagagctctttcatgtatccattcattcattcaatgctgtgtgccagtcattgaagaaaactacacaaaatctcagtggccttagagcttagagtcaagtggaagaggcagacagacattaaactaatgatatccaaataattattttaaattggcattgtcataaatattataggaaagaagtacagggcactgggggatgtagcccagcttggtctcaggtcttggatagagaatgatcagtttgctgggatgggaaattcaggaggaagaccaggtttgggtgtagaggggctttaaaacggtaaataagactcaaacactagccgggcacagtggctcacacctgtaatcccagcactttggaaggccgaggcaggcagatcatttgaggtcagcagttcaagactagcctggccaacatagcaaaaccccacctgtactaaaaatacaaaaaattagccagttgtggtggtgcacgcctagaatcccagctactctggaggttgaggcaaatcaaacacctgtggaactcactatgtgcactgggcaccattctaagcaggtttcaaccatccgctcatataatccttacagcgatcttatgaaggagggaccagcattatccttattttacagatggaggcgccaaaggggctaacatgtttttccaagtctccacaattaacaagagacagagccaggatatcaaatccagacagactgccagaatccaccctctctaccactgtacatgatacaggctctctctgggggacttacctagatgtgttcatttgaagattctggtgacaattggataaacactttccttatcattttaaaccgtttgagctgggatttctgttatttgctggcaacagatacaaatgtgaacggacgtctgaagttgtaaaattcaagagagaaggctgggctgggttcaatctaaggaaaaccttcacgttttacctccggcaatgcattctgggctatcctcttctcagtagtctttcatcttgaaaaggtttccttgaactgtagcctcttctgaaggacaaagacatttagggcatgatttttttacaaattaaatcgagactgggttcagtggttcacacttgtggtcctagcactttgggaggctgagattgaaggatcccttgaggccaggagttcgagactagcctgggcagcataatgagaccctgtctgtacaaaaaattaaaaattaggtgcggtggctcacgcctgtgatccctattacttaggaggctaaggtaggaggatcacttgagcccaggagttcacagctgcattgggccagggttgagccactgcactccagacttggcaacagagagaccctgtcttaaataaaatccaaaaaaaagcaactgcctactatggcggtaataccatccattcacagagtcctgtcttcatcttcccatccatacacagatatgtactttttgtttttttttttttttttttggagacagagcctcattctgtcacctaggctggagtgcaatggtgtgatctcagctcactgcaacctctaacctctgcctcccgggttcaagcaattctcttgcctcagcctcctgagtagctgggatcacaggcatgtgccaccaagcccggctaatttttgtatttttagtagagatggggtttcaccatgttggtcaggctagtctcaaactcctgaccttgtgatctgctctccttggcctcctgaagtgctgggattacaagcgtgagccaccgtgcctggcccagacacgtacatgttaagacccctgaaacaactttatgtacaagctaagtttgacacggtgatggatgtgaaacctggcaagtctgaaaggcaggaaaagccagcagagcggaaactgcttgcagcgtaacagaagcaggaagcttggtctgcctgtcttgggcatctcacgcctcacttgccttgttgcaaatatcgtaactctaccttgttcaagatccactaagactgattaaaaccgtttaaaatggctcttgttgacaagatttactatagaacatcttaatgactaaacaaaattatggtgtaattttacttgattaaagacaaaactaaaacctgtgcaatctccagtgtatgtgttaagatagcaacttaaaaacatctttaaagaatttagagcctggctcctgctggagagaaatgaaaatgggaatgtgggtattgttcatgggtttccttccccttacggcagcttcctgtgtggtttttgtttctttcatccctccgctggctctgtgtgcttttttccaattgtctagagagctagaaggtaatgactgtaaaaaaccaacgctacttgcaagcagggttgtatctctagatgttctctggacttcactccgtatctgacttcttatatgtgtttatcagtctcctgttcaaattccttctgtggctccagtcccaagcatcccctaatatcacaacacaacctgtttataagataaagctatgagtttattgcttactgcagtaaaaaaaaggacaccacctcatgcctcagtagggatggtaaggtcagatttttttttttttgggggggacggagtctcgctgtgttgcccaggctggagtgcagtggcacaatctcggctcactgcaagctccgcctcccgggttcacgccattctcctgcctcagtctccggagcagctgggactacagacgcccgccaccatgcctggctaattttttgtattttttagtagagacggggtttcactgtgttagccaggatggtctcgatctcctgaccttgtgatctgcctgccttggcctcccagagtgctgggattacaggcgtgagccaccgcgcccggccagggtgagaatttaatgagaatcggaagctcaacggaagacagggtcttccaaagtgggggcttgatgaaggatcaggtagagagcttgtcgtaacaacccaggattggtgcacacaccaagacgtagattttgaaaaaagggattaaagatgtttagagtatcaattattgatgtattccatggaggagctgatcttttgcagattcttaaaatgaacaccaattcctctacctggcagatgactgatggaaaaagaaagtcgtgctaatgaagacagaggaatagcacgaagtcatgttcatgtggacagaaaagtgctgttttttttttcttttttttgagacggagtctcactttgttgcccaggctggagggcagtggcgcgatcttggctcactgcaagctcttcctcctgggttcatgccattctcctgcctcagcttcccaagtagctgggactacaggtgcccgccaccacgcccagctaatttttttgtgtttttagtagagatggggtttcaccgtgttagccaggatggtctcgatctcctgaccttgtgatccgcctgcctgggcctcccaaagtgctgggattacaggcgtgagccaccgcgaccggcctaagaaggtgctgtttttgttctcagtgtccaggcagagagtgaggcattaatagatggtttccattcttactctccatggatgaagttgagggcgttggacgtattcccagggtcacatgtgatctgtcctctgcctttccatttccatcgcgtctccatctcagcttgtactctgtgatccagctctactgacttgcttttaacttcttgttgattcccaccccaggagcttagcatgggctgtagctatgcctggaatgccatttctccttcctattatttgcctagccaactctttttatatggcttaaacgtcacctcttcaggaaagtctcactgatttccaatctaaaggttggttcccccattctcaattcttttgagaggaaatgaactgaacccctttccacattgcttatgttttcttcagagaacttatcataatagtaactaaatggcaattttggaatcggttattttttatgcttgcctctgtctgctgctcactgctgtatgcctagggcttagaagagtgatttgcagctaatggatcctcaatagacatttgcagaatagatgattttgtgaatatggactgcgtctcctttgattgatgggaaaagcttttgttccattgaagttgagtgtgtatttctcatggaagccttctgtgatatctaaccccactgctatcggcaaaatagtgtctccccgaaattcatatattaaggtcctaatccccaatatctcagaatgtgactacatttggagttagtctttaatgaggcaagttaaaatggggtcattagcatgggccctaatccaatatgactgttgtccttataagaagagagacaccaggggtgcatgtgcatagaggaaagtccgtaggggacacagcaagaaaacagccatgtgcaagccaaggagagagaccccagaaacaaccaacctgcagacaccttgaccttggactttcagtctccagaactgagagaaagtaattttctctttaagccacacagtctgtgctattttaatggcaggtccagcaagctgatacccctgcctgagactgggttaggatcccctgctctgggcagcccttctgtttctccacatcaagatacttaatttctctgcattataattggctgtatccaactcgaagcttcagagcagaaggaactcacctcttccttcctggaacctggcacagggcctggcatataagaagtgtcttctgtttgtaaaatgaatgaatgaaagaatttgggaataaagtcaggatgctgagggttagcttttgtcaaatattgctgtgcagaaatttcattcatcaagtacttattccatgcatactatataccagacactaacctaggtgctaggaagaatgcagtatacaaaggagatttaaaaaatatccttgtcctcaagagtcttatatcgtgctagacgtagagaaataacaagcaagagaagtaaacatacataatggggccaggtctagggtgatacacatgaggcactgactgggtgcaaaatttaaggcagtgcaaaaaactggagtaattaggataaataatttaatgcaatttacaactttaatgcaatttttaatgcaatttttaaaacacaatgcaaaaatatccacaatggacaaaacatcaaaatcttcagtaaagacaagatggttatacagcctgctatgagaaaaaaaaagaattgggaatgggaacaggaaattttgtggagagaggtgttgaggttgtaggtggagtgaccagagaagtccctaccaagaagatgctacttgggtgaagacttgaaggaagagaggagcaatccatgcaaatatctgggaataactttctctgcagatggaacagcaggtgcaaaggcccctggggttgcaccacacttggagaggaactagtgtgactgaaggctaggagttagcaggggaaggggtacaggagatgaggttagaggggtaataggccaagatgcagagagaatgagctgaactcaatattgccaactcattcaaacttagaggctggaaatcaggattttaaagtggtatctcttaatttttaaaggaagtctactaatatgaaaaaataattaaacactgcataggctaaaatcagtagttcactactgcaggcaattttgcctcccacagaacatctggagatatgtgtggctgtcacaaccgggaagcagatgctactggcacctagtggatagaggccaaggatgctgctgaaatccagccttgcggccgggtgcagtggctcacacctgtaaatcccagcactttgggaggccaaggtgggtggatcacctgaggtcaagagtttgagagcagcccagtcaacatggagaaaccctgtctctactaaaaatacaaaaaaaaaaaaaaaaaaaaaaaaaaaaattagctggccatggtggcaggtgcctgtaactccagctactcgggaggctgaggcaggagaattgcttgaacccgggaggcagagcatgcagtgagccgagatcgcgccactgcactccagcctgggtgacagtgagactccgtctcaaaaaaataaaataaaaaataaaaaaataaaataaatcctgcctcgcacaggatagccccactccccccgccttgcaaagaagcatgatttggctggaaacatcaattgtgccttaggtagaaaactctgcgctaaatagaacatagctgtgaatggaaactgttgatgaggtcagcaattccaggaaaggatcagatgggccagaagctccactacggccctcttccctccacgcctcccaaaatgcccacccatttcctttatgctgcagcagaagtgattttccaccacatgcctaacactcctcctcattaagtaatcactatccacagccactcatttccatgtttgtagccagtccaggtgtaaaagacgcctgccctgttcataggagtcagatggagatcagccaattacagggctattagatgaaaatgcagtgccttccttatcttgcctctgtgggttgagctcttcacgatggtgggtttgcgcctgatcagtactttagtccaatgcccgcccagcctggttctctaattctggccagcagagcacaatttcctattctaaatggaacagctccgctgatatgttctgagcagcagcaatattcacccttttgcatactgtattcatagctgattatgcaaatcacatttcattagtcttttcctcattaaaatgatttgaaagacaaataattttggatagacttttattgttgtgcaagggtatgtctaaagcaactgtttttggtgcaatgagctagaacattagtcataaactaaaaaatccccacaaagccctgggaggtactgggaaaatgtgaaccgggtcatcaaaatagaaggtggtggtaactggggcagactggaggcagctcacctagactagaggagacatctagtcctcaggtccagccaatatggcagaatggcaactgggaccagtagggcaagactttttctttgacattttaataggactagaaatctgagattttttttttttttttttttttttgagatggagtctcgctctgtcgcccaggctggagtgcagtggcatgatgtcggctcactgcaacctccacctgctgggttgaagtgattctcctgcctcagcctcctgagtagctggaattacagccatgtgccaccacgcctgactaatttttgtatttttggtagagatgaggtttcgccatgttagccaggctggtcttgaactcctgacctcaagtgatccacccaccatagcctcccaaactgctgggattataggcgtaagccaccacccctggtcaaactctggatttttaaagaactctatctgctttaatacactgaatgggaattctttgacatttatgtagtgtagatgtagtgtgtgggttatcagatggtgatctctagttaggttctgggaactatctgggttttgcatgtgagagtaactcagtccagaaagttaaaaatggactgggtgaagaaggaagggatggtggattcaaggtctgcccaactcaggaatagtggttttcctgcccctaaaccaaagcctcgtcatcctcatcagtatcataatggccatttgtgtgcacagcatcgtaagggaagggccttatcgttaactcatgcgtttcttaaaacaccctgtgacccattttgcagatgagagagctgactcttcataatcacatgacaaatgagtgcatacccagaatttgagcctgtgactctacattctgagctttgatctattactatttgatctattactgctgactatagatataggttggaatgaatgtagtaaagttttaggatacaaaaatcagtagcaattctacgcaccaacaaccgttgagctaagaaccaaatcaagaagacaatccccattacaatagctataaaaacatataaaatacctagcactatatttaaccaaggaggtgaaagatctctgcaagaaaaactctaaaagaccgatgaaagaaatcctaggtgacacaaacaaatggaagaacattccatactcatggatcagaagaattaataccattaaatgaccatagtgcccaaagcaatctctagattgatgtaatccctatcaaaataccagtgtcatttttcagataaaacaaacttaaaatatgtttaggctgggcgtagcagctcatggctgtaatcccagcagtttgggaggctgaggtgggtggatcacttgaggtcacaagtttgagaccagcctaaccaacatggtgaaaccctatctctactaaaaatacaaaactcagccaggagtagtggtgcatgcctgtaatcccagctactcaggaggctgaggcaaaagaattgtttgaacctgggaggtggaggctgtagtgagccgcgatcatgccactgcactccagcctgggcgatggaatgagactccatctcaaaaaaaaaaaaaaaaaaaaaaagtttttaaaaaaaggcccggaaattgtggctcatgcctgtaatcccagtgctttgggaggctcagatgggaggattccttgaagccaggggtttgagaccagcctgggcaacaaaatgaggccccatctttagatagagtttttaaaaagacagatatagtttggcagattattttcttaacaatgtaaagactctagagaaagctgaggttgagtgtttctgaacttgagaaaagtgttttgtagtttttggccatatccctatatgtggagtgggacaaagtcaattagccatccgagagttctctagactcatgaaaggcaagaagacagcaaagacaaagttggccgtcctcaatggctcttaacctatgacctatgggagttggtgtatcaatacccagctccctcactgcccttaagtgcctgttctataccattcaccagagctttgcagccctcgttgcccacaggagtagcttgattgataacactgtacattgacttctttcccttttttatctcactactttcacctctcacatcaactacaaatgcttgtcttagggtcttctcctgagagaacccaaactaagacacaaggaaacctcaaattctttgttttttgtttaacttgcattgtgtttgcatctttttgaactaggctagtcatgtcatcaagtttatccatctgcattcaattaaatttttagacagaggtcccttgctgttgcccagactggatagcagtggtatgatccaatcacagctcactgcaacctcaaacgcctgggcttgagtcagccttctgcctcagcctcccaagtagctggaactacaggtgcatgccagcacaaccaactagttcaaattttttttgtagagatagggtctcactctgttgcccagtctggcctcaaactcccagccttaagtgatccccctgccttggcatctgaaagtgctcagattacaggcatgaaccatgcccaatcccatctgcatttattatgcaatgtctagggtaatattgggcagattacaacagaatttagaactagttttaacttaagcttactagtagaagaattctaaaataaaaggggaggcaagatataaatcaaaaggatttggtcaaagagaagatacttgtattgctgtagttcctgccacgtttccattggttgaaatacagttgattgtctacagtgcagccttaccagtgataaggggctgtcttctttaatcttcctttttaatttgcttcctaattactttaaaggaagaactctttggcactgaaaattactctagattgtaaccaaaaaaagatccagaacctttttttttttttttctatttcttttaatcttcattcaggggcatagtataattgaattaagacgctaccagtgggtgaattacaggataataattcagacctttctgtttaataggggctggcctgtggccttgagtccactagatctgaagggtgaattactgctccataactcactagctcccatttaaagagaccctggttaaagagaattaacatcaacaaccaagtcaggaaaaggcaacccaagacctaagagtaagagatgaggataacacagaaatgaatttggaaagttctggcttctcacttcaaagaaggcaggcttcagagaataaaaaaccttccataaaaaaccaaaggcctctctgctcagcagagctctgggtgttttttcaccaaagccctggcaaacatacccagatgtctcaagcatgcatcctttcagatctaataaaatgactaactgggctttaaacctagcctggatatgggcgaggtgtccggcagttacctgcaccttgaacagagtggacaataacacccaaagtccttctttctgtcttccctaaagtgtatgtatgttatttatttattgtttatttatttagtctcactctgtcatccaggctggagtgcagtggtgtgatctcggctcactgcagcctctgcctcctgggttcaagtgatttttctgcctcagcctcccaagtagctgagattatacacatgtgtcaccatgcctggctaatatttgtgtttttagtaaaaatggggtttcaccatgttgtccaggctggtctcaaactcctggcctcaagtgatttgcccacctcagcctcgcaaagtgctgagattacaggtgtgagccaccatgcccggcccctgatgtgatgtttttctagctgatgcctgaaatgtcaccattagcaatttttttttttaaagtaaaagctgacatccttctgtttcctcttttccaaaaaagagttgacagtggacataagttaaatattatagcacttaagtcatagatatgaattcagatctaaacttcattgactgtgaaatcaaagggaaattgcctaccctctctggtttcaagtttctcatctataaagcagggattgtaatagtcccaacttcttagggctgtcataaaagttagataaaagaatggatatgaaacatagaaaaatggctgacgtggagtaagacttcaataaagaataagcattattccactgcactccagcctgggcgacagagtgagactccatctcaaaaagaaaataagcattattatcgaaaaatatcctttagagactgaaggatgtgaagaattgcattgctgattttagtttctagaataagaatgtcatccagtgtaagagaaaaagggtgatcaattcaatgtggttcatagatatcattctctaagatggcatgaattgatagttcaccgtctttggggtaaacccaacttttgtgaatttctaaaatccaagagacaaccacctcagctgcaaaggatctcatccagcttaggaggtcagtagcagctgataggacaggttccattttcacttcctcttagacatcttgcctgtctctgccaaccttctgctatctgtcccagacttttacttaaagataaaaagagaatgcttataattcattacagttcattaaaatgaaaataaaatttattttgcatcaaaatgaaaaaaagactcatttattattagcatataaatggcatttttaaatgtcactctgcctcaaaatcacttacattttcagtgatcatagcacacaaaattaatttttgatagccttttgtgatttggctggaaattcttatttctttttgtgctttaaacagcaaactgtatccactgctattcatagcaaattttagataatgaagcaattaaaaatacatggatttaagatcttatctcatttttcctttggcctatttctgcttcattattcatgaagggatatgtttaattcagagttagtaattgcagatatatctagtataaattgtgcctcatattctttacccatttcaatttattttagcaaatagatctctgtttgaaaaaaaagtcattgagagagggtgagtatgacaaaaatgcagaaatctgcgtgtatgtgtatattgattgacatatccaaaccagatctcaaaaatgttaataaccacatttcctgaggttttaccaagagccaggcactgtgctgaacaattttacacagcatttcactcaatcctaagagtaactttaggagggctgtatagttagtgctcccattttttagatacggagactgaggctcaggtcaaaaaagtggcctgaagtcacatcattagaaatgacaaagaaccagaattggaacttggcttgtctgtctccacagcctctgtattagaccattcatctcctgtgttctagaacaaagtgtattaaagcctcaaagagatttgtcaaaggctgctaaaatcgtcctgcagttccacctaacagcatccaaagttcataaagttgctggtctgaggagctgtgacttatttggtttccatgagctctaaatatattttaggaatttatcctagagaaataacaggtacacatggtttctttttttttctttcttttttttaagttctagggtacacgtgcacaacatgcaagtttgtttcataggtatacatgtgccatgttggtttggggcaaccatcacctcgtcatttacattaggtatttctcctaatgctatccctcccccagttccccacaccccaataggccccagtgtgtgatgttcccctcactgtgtccatgtgttctcattgttcaactcccacttatgagtgagaacatgtggtgtttggttttctgtccttgtgatattttgctgagaatgatggtttccagcttcatccatgtccctactaaggacatgaactcatccttttttatggctgcatggtatttcatggtgtatatgtgccacattttctttttttattttttttttattattttgttttattattatacttcaagttttagggtacatgtgcacaacgtgcaggtttgttacatatgtatacatgtgccatgttggtgtgctgcacccattaacgcgtcattagcattaggtatatctcctaatgctatccctcccccctcccccaccccacaacagtccccagtgtgtgatgttccccttcctgtgtccatgcgttctcattgttcaattcccacttaggagtgagaacatgcaatgtttggttttttgtccttgcgatagtttgctgagaatgatggtttccagtttcatccatgtccctacaaaggacatgaactcatcattttttatggctgcatagtattccatggtgtatatgtgccacattttcttaatccagtctatcattgatagatgtttgggttggttccaagtctttgctattgtgaacagtgccacaataaacatatgtgtgcatgtgtctttatagtagaatgatttataatcctttgggtatatacccagtaatgggattgctgggtcaaatggttatttctagttttagatcattgaggcatcaccacactgtcttccacaatggttgaactaatttacactcccaccaacagtgtaaaagcgttcctatttctccacatcctctccagaatctgttgtttcctgactttttaatgatcaccattctaaatggcatgagatgctatctcattgtggttttgatttgcatttctctgatgaccagtgatgatgagaattttttcatatgtctgttggctgcataaatgtcatcttttgagaagggcctgttcatatcctttgcccattttttgatggggttgtttttttcttgtaaatttgtttaaattcttcgtagattctggatattagccctttgtcagatggatagattgcaaaaattgtctcccattctgtaggttgcctgttcactctgatgatagtgtcttttgctgtgcagaagctctttagttaaattagatcccatttgtctattttggcttttgttgccattgcttttggtgttttagtcatgaagtctttgcccatgcctatgtcctggatggtatcgcctaggttttcttctaggatttttatggttttcggtcttccatttaagtctttaatccatcttgaattaatttttgcgtaaggtataaggaagggatccagtttcagctttctacatacggctaaccagttttcccagcaccatttattaaataggtaatcctttccccatttcttgtttttgtcagatttgtcaaagatcagatggttgtaggtgtgtggtgttatttgaggcctctgttctattccatatgtctatatatctgttttggtaccagtaccatgctgttttgtttactgtagccttgtagtatagtttgaagtcaggtagcatgatgcctccagctttgttctttttgcttaggattgtcttggctatgtgggctcttttttggttccatatgaaatttaaagcagtttttttccaattctgtgaagaaagtcagtggtagcttgaggggaatagcattgaatctataaattaccttaggcagtatggccattttcatgatattggttctacctatccatgagcatggaatgttttccatttgtttgtgtcctctcttatttccttgagcagtggtttgtagttcttcttgaagaggtccttcacatcccttgtaagttggattcctaggtattttattctctttatagcaattgtgaatggcagttcactcatgatttggctctctgtctgttattggtgtataggaatgcttgtgatttttgcacattgattttgtatcttgagactttgctgaagtcgcttatcagcttaaggagattttgggctgagacaatgggttttctaagtatataatcatgtcatctgcaaacagagacaatttgacttcctcttttcctaactgaatatcctttatttctttctcttgcctgattgccctggccagaacttccaatgctatgttgaataggagtgtcaagagagggcatccttgtcttgtgccagttttcaaagggaatgcttccagttttttcccattcattatgatactggctgtgggtttgtcataaatagttcttattattttgagatacattccatcaatacctagtttattgagagtttttagcatgaaaggctgttgaattttgttgaaggccttttctgctctattgagataatcatgtggcttttgtctttcattctgtttatgtgatggattacgtttatcgatttgtgtatattgaacaagccttgcatcccagggatgaagctgagttgatcatggtggataagctttttgatgtgctgctggattcagtttgccagtattttattgaggattttcgcatcgatattcatcagggatattggcctaaaatcctctttttttgttttgtctctgccaggctttggtatcacgatgatgctggcctcataaaatgagttagggaggattccctctttttccattgattggaatagtttcagacagaatgataccagctcttctttgtacctctggtagaatttggctgtgaatccatctggtcctggactttttttgggtggtaggctattaattattgcctccatttcagaacctgttattggtctattcagagatacaacttcttcctggtttagtcttgggagggtgtgtgtgtccaggaatttatccatttcctctagattttctagtttaataacatagaggtgtttatagaattctctgatggtagtttgtatttctgtgggatcggtggtgatacctcatttatcattttttattgcatctatttgattcttctctcttttcttctttattagtcttgctagtggtctgttttgttgaacttttcaaaaaaccatctcctggattcattgatttttttgaagagttttttatgtttctgtctccttcagttctgctctcatcttagttatttcttgtcttctgctagcttttgaatttgtttggtcttgcttctctagttcttttaattgtgatgttagcatgtcaattttagatctttcctgctttcttttatgggcatttagtgctatgaatgtccctctacacactgctttaaatgtgtcccagaggttctggtagtttgtgtctttgttctcattggtttcaaagaacatctttatttctgccttcattttgttatatacccagtagtcattaaggatcaggttgttcagtttccatgtagttgtgcagttttgagtgaatttcttaatcctgagttctaatgtgattgcactgtggtctgagagacagtttgttgtgatttttagtgttttacatttgctgaggagtgttttaattccaattatgtggtcaattttagaataagtgtgttgtggtgctgagaagaatgtatattctattgatttggggtggagagttctgtggatgtctattatgtccacttggtctggagctgaattcaagtcctggatatccttgttaattttctgtcttgttgatctgtctaatattgacagtggggtgtttaagtctcctgttattagtgtgtgggagtctaagtctctttgtaggtctctaagaacttactttatgaatctgggtgttcctgtattgagtgcgtatatatttaggatagttagctcttcttgctgaattgatccctttaccattatgtaatggccttctttatctcttttgatctttgttggtttaaagtctgttttatcagagaccaggattgcaacccctgcttctttttttgctttccatttgcttggtagatcttcctccatccctttattttgagcctaggtttgtcttttcacgtgaaatggatctcctgaatacagcacactgataggtcttgactctttatccaatttgccagtctgtgttttttcattggggtatttagctcgtttacatataaggttaatattgttatgtatgaatttgatcctgtcattatgatgctagctggttattttgcccgttaatttatgcagattcttcatagtgtcaattgtctttacaatttggcatgttttcacagtggctcatactggttgttcttttccatatttagtccttccctcaggagctcttgtgagtcaggcctgctggtgacaaaatctctcagcatttgcttgtctgtacaggattttatttctcctccacttataaagcttagtttggctggatatgaaattctgggttgaaaattctttaagaatgttgaatattggcccccactctcttctggcttgtagggtttctgcagagagatctgctgttagtctgatgggcttccctttgcgggtaacccaacctttctctctggctgaacttaacactttttccttcttttcaaccttggcgaatctgacaattatgtgtcttggggttgctcttcttgaggagtattttgtggtgttctttgtatttcctgaatttcattgttggcctgccttgctaggttggggaagttctcctggataatatcctaaagaatgttttccaacttgattccattctccctgtcactttcaggtacgccagtcaaacgtagatttggtcttttcacatagccccgtatttcttagaggctttgttcatttcttttcattcttttttctctaatcttgtcttcttactttatttcattaatttgatcttcaatcacttgtatcctgtcttctacttgatggaatcagctactgaagctcgtgtatgctccccgaagttctcgtgctgtggttttcagctccatcaggtcatttaagctcttctctatactggttattctagttagccatacgtctaaccttttttcaaggtttttagcttccttgcgatgggttagaacatgctcctttatctcggagaagtttgttattattgaccttctgaagcctacttctgtcaactcgtcaaactcattctccatccagttttgatcccttgctggcaagaagtagtgttctttggaggagaagaggtgttctggcttttggaattttcagcctttctgctctggtttctccccatctttgtggttttatctacctttggtttttgatgttggtgacctatggatggggttttggtgtggatgtccttttgttgatgttgatgctattcctttctgtttgttagttttccttctaacagtcaggcccctcagctacaggtctgttggagtttgcttgaggtccactccagaccgtgtttgcctaggtatcaccagcggaggctgcagaacagcaaatctttttgcctgatccttcctctggaagcttcatcccagaggggcacctgcctgtatgaggtgtctgtcagcccctactgggaggtgtctcccagacaggctacacgggggtcagggacccacttgaggaggcaatctgtccgttattggagcttgaacaccatgctgtgagaaccactgctctcttcagaactgtcaagcagggactttttccatgtggtatcttttaatacaagttgtcacagggttttatacaccagtaaaaaagcaggaaagaggaaagaaaaaaggaaatggctcaacaatgttcaattatatgttaaataaatcctgatgcatttatttagtattatactgtaacaccatcaaaaatgagttgtgaggccaaggcaggtggatagcttgagtccaggagttcaagaccagcctgggaaacatagtgagaccccatctctacaagaataaacaaaactagctggacattgttgcacgtgcctgtagtgccagctacttgggaggctgaggagggaggattatttgagcctgggaggtcgaggctgcaatgagctaggatggcaccactgcactccagcctcggcgatagagtgagatccagtctcaaaaagagaatcttagtttactgacatgtaaaaaatgtgtctgcaggttataaaagtggcaggtccataaaacaatatatgtaatgtatcccttttctaaaaaaaaaaaactacatatgtgtatatatatgtgtaaatgaggaaagagagaagccaggacatctcagcttttctgagattttgcacaacaaaaacataacacaagccacatatgtaatttaaaattttcttttttatttattattattatttcttttttattttattattttttctcccccacttgtaaatagcattattgctttactgatgatcagctttgttttataaaaaactcagaaaattcagtaaagtatgcacaagaaaggaaaaatgtcataactacaccagccaaagatcagtcccctgtatctaacagtgtgtgtgaatcttgctagacctgccctgtgctatttggtggtcatgagccacgtgactcctgagcactggaagtgtggctggtccaaactgagacgtgctgtaagtgtcaaagacatgctggattccagagatttagaaccaaagaagatagtacaatatctcattaataatttttctattggttacaggttgaaatgctaatatttgaagtatttaaaaataaaatatgctactaaaattaattttacctgttttttcactttttattatagctattagaaaattttaaatttctcatgcctgtaatcccagcacttggggaggccgaggcaggcagatcacctgaggtcaggagtttgagaccagcctgatgaacatggggaaacgccacctctaataaaaatacaaaaattaaccgggcatggtggtgcgtgcctgtaatcccagctactcaggaggctgaggaagcattgtttgaacccaggaggcagaggttgcaatgagccaagattgcgccactgcactgcaccctgggcgaaagagtgaaactccgtctcaaaaaaaattaatattttgatacagccatgcaatgtgaaataatcaaatcatggagaatggagtatccatcccctgaagcatttgtcctttgtgttagaaacaatccaattaagctcctttagttatttaaaaatgtacaattaagttattgactatagtcaccctgtgtggtatcaaatagtaggtcttatttattcttttttttttttggagacagtctcgctctgtcacccaggctggggtgtagtggcatgatctgggctcactgtagcctctgcctcctgagttcaagcgattcttgtgcttcagcctcccaagtagctgggatttcaggcatgcaccaccacgtttggctaattttttatatttttagtagagatggggtttcgccatgttgtccaggctggtctcaaactcctgagctcaggcaatctgcccgccgtggcctcctgaaatgctaggattataggcacgaaccaccatgcctggccttatttatttctaggtatttctttgttctcattaacattctccctgtcaccccactattctttccagcctctgttaaccatccttctactctctatctccataagttcattgtttttatttttagatcccacaaataaatgagaacatgcagtttgtctttctgtgcctggcttatttcacttaacataatgacctccagttccatctatgttgttgcaaatgacaggacctcattctttttcatggctgaatagtactccaaatggaaagtctctttagtgatcttctgactcagtcaataaaatgcatcaatattccactgggtatgcatgcctctattctagattctggaggtactggagaaaacaaaacaggcaaaactgccaccctcatggagcatgagttctggtaggagagacagaaaaaaaatgcaagaaaatacgcaatatttcacgtgttgatgagagctatggagacaaaggagaagggagaagaccaaggtgttctaatgaaggatgatcaggaaggctcgtgttataaggtgacattgtgcagagacgtgggggaaatgagtgaatgtgtcttgaggctgagagacagccgtctggcaagtccacaggcccctaagcagaaacaagcttggcgtgatggaggaatcacaaggggctgtaatggctggagcagagcttatcctcccagttgaggaggtaggaagtagaggttgagattttggagtcgagcagacctgagatatctaatatacaattttaaggcactggtgttgctgtgatagaacctttctgggtcaccccaaagtactgacaatgacaaatatattgggcaggcggtgtggggaatgtcagagaaagaggctgagtttttctctgggtccatgcagtgcagagagaagagaataaatgtgagacagagagaaacgggagcaggaacttggaggtagaaataatcaaaagaaacaggaaccctgaggaatctgcaaaagtcttggcaagatgttcaactcataggatgtgggatataagctcaggccaaatttatttaaaatgcaaaggaagaggtgaccacagcttacctctgggccaagcttatttagtataccaaatatttgaagaatcatttcttcttaatttggtttgttcttagtagatgctcccactggtttaaacctgaatttcaagctgttgtgttttttttaaacctacactaaataatacacgggtgggtgaaaagcagaaggaggctttgtgaatgagcttttttaaatagtgagattccttggcatgcataaaatgttatttgggatagaagaaagcttgatttatgaaaatcttccctaggccacgtagtgcagaatcaggggactctggcatcgccgcccggcatgcaaataaacgtttccagcagttctttagagtatgcatttcttgtttttttggctgcagaaagtatggtgtccaaaaattaggtagggtttgctttgcattccagttgtccgtgttgccagaaaacaatgccatctggatgtcattccttcacctagagtaaggcgctgtcaccatgcgtaagcattataacataatctctgggttacagtcctggctggtcactgactagcttggaaagtttaccacaaatcctctgagtctcacttctccctactgtaaaggcaggataattattaatttgagaacacgtttggttgtactgaggatccaataagagaatatttggcagaaaaatctggccaatggtaaatggtattcagtaaataaacacattttggtcgtcagcagagagctacctggattttattttatttccttccttttttttttatcgtagagaaaaatgacagggattcactttctaagaaattacactatgttcaatgacttcccatcaagagtaggcaatgttccgtatcctgccattggtaagtatcaaatgggcccgtgtcagacaagtcatggcttttaatctccctttattggccacgtcacctgtcagtgaccttgactgttgccggctgcctcatgttctgcagtttcctgataagtgtgtttccggcttttgaagttatgtctgccgaaaaccacatctggttcaccgccgcctcaacagacacacaatgaaatacaaaaggctaattctgctgtgtacgcaatccatgtttctttccccagaggattccagatggagtgaactcagtagaggcggtgcttcgacggctgatgatcttgcggagaggagagaggagcattagttacggttttaagtcccggctgaactggcaggggttacatgacctcagactcaggggtaagtgcgcaagctctcgcccctggaagggctgtgatgcctttcaacagccacacctctccgttgaacccatcaacaccctttgtgcagaggtgggttgagatttctcagatgaagtaacatttcctactctagtagtctcaattggtaaatataattgtttttttttttttttttttgagacggagtcttgctctgtcgcccaggctggagtgcagtggcgcgatctcggctcactgcaagctccgcctcccgggttcacgccattctcctgcctcagcctcccgagtagctgggactacaggcgcccgcaaccacgccaggctaatttttttggtattttttagtagagacggggtttcaccgtgttagccaggatggtctcaatctcctgacctcgtgatccgcccgcctcggcctcccaaagtgctgggattacaggcgtgagccaccgcgtccggccggtaaatataactttaatgtggacatcagaaggaattctggtattacgagtggtgggagaagcattttatactttattagggtatgaataacaacatctttatttacttttaacttttattttaggtttaggggtacatgtgcaggtttgttataaaggttaaattgcatgtcattggggtttggtgtccagattatttcatcactcttgtaatgagcacagtacccaataagtagttttttgatgctcaccctcctccttccctccctgctcaagtaggccctggtgcctgctgttcccttctttgtgtccatatatactcaatgtttagctcccacttataagtgagaacatgcgacattagattttctgttcctgagttagttcacttaggataatagcctccggcttcctccatgttgctgcaaaggacataatctaattcttttttatggctgtgtagtattccaggctgtataattaccacattttctttatccagtctaccgttgatgggcatttaggtggattccatgtctttgctattgtgaatagtgccgtgatggacatacatgtgcatgtgtctttatggcagaacaatgtatattcctttgggtatatgcccagtaatgtgatcgacaacatatttatttaaaaattgagcacttatttaaaaaatcttaagtgctttcttcattggctgtgaaagctctgagttttctgtgaatgtcattaggtccattgtacacatgtgaaaagtaaagcaacacacccaaagatggtcagtcctttgaacttgggttgtttgatgtttgtgactattacatagatgccatttatattgagtatatgtctagcagctttattgctgggtcacaggctggacgtatgtttagttgctggagattgccaactcattttccaaagctgttatacccatttgtatcaattttttccaagcagcacagccaaatttgaagctggatctggctgattccagctctaacttttttttttttttttttttttttggagagagggtctcactctgccacccaggtgggagtacagtggcacaatcacaactcactgcagctttgatctccctgggctcaagtgatcctcctaccccagcctcccaagaagctggtactgtaggcatactccaccatgcccagctaatacttgtattttttatagagaagggatttcatcatgctgcacaggctggtctcgaactcctaggctcaagcaacatgccgaagtgctgggactacaggtgtgagccaccacgcctggcccctaatatatatgtgtgtgtattttatatacgtatatataatgtattacacatatttttacattatatatattttacatatatattttatgtattatatattttacatatatattagaaacatttacacatatatatttacatgtatattttacatgtatatgtttatatattttttatgtatttattttacatatattttaagatatataaaattcatagcaggcaaaaacagcttctaatattttgaaccattgtactatatcctacgaaagtactaagtataaataagagagacttcccggagaaccattgctcctggccagtagagggtttggtttttggaggtggttttgttttgtaaacgtctttgttaatatggaacattcagacaagtgcataaatcttaagtgagcagctcagtgaatttttgcaaagtgattattaccatgcagctaccacctgaccaggatataaagcatttctagcaccactgacagccttcctccaactttgttcttattccaaattatctttactctagtgacccttcacaattccacatgccatttagcatgatgcggtcattttccacaacaaaaaaatcctgctgggattttgattgagattgcattgaattgattgattaatctgaagattttgttagattggttctttcttccctaagtattcaaaataattcactggtaaaaacacgtaggcctggggtggttgtgtgtgtgtgtgtggtgtggagggactgagagaagggatgaattataattacagatttaatttctttttttaatttgtaatttttgtgggtcaatagtatgcatatgtattttggggtatacgagatattttgatacaggcatatgatgtgtgataatcatgtcagggtaaagggagtgtccatcacctcaagtatttatcctgtctttgtgttacaaacaatccagttatactcttttagttattttaaaatgtacaatgaattattgactgtagtcatcccgatgtgctatcaaatacagatcttattctgttgaactctgtacccattaactatccccccagccactagcctctgataaccacggtccaactctctatctccacaagttcaattgtttttctttttagctcccacaaatgagtgagaacatgggaagcttgtctttctgtgcctggcttatttcaatgaacagaatgacctccagtttcatccgtgttgttgcaaatgacaggatctcattctcttttatggaggaatagtactccattgtgtatgtgtaccaaattttctttatccattcctctgttggcgggcacttagattcttctagatcgtggctactgtgacaagtgctgcagtaaacacgggagtgcaggtatttctttgatacactgatttcctttctcttgggtatatatctaacagtgagattcctagatcatagggtagttcaatttttagtttttttgaggaacaccctagatttaatttattagctattggagtattcggattttctgtttcttatgtcagttttgctaggtcatttttagggaaaaacttccattttatctaaatcttccaatctattgacttaaagctgttctacaacgcatcaaggaattattttatgtgatagatacgttctatgtgttgattgtggtcatatttacatgggggtatacatttgtcaagtcttattcaactgtgcacttaaaatgggtacattatatgtatttacattatatgtaaattatagctcagtgtggttcaataaaaatttacaattgataccattttatttttacctgtacttatgaaaaaagttaaaaagtttaatcatatcaagtgttggcagtaagataggctacactgcaagagagggtatacattgccacaaccacctggaagaacaatttggaaatactatttatttatagattgattgatggagtctcactctgtcacccaggctggagtgtagtggtgcagtctaggctcactgcaacctctgcctcctttgttcaagtgattctcctgcttcagtctcccaagtagctggaattacaggcatgctccaccatacccagctaatttttctatctttagtagagatggggtttcaccatgttggccagaatggtctcgaactcctgacctcaagtgatccaccccccactggcctcccaaagtgttgggattacaggcgtgagccaccacacccagcctggaaattcttttaaaatgggaaatgattatatgctatcacctacagggacacattttagggagatcctcacacatgtgctcaaagagatgatgcaacatttattgcagttctgtttgtaagagaaaaaaaaattaaaaatgtaaccatcactcagaggtgaatggtggtaaacatacatggtaaaatagctcttaaatatagcaaattaaaattacatgtttgcaacttggacaaatccctcaaaggagtgagaaaaaaattacaaaggaactacagttgatgccatttatatataaatttttaaaagcactattcttcccccggtgtcataaaaattttagctgagtatgtggaaatccagaataaagatttccttgcagctaggtgtgcccatgtttaagctatgttcaacaggatgtgaggtgtgttcagcaattctggaaaccttccctaagtgacagctgaggaaaaccttttaactctgtcacttccttctcctacctgtctttcccccttttttctttctgtgtttgtttcccagggctactgtaagcagacaggaggagtctccagggattgtaggaatttaatccatttgagcaatcaggctgttttacagcttcctgccctgcagcctgttcttccccagccctgggtagaaagaggtcatcttgtcagtttaaaccagctcctgacaagtgatgaacccaagtgaacgttccttattaccatgctcaagtctctaccctgggaaaagctatagcttccttaccataacatgcaaactatgtgctggcatgatgacttactgtgtctgtacatctacgtgggatgacgtgtaccctctctcctctctatcaccccataaaaccctcgtcactttccctctgagagacactgctttggagaatcctcccagtgtcgtccttacttgagccaagtaataaaactcccattgatcaaaacctgcttccttgtggagagtcatttgttacttgtcaggggaatgaaccccggtgtttttcgggtaacgctactgtagcaaagagctgtaaactaggtggctttaaacaacagaaatttattctctgacagctctggaggctttagaagtctgaagtcagtgctctctgggggctctagagaagaatggattatgtgccttgctcccacctccttgtgttgctggtgatctttggccctccctggctacagatacatccactatctgcccctgtcttcagattgcatcctctcacatgtgtccgattctgggtctctcctcttcttataaggacacccgtcacactggatcaggacccaccctaaaccagtatcttaacttgatcacacctgcaaagaccttattttcaagtaaggccacatttgaaaatcagggggggtggggttaggactttaacatattttttgtgggaacacagttcaacccacaccatcttcctatcctcctcctatttctttaatccttctaaacctttctgtgggttgggatgtgaatgtgatagcaggagctataacagctgtattggaccatgaggtaaattcagaaatagactccaggaatggaggacctaaaaaatcaaagacagttgggttcctaacataataatgaggccacatcaggtatagactacctatgaagactctcatatgcaaaataaataaatatttatcttttaaacctctcttctctttgtgttggggttttttcacttgcagtcaaatctaatcttaatacacacacacacatgcacacacacacacacacacatttgctcatatgatttgttggactctaagtgtgaacatactaaacttatgaagcgtggctatctctgaggaagagagagtagaatgagaaatgatggtcagagggaacttcaacttcctctgacaccttttatttctttaagtaaaagaagacaaatatactaaaagtttagtattaatagctttgaattatagatggtggaaatctttgataacattaatatttgaattttgaattttaaaaatttgtccttccagaatctcctcaaatattaagaggactctatttgcaccttttactccaagtcgcatgaatcagtgtgaaattcctggaatgtactggctattttttttcttttttttgagagagtctcactctgtcacccagggtggagtgcagtggcgtgatctcagttcactgcaacctccacctcctgcctcaagtggttctcctgcctcagcctcctgaataactgcaattacaggtgtgcaccaccatgtccacctaatttttatatttttagtagagatggggtttcactatgttggccaggctggtcttgaatttctgacctcaggtgatctgcctacttcagcctcccaaagtgctgggattacaggcatgagccaccatgcttggcccctgcactggctatttttgaccctctctggacatactacctgccccagttggactgtcctccttttcctcacctgggcatctcctaagcatcctccagtctcagctccaagttaatgacaggtgatgagacatctaagtaaacatttggaaaatcagcgaaaattaatttccatcagattccataataaaagcccaatagatggttctttttcataattgcctaaattacaaaagtaacacttgctcaccataagaaatgcaaagaccaggataataaaacttgataagagcaaaaattgaaatctgccttttatcatctccattgtatcccaggcacaactaatctgtataaaggtttaaatatcttaaaactaaactgtagagcactaggataaaattggggactattttaaaaatccaatggtaggaatgaatatttcttacatggaactgaaggtggaaactttaaccagattcttctgtaattaaaacagttttaaaaatcttacataaatgaaaaactaggaaaatatctgcaacatatacaatggaccagaattacaatatccttaatatgtaaagggatatttcaaattcatacagaaagaaaaaacaggtattttattttattttattttattttatttgcgactgagtcgtgctctgttgtccaggctggagtgcagtggcgtgatctccactcactgcaacctctgcctcctgggttcaagcaattctcgtgcctcagtctcccaagtagctgggattataggcacctgccagcacgccaggttaatttttgtattttttctagaaacaggtttcaccatgttgaccaggctggtctcaaactcctgacctcaagtgatctacccaccttggcctcccaaagtgctgggattacaggtgtgagccactgtgcccagccacaacaggcaattttggagagcaaaaactaagtgtaactggtacataaaaataaataatatctgttgatggggagaatgtaggggaatttgcacattcatataattctggtggaattgaaaaatcaacaaaactttctaggagaaaatgtggccctatgtatcaaaagcctttaaaaagatacagtatccccctttattaatggtttggatgtctggggtttaagttacatatagacagtccaataaaatattttgagagagagagagagatcacattcacataacttttattgctgtatattgtcataatgttttattttttgctaatcttttattgtgcctaatttataaaataaattttatcataggtgtgtatagataggaaaaaaacatagtatgtatagggcttggtaccatccttacttccagccatcccatgggggtattggaaagtatacactccaccaccgccctgtggaaaagggagtctactatgcatgattttgactcagtgatttcactaggaatcccttaagagaaaataaagaggactatgggtgagctaccaatctattcgtctcaatggtgcatatagtagcaaagaaaattgtaaacaacctgtttataatcttcattaaacaaatgatggcatatttgttcaatagaatagtatgaaggttattaaagtgacttaatttcttcagaagatgtttgcaatgtattaagtgaaaaattaaaaattatataaatccatctttttaaaaaggtgtccgtacatgtatatcatacagaacactggaagaattatatatcaatgtgtgcaaggggggatgtttcagaggggtgggactatgggtaattttcatttcctttttgtttgttttgttttgttttgttttttgaggcagagtttcgctcttgttgcccagcgccatggcacgatggctcactgcaacttccgtctcccgagttcaagcgattctcctgcctcagcctcccaagtagctgggattacaggcatgtaccaccacacctggctaatttttgtatttctagtagagacggggttttaccatgttggccaggctggtctcgaactcctgacctcaagtaatccatctgtctttgccttccaaagtgctgggattacaggcatgagccactgtacccagcctcatgttctttttatttatcaatatgtttacaatgaggaaaatgtttaaaaaggtcccagttgaagcatctcatcctttgggaagccttcctgccctccagtccttataaatacccttcctgtgtgtgttcactgtgtgtatctcacaagactagcaagctgacctcttcagtgttaatttccttgttctgttcattgttcatcactagagtataacttccttgaggaaaagagacatgtcttgccttgtcactgcattctcaatttgtagtttgaagaatgtttgttgaatgatgaattgaaaatgtccttttatttggtcttttaagtaactatctgctagcatcccactgtttaataatttataaaattggaaatcacaaatttctaatgggagtgagtaattgcttcaaactctggttttgccaatggagaaacagaggctggggagaaacgaagtgacaaccggtgttgtgtggtgggctaggggcaggctaggaccacacctgctctcacggtttttctcctgaggctttcacagaccagactgcttagcaggcctcctgatttgcttttgttatatggggaaatctgacacacagagaatcgtgagggggatgaatgtttctagttagggcaggagggggcagtgagaaagggagaaatctggctgcccatgagaaacaaggtttaaaactagattttatgatattccacctgtctccatgctctgaaattgtgtgcgtgtgtgcgcgcgcacatgtttacttcatggggaagaaagtgcaagaaaactttatctcgggcagcctggcaaattcaacctctaagacagccaccctcagaaatctgctcaagctgttcctttctttcctcaaatgtcccctgatggtctccccacctctcaaatttgctgggtcattgcatctgtttctacctggctgcatctgagtagtcgcagtgtcagtaagtgaatttgggcttccagctgcgggcctcagcaagtttatctctgaaaatggacctgtcttcacacttaatcgtgtctctgtgtcccccatctctgagcaaacagctggaaagtgagttgagtcaaccagtagttggtctgcatggggctttctggatgacacatattttgatatttaatcctcaaaacgttttgatatttaatcctcaaaaccattctgtgaggaagagctgtcatccccattttgtagatgagaatactgagtcccagggagagaaggttaccttccctgggttatacagccgcaagtgggtgaggctggctgagaaagctgagggtttgggtatgaggaagttaaatttgctttcccccttctggcaggtagcatttgcaagggccgtgtgtttaaaaacaaaaaatgactttagtattcataatacttaggaacacgtaataaacactgaacctggttctctaccttagacttcataatttgaggagaagaaattcaatgtagtcatttttaagagatccttgtcccttcttgaggttatacaagtatcttaggacttgtgagtttttgggaaaaataaagcccagatgggtcctgtgttttctgtgggtgttgttattatttatttttatttattttattatactttaagttctagggtacatgtgcacaacgtgcaggtttgttacatatgtatacatgtgccgtgttggtttgctgcacccattaactcgtcatttacattaggtatttctcctaatgctatccctcccccatgcccccaccccacgacaggcccctattattattatttttgagatggggtctcgctcttgtcagccaggctggagtgcagaggcgcattcttggctcactgcaacctctgtcccctgagctcaagagatcctccctcctcagcatcctaagtagctgagaccccagatgtgtgccaccacgccttgctacgttattttatttatttatttttgttagagacagggttttaccatgttgcccaggctgatcacgaactcctgagctcaagcaatctgtctgcctctgcctcccaaagtgaggggattacaggtgttagccaccgtgcccggccctgtgggtatcattattgaaggtgcttttgttttctgttctggatggctcagaggtgtctcttgaagtgtcatctccgtggaccacagattcagccataggtatccacaccgatgctctagtatcatacacacactgcacaggcctgcagcagtcattgttgccattgacaaatatttgttaccaaggtttccaccccttgcagaatacccacgctagtcttgcggatgtatcatcctaggagtgggtcagttctgtattcagactccagagccgagccccctgtggcagagtaggagtgcccaaacctgcaagatcctacagccgtgcttgccatcttgagatgtagataacatttttatcattctctttaaactatttttcttattttgttgaggtatagcttatatacactaaaatgcacaaatcctaagtatacggatcaatggatttgtatacaggtatatgccttaggtaaccaccatccagatctagtcacagaacattttcattaccttagaaaaatccctcatgacctattaaagttaccccactgttggatgtaaccactgtctgatctcaatcactgtagcttagctttcctgtttttgccattcatataaatggcatgatccagaaggtactcttttgtttctagcttcttttgcccaaaatatttttgaaaatcatccatgttatttggttttaccacatttcattctatttgtattaatgtttcgtattacattgtatttgcatacagcaattatctcttttcctttttatagacctttgcattgtttccagtttgggactagtaagaataaagtttctatgagcattcttgtacaaatgtttttgtgggcatccatgagatggtttggctgtgtccccactcaaatttcatctcaaattgtaatccgcatatttcaggggagggacttagtgggagggaggtgattggatcacaggggtggtttcccccatgctgttctagtgatagtgagttctcgcaagatctgatggtgatgtaagtgacgatttcccctgctctctctctcctgcagccttgttaaggatgtgcatgcttctcctttgccttccaccgtgattgtaagtttcctgaggccttcccagcaatgcagaaccgtaagtcaattaaacctctttcctttatacgttatccagtctctgggaagttctttatggcaatgtgaaaaatggcctaatataatacatacttgtttctcttgggtataactctaagattgaaactggggtcttatttaattttattgggaactggcaaattgtgttccagagtaattgagttactctgtattttatattcccattagcattgtgtgggagttccagtcactctacatccttgccaatacgtctattattcttttttattccatcccagtctacaggaaaactggatgcttattttctccatcagagttttccgccatgttgtactttctgccatattgtatatatgttgctgttcctactggggacatatacaccaaagtttaagatcatggtttttcattttcaccctggatttctccgaactgccatccagctttccttctcccctaccttaaatcttacttactttaattctgtttggaaaagtggaaagtaatatagatcaagtagctatctcctattatattcaaagtaaaatgtatattagagaagtaggtataagaaaatcttcatttagggccaggcacagtggctcatgcctgtaatcccagcactttgggaggcagaggtgggtggatcacctgaggtcaggagttccagactggtctggccagcatggtgaaaccccgcctccactaaaaacacaaaaattatctgggtgtgatggtgcacgcccataatcccaggtacttgggaggctgatgcaggagaattgcttgaacccaggaggcagaggttgcagtgagcagagatcactccactgcactccagcttgggtgacaaagtgagactccatctcaaaaaaaaaaaaaaaaaaaagtcttcatctgggggcagtctagtgtaatggaaaattctagaattctggactcagatggccctgtcccttactgactgtgactttagacacatgatttaatagcatggaatttcagattcattgactataaaatacagagagtaaaaattcaatgacataaaggaggtaaaacagtatgctacagactaggtaattcttctcaagtacatttcaattttagtttgtatcagacaggatgtgctgtggttaccacacgcagcccccaaatctcagtggtttagcatgatggaaatttgttttttactcacattctatttctaaccctggttgttggagctctctcatcagtcacttaggaacctagtctaaaggagatgtcactttggctccaggttgcatgaataatagcattgagtgctagtgggggaagggggtatggtggtaaattcgggtgtccagtcagcaaatatgtgctgaggaacctattctgtgataaacattggaaagacagaaacaaacaaaaaatactgtacctgcttccaggagctcacagcataataacagcaataacaaggacaacagcaactgtagctgcagcagcgaaaagttactgatcacttatgaagcccagcactgtatcaagaacttattttatgatgcagatgttttcccaatcagaaaactcagataagggaaaacagaattttatttttctgtaactgaatttcattttactcttaagcacccacttccactgcaaaattgaattagagaaaatgtaatcacttctggtttaaaactcagtctcttgtggatactgctcagttgacccaactttctaccctttgcatttctctctgtctttcccactgtgtttaaagttcctggtgtgaggtgcaggctttagtattaaggcatgccagactttgggaagtatcatctgttgttacctgtccccacctagtgtagttatgtgtccctttgtttctaccactgctgattgatcgtggttctgtatctgttttggggtcaatacatccacatccctaatccccaaatgtgagaatgttttggtcctctggttctcacggccacttctgtgcccttcgtggaaacttaggtgcttccggctgctctctccacaccacactggcatgaggatctgcaaggctgccctcagtcttccccacccagaaaatccccatggccatttctactctgtggcttgggtaccatgtaggtcaaagaacttctctataaatcgtacagactcctgggaactgtagcagtggctcccctgctctgggatttccctaaacttatttatggcttctttcatcatccttaccctagaccatagttattctgtttatccaggatcaacgtatacaagtgtaatggttttaagtgaccttaaataaatgcccctgaaaagataggccaatcagtgttccagctgcagatggaaactaatcactactattttgtaatagggataataatggtgtaagttcaggactgaaatacaagcaaaggcctgaagccagaatcagtatgaattaggattctgtgtccattcatcatgaaggctgatcagttgttggctttgaacagaaggctcatgccttgattagagctgtcagtggtagggagtaaattaaaatgtgtttgtgctccactagtgtgtttgaattttaaatcactggaaatccctgtgtggcctaaactagaagttttctcatatgcaaagggatggagttggaacagatagttgatccctaagtacccttccagctatgaggtattctgtttcataataggatggtaaacaatcttaactcattcctttgtaacttaatttttctgcatcagggaagaatagcagccagtgcttggtatttaagcaaaacatacatttataattcatttatatgcagtcatatatattataaatgggaatccaaaggataccacccttaataagcaagtgagaatttatgaactcctttgcttccaacccactactattatttatcttatattaatggcctctctacccagtagactgctctaagtctattaactttcttttttaaaatggcatctttcagatttggtgcaagccattgggctgtaggctcatttgcaatttctccattttttatgaatacagtgatttatgtcacggggatgtaatggctcattttgggtctaattttgactcccacttggattcaaggcatctgagcatgtcttatgggctcaacaagcatctagttgaatgagttgattttcatgatgatgatagttgtaaggggcaattgagaaggtggtttataaatgaggccttggggagaatgacatagttataatgactgctggctttggggacagacattcttagtcccactttctatctctgtaatattgagggaggttaactagatttgaggggccttgtttatgtatctacaaaatgagcacaattataaccaagctcctatggtggtaattaagagttcaacatggtaatgtatgtaaagggacttagcaacttgccttgcacagagtaagtgttcaataaagcttagctgctattgtaatgtctaccccacacctggtcccatgaacttatttctgaacttttcatcacggaggactgtagggagaagccaacagagctgttttcacaagggaccatgtgaaatgttaaggtgggtccagaggtcctggaatttacatttaaagccaggagctaaaaaaatgagaattattactgttcctgacctcatttgtccctcgggctggtgaggcttagggtacatttatatttgctttcttatatctatacctttcttttagtcttggtgtttttcacattgacagagccacaaactaactagaaggctacatactcctcagtaagaatagctaacatttgcagcatgtactatatgtcaggcacaatcccatgtggttttacaggaatatctaatagaaccctcacaataatcttttgagggagatcattattgtataattgaaaaagcagaggcttagtgagatgaaacaatttttggtttgtatcagtcagtatgagctgtgttgtgctgtggtaacaagcagctcccaaatctcagtggtttggcataatggaaattcatttcttactcttactgtatttctaacactgactatttggagttttctcatcagtcactttggaacctaggctaaaggagacttcactttgataccacattgcacaaatgatagcactgagtgctaactggagtaaattcgggttttgagccatttattcaacaaatgtcatcaataaaagaaggagctggcattcaagtcttgcctgtctagaacactcaatcttaagcaacccattgtgaacataatcccatagccctcaaaggcctcaccttttcaccaactagttctgttccttttgtgattgatgatgcaatttcagtgttttaaatgttgtatttacattgattggggctgctgagatcattcacacaaatatgtctagccataaattccagagaaactgtgccatgcagttccaaattccttcacttctcccaccagtacaagggcttcataggagcaaagatttgcaaatgatgttcccatccaacacttaacacttcttatttttaatcgagacatcttctgctcaccacttttggcactctgcttgtgcagccttctctagtctccagacaacagctattttctctgttagccaattaccctccactgaaggttccagtatcctcatacctgcagaaaaaaattacctggaaagaatgcacttttctcagggcccagacggtgatggattgtaccatgatggtttttgttcacctacaccggtggattttcctttcctgctggaggaaaagatctcattctgcaaatgcactaatgatgtgtaattatcatcgctgcaagccttctacgcatctgggctaatggttccagcttccatgatgattctcatatgttacccaattccatatttgagtggttctgtcctgcccctggtaacagtaacagttggcttctagacaaacttaaatatcctggctttatatacctggctcatagcatgtgatgataatagcaatcaccacataagtttcaatcatatctttactcacagaagggagatactcttggttgaatatttaattcagttttgttaaaacttgaagtcttcttgaaacagcgctgcctgacagaaatatttaacgtcaggaattcatgagcaatgggaccccaaggtcaaaaaaggggaatgagtagtcaaatccagccttgcttgtcacagcagactggagcttcaggaattattaagcaggcagtgggaagaacaaaggggataatgttctttccattgaagtaatttttctcaatgcaaaatgctttttcggagtccatgtgggttaatttccacccattttgcatgtaggagacatgcatccaagtcctcagtctcagagttggaagaaatattttttctttattttccttatttctagtaaacttcaccccaaaccctcaaacagttaggttgcttaaaataaaaacaattttggtcaatactgaggcttccctacccctagagtttgtttattacagtagttattgaattgaatccttgagataggactttctgttgatgtgcatactacctgaaaccatgtgaccctcttcttctattttaacattggagcccaagacccttttgtggggttgctgtccccttaccctggggtcctgctttcagaggggtacttgatagcttctcctttgatatctaaatttcttgggtgctgctccttcataaaggccaaagttcccactgtttgcaagacactcacttcccaactgcaaccccctttccatttctaggggtggaaatcctgcctcttcctgctagttttcccttccttggtctgataaatccagttcatgtctttatcttgtgaatcctctgcaaattgctatggcaaaaatccctaagatctcttttgagatggaagaccaaacatacagcaaagaaaacacagattaataattcaaaaacatatctgccactggtaaaaaaaaaaaaaaaaaaaaaaattagaatcaaaccattaatttctccttacactttctcctgcagcagtgaatatactacaaagcttggtttctgtgataataggaataaggcttactgagctatattgcatttcctaattggatcattcttcaaccattttatctcatgggtatctaccctgccttttatggttggggtggttttcttttcctccccctcttagatcttaattttgcaaacaaggactgagaagtggcattaagatcagcctcattatcacattgcagtttggcaccttattcctctctccatctttattagcagagtctctgatttttttaagcttatttgcataatttctaacatcccgggtttattcagaaggccttttgatgaaggaatggagaaggtcttctctactccaaaggcctcttcattaggacacagtggaacacagcacctaagaacacagactccgcaggcaactgaaaagcctagatttgagttctacttagccgcttctgggctgcgtgacccttgggaagttgttcaacgtctttgaacctcagtttctccatgtgtagcaatagcagctacatctcatgaccaatctgaatcactccatggaaaatacaacagtgtcctgttcatgctattgggcgttgttatcattatccttttctctttattaatgtaaacattttactgaagaatgacgtacatacagaaaagtgcctgtgtcataagtataaagctcaaggggttttcagaaattgacacatctgagtcaccagcatccagatcaacaaacaaagcattggcaaaactcctaagagcactttcacagctctttcctgccactaaatccttccccgcaaggggtaaccactctcctgacttgtaacaattgcaggttagttttacctatttttgaactttatataaatggagtcaaacacgatgcactatttttgtctgatttccttttcctgatatttttcatgagattcattctctgttgtagtcagcagatataattcatttttaattgctgtatagtgttctattttgggaatatgtcacaatttttatccattctacttttggtggacatgtatgttgtttctgattttgggctatgaaatatagcaatgctatagtatatctaatgcatatattttggagaatttgtatatgtatacatttttataggcatatatttaagcatgaaattactgagtcacaagttatggatctgtttaactttagtagacactgtcagtgttcccaagtggttgtaaaatttacactccctccaacaatgaaaaataattccagttgatctacattctcaccaatgtttggtatcattgattttgttcattttaaacaacatggtgggtgtgtagtcatattgtgggttatccatcagatagctgatattttattttttcaacttttcatttggaaataatttcaaacttacaggcaagttgcgagattagtacaaaattgtatgctcttcacccatatacatcaactgttcatcattttccacatttgctttattttctctctgtaggcgtgcacatactgctttttaaaaatatgaggtaagtttcagatatcatgcctcatttaccactaaatgtttcagagtgtgtgtaccaagaactatctcttaaataaacacagtatagtaatcaaaatcagaaaaactcaccactcatacgatataattatgtaacctgtagatcttattaaaatttttccaaatattcctgtaatgtttttgtagcatttttttcatgctctggatttaatccaggatcatgcattacatttagttttcatgcctctgtagtcttctttaatatggaatgtttcctgtctcttgtcgtctttcaggatattcacatgttatgaagagcataagaattactgtaattttggcttattggatgtttcctgatgagattcaggttatacatttttggtgaattattatataagtgatagtgtgttcttctcagtacatgacgttggtttgttctgtcactattgttgttgactttaatcactttgtcaaagtaatatatgctaaacttcttcactataaaattactttcatccccttgtaattaataaataactttaggggatatactctgaggctgtgtaagtatactgtacttcatcaaactttcatgcacttatctcagcatctattgatgatacttgcctgaatcaattattactatgatggttgcaaataactttctaattccattgctcctccattaattagtttgcattctacagtaaggaagtgctttcccttccctccattaattaattaatcactcatcacaatagagaaataaagacattagactaagaagagcaacacagtgatatatgctagaatagtgggcatgacaaacgaaacagcacttgagatctgaaagacagctaaaaattaggctatcaaagaggaccagaaaaaagtgaggcaataggaaaagcacaagcaaaggctgtgagttcaaagacagcctgagaaaaattcaccatggttggggtgtagcaagtaaagggagacaagtgaaggttgaaagcctggaaggaaagcctgaggcaatcattaagattaactcctcattcatgacagtgggtttctctatttggaaagattttttttcactgtgtctgcctgcgtcaggcccacccatactcaaattcttatctatttcttttaactattgcttttaaacagaaaatccccaagtttagtggcttaaaacaatgatttattatgtcttgagcttttgtgggtcagcagtgggggcagggttcagcagggtggttcttccactccatgtgacattggctgaagtctcttacttggctgccttcttgattgcctggactgggtttggaagtccaagaaacttctctcacatttctggggacttggtgcctcttcacatgacctccctctttccatgtgatagttcatatgttagtagtcaagcccatgcatctttacagcatggtgggtcctcctaagagcaacagtgggagctgccaggactcataaaggttattactgacacaagtcacttgcattgcattctattgacaagttactgggccagcccagatttcactgggagaaaaaaatggatttcatcctttggcaaggagggaaggaatcttcagagacaatctatcatgccacctctttcaggaagtcttccctgacttctccaatctcattttctaccaatctatcaatcacagttattgttctgagcctttgttaggctcattttatatagtgctttgtggtatttccaaaatttttcaagtgtcaatattttagctttactgattcctgaagtagaacctcatttacttaagtgcagtaattaataaatttggataataataggctgtcatttatggaatgataaccatgcatctggcctatgcaagatactttaccttaattatctaattatatccgcttaagaagataaaactgtctttattttttaacagaaagaaaaccaagtcccagaaggaaaacaaattgcttaaggttgtctgacaaattaggggtagagtcaacattgaaaccgaggtctgtgcaattctaaaattgtgttgcaatcttcctacatataatcatttattgagcacaaactatgtgttagtctccttgcttagcactagggattcagaaatgtgtaaatgcccttagtctaacagagaaggaagatgtgtaaacaaacactgactactcagtgtttaaaggcacagcatgttaaatgctagagtggagttctgagactccagaccagggttcatcaaccctgccaggaaaggttggggaaggcttgaccatggcagggacatttgaattgcagcttgaaggataaataggaattcactaaggagaggaggaggggaggggaggggagattgatgggagatgaagttggagaattaggttccaattgtaaagaaagggaaggaaaggaaatcattgccattgagcatcccttgtaagcttgtcccattgaatcctaaaacctgctctgaaagtgctattctcatattcccgttctcatagataggaaagcgaagctaagagagatcaaatcatataccaaaggccgcattacatagtttggactttatcttataggtatcaggaagcgaacacactttcaaaaccagcgcatgacctgacctgacagagaaatgaacattgttgtcatatagagatgggaaagagtgggtagagggtagtagtgtacagaccagatttagggggttgttcctactaccagccatgaattgatgaggaccttgatgaattcaatggtaacaggatggagaggaggggctgaacagaacttagggtagtgtttatgaggtataaataatgagactgacgcactggtaggatacaaaaatgaagggagaagagtcaagaattcaaagcttctaggtttggttgatattttcatcaaaggggttatgggagtcacagagctcaactgatatcccttagttgcttcacaaattactctctctctgaatctcacttgtccatacctgaaaatgcagataagataatagtgttacctacctcattagctgacttaaatggagctaacacatgaatggtgctgagcacaaagctcggctcatggcaatgaatatcaactctcattcattcaatgaatatctattggataccttccacaggccaggaactctcttaggtcctaggaagacagactataaataagattctcaaagttcctatgcttacggaggttacattcgtattacgtcttgttcttatacaacacataataatacaaaagttaattgcagagaatagtaaatatacaaaggaagcacataggctaagagataaagggaagctgtcaagggcgctttagatggggaatgggttcttaactgtaagtgacctgccccaccgtcacccggcggacatttggcaatgtcaagagacatttttgatggtcacagcttggaggcaagtgctactggcatctagtaggtagaagccagggatgttgctaaacaccctacagtgcacagaacagccccccagtgcaaagaatgatctggtctcaaatgtcaatactgctgagattgagaaaccctgagacagggttatgaaagagtcttttcagtgagggcatatttgggctgaaagctcagggaagacaaggaacaggtggtgagaagagctgaccagagagcatttcagaaagaggaaagagtaactgcaaagtccagaggagggaaagaacttcttgtattcagggatcagaaaagagactaagtggctcgaacgctgtaaggatgggagttggcacgtgcagagattagagaagttagcagctggatcatgcaagatctcagaagccacataaagagtttgtcttttgttctaagaatactaggaagcctttcgagcacgttgaaataagacacaccccctgttcagttttacatttcacattttaaaaaactcatgctggctgcattgtggattaaagagagtcaaaaaaaatcagaaggctgttgcagtcactcatgcaagagatggtgacgatgaagctagcgttttatcagtggaggtggagagaaacggacaggttagaaatatgttttgaaggtagagcagacagcacttaaagacatcagatcccaggggtgaggggaatgagaaatcaaggatgactcctaggattttagcttgaggcactgagtaggtggtggtggtattcattgcgttggaaagatgtcagaaggaacaggtttgggaggttgttttggacttacaggtttgagatgctaatttttaatcccagtgaagacgcaagtatgcagacagctggatatacagagctgaagctaccaggggaggtcagggctgtaattatacattacgacatattttataatataattccttcttgccgaagtctccctgcatatcatcctgcatgcagatgtctgaagtctcaaggaggcattttctcagaatcattgccaagcccaacactgtgatatttttaaagtgtcacatcctccatgcccctctttgaattgagtcacatgtttaattaagtttccacttacaacccaagtaaaggggaaaaataaccctaaagaattgatccgtgcctgcagagctttggaattttgggtggctaccctctctgcttctctcttccttttttctttctttcttctttttttccccacttatttgctagggacattttcattctcaagttgcgattagttttggaaatgggggtcttgcagtagagagtattgaggaagccctgtccttaagaagtcgtcttcacagatgatgacaccgaatggctgaaatgcagcagaaggatctctgggttaagattcagaagacctgagccctcagcttggtctgaccacatgctgaccatgtcaactcagggcatggtctcagcttcccgttcttttgtaaaaatgggagagaatccccaacagatgtgagtctttgtgaaaatcatatgagatcatatgtctaaggtctggaaagcatgcacattttacaaaagccatcacttcccaccccctccgtcaacaccaccctagtccaagcctccgtcatatgttcccctcattactacaatagtctcctgactgctctccatggtactgcttctgcccactccccctgccagtctgttcttaacagccagaatgatgccatgaaaatatgtcacatcatgtcacttccctgctcaaaaccctcccactcatatcccactcacctcccactcacggtgacatttggagtccccatgcaacgctactcaccattcaacagctctcactcatatccactgctgggtccacatcagccacacggccttcctgatattcctggaacacattaggtggaatcccaccctgaggcctttgtacttgctgtttcctctgtctagaaagtctttttctcagatagccacatgcttccaatgccttcttcccagggaggcttttcctaatcactttaacacagattgccgtctctccctcctgccccacatgcactacattctccttctatactttaattcacagccttttacttccaaacatttcattttccttttcttccttttttttttttttttttttttttttttgagagaaggtcttactctgttacccaggctggagtgctgatcatagctcactgtagcctcacattcctgggctcatgtgatcctcatgcctcagcctcctgagtagctgggactatagactcaagctaccatgtcaggataatttttaaatttttctgtgaagacggggactagcaatgtttcccatgctggtctcaaactcctggcctcaagcaatcctcctacctcagcctcccaaagcactgggattacaggtatgagccaccacgcccactagcccattttctttatatcttctgtgtttcatccgtcttcatctgatgaaaagtaagctcagtgaaggacgggatttttctccgcattttgttcaagactgtattctgtagcacctacaacagtgcctggcacagagaggtgctcagtaaatatgaagaatggacagatgagaaaatggaaacacaaagaattaaaataacttgcccaaagttacagatgggaaaagggtgtgttcacattcagacacctccacttcctcaatggacagttgaaggtgatcatatctttcccggtttcctcaccggtcattgctagaagccaaaggaatgcgtgcctcgtcccctcagagagcgcacactaccatacagagtacgtggaattcagtgaggccatgagagggtgccattaatagacttgtgtgtgtgtgcctggagtacatccctttggctcatctaatttcagaagtggacaacttcaagcatgctccaggtgtctcacctctgagctatatacaggtatatacacctctgatacatatacctgtgtatatcccagcttttctatccctgggctttcttggagcaaggaagtttagtccatgtgcagaacagcctggctgtgagcaggagaggatgttcccggggcacctgtccctcaaccagtgggtgtgggtggataaatgtcccaaggtcctaccccttgctggggtgaatctgcagcacatgctatgtggcatgtacctgcattacagaggatctttgcaggattgcacccctctgtttttcactcctggctcttaaaaagtcgcctccaaaacattacctgtctccacacccatgttgcagactttgctttcaaggaaacccaaactaagagagtgcctgcaaaggggagctcgggatttgggttcaaagtttcaaatcccagtttggctatttgcccttgtgaccctgagcatgttccttaatttcctcaaagttccccagcaagtggagacactaatatgaagcttgcctgcttggaggaagaaggaatataggcagtgacctgtcccgatgcctgagatataatatgctattaaaaaatggatgctgatattattataattacacaattgtaattattgatatcaatagttattataaatatgtatttttgtatgtgttcatgatgtgatcggtcatgttcatgtgtatgcatgtgactcaacattcttattattcatctttgtcattcaagttaagaaagaggacatgggaaggcaaaaaaggaggtatatcctaagggaggagattaaaggacccctagactccacaaattcctaagctgtcatggtagagagcagtctactgctttttgaagctcttgtcaacccctcagcatctatacttctgacatattccatcaacctgtgtattaatatggctcatatttctaacaagtgctcacatggtgctttcattctggcagaaactgttaaaacttctctacacagaaagttctttatccctatgtcacagatgaggaatgtgaagcccagagacgttggccaaccttcccaaggtcacacagctaggaaagggcaaagctggatttggacctaggtggtctggcttcagagtccatgctggtaacccctctgctgtattgcctctttgcacaagatcagcagaacctagggagcaatttcgctgccatcccagcagcctaggggaaaggagacatcatagtttccttatttgataacttcataaacgatagcatttagtgcaaagcagcgaggtactccagaagaagcccaatctactcatctctgcaaattccatagatggccttgtcatgatgtctgggttgctgtgatctccacttctgccttcagtttgttcccatggccagatgaaaccccttggaaagaacaaaactattatattgctggggtagagaagagtgtagttttacagaagctgaatggcgtggaaccatgcagcttaaattatcaggctgtgatggctcctatcacctagcaggtggagagagaacagcagatagaaaagactgacttctagcagctactgaggtctcttctccttgtcaacagagacttagatggtagatttgaagtggaaaatgggaatttgaaaattagagacaaagaatggcaattagtttagctaaggcaaaaagatgggatttttaaaaagcaacgttttgctaagtcagtgctggggaacaattttatcaggaagtaaaaataaactctggtttatatgtattatggaatgtgttatgtctcttctactgcatgttgatggctacgtgagggcgagagctatgctggggaccaactggaggtgctatgtggagaatagggatgcaggatgtggaatcaaatggtctggattcaaatcctggctcttagcagctgtgcaggctcaagcagattttgaatgctctctaaacctcagtttccatgtctgttaagtggataatttgccttttctgtagggttatactgaggattaaatgacataatccacatatatttagcacagtatcgggcacatggcaagctctcagtatttgataactgttatgacgacaaagttataaaatgggtgaagtcctgtgtcttgtttcaaagatggatacacactgaaaggatgaacaacaacaatggtatataacagcatcaaaaagaagtctaggccaggcgtgatggctcatgcctgtaatcacagcactttcggaggctgaggcaggtggatcacctaacgtcgggagttcgagaccagcctggccaatatggcaaaaccctgtctctactaaaaatacaaaaattagctgggcatggtggtacacgcctgtaatcccagctatttgggaggctgaggcaggaaaattgtttgaacctgggaggcagaggttgcagtgagccgagatggtgccattgcactccagcctggttgacagagcgagactccacctcaaaaaaaaaaaaaaaaaaaaaaaaagatttacacaggagaccatgaaacttactaattgtttttcctactgaagatttttattcattatgtatagcataattgttaagaatattgatcttgacatcagacaaacaaggctttaaattttcattctatttactcaccgtgagcagtcagttgatctctctgaaccttagttttcttaaccataaaatggggatgatagtaccaaacccctggggttgtatgaggattaactgagaaagcagataaaaagcattttgcatgtgaattgatattattgataatattataaacatgaatatgtgaatgtgttcatgacttttttccaggtttatttaaatataactaaaaaatattgtatacattatggttcacaatgtgatattttaatagatgtacacattgtgaaatgattaccacaatcaagctaattaatatatctgtctcctcaaagacctaaaaatggaaataccatttgacccagcaatcccattactgggtatatagccaaaggaatagaaatcgttctgtcataaagacacatgcacatatatgtgcgttgcagcactatttacaatagcaaagacacggaatcaacctaaatgcccatcaatatagactggataaagaaaacgtggtacatatacaccatggaatattatgtagccgtaaaaagaatgagatcatgtccactgcaggaacatggatagagctggaggcaattatccttagcaaactaatgcaggaacagagaaccatataccacatgttctcacttataagtgggagcttaatggtgagaatacatggacacgtataggggaacaacacacagtggggcctgtcagagggtggagggtgggaggaggaagaggatcaggaaaaacaactaatggatactaggcttaatacctgggtgatgaaatgatctgtacaacaaacccccatgacacatatttacctatgtaacaaaactgcacatttgccccaaacttaaaagttaaactatatatatatgtgtgtatatatatacatatatacacacatatacacgtatatatacacaatatgtatatatgcacatatacatgtatatatagtgtatatatagtatatatacactatatagtatatacttatatataatatatgtatacatatactatatatacaagtatatgtagtatatactacatatacttgtatatgtagtatatactacatatacttgtatatgtagtatatactatatatacaagtatgtatagtatataggtatatatagtatatacatacttgtatatatagtatatatgtgtatatgtgtgtgtatatatacttatatatacatatatacgcatgtatatacacatatatacatgtgtatatatatatttacattgtgtgtgtgtgtgtagtttgctaaggataattgcctctagctccatccatgttcctgcaatggacatggtctcattctttttacagctacatagtattccatggtgtatatgtaccacgttttctttatccagtctatattgatgggtattaggttgattctgtgtctttgctattgtactatatatgtagatatatacacacacatagtatatatttatgtttactatataaatatatatagtatttatatatactatatatatttatatatagtgtatatacactatatatttatatatagtgtatatacactatatataaatatatagtgtatatatactatgtatttatatatagtgtatatatactatatactatgtatttatatatagtgtatatactatatattaaaaatataccataaataaaaaatatatataatatacatatacactatatatagtatatatacacactatatatttatatatacactatatatactatatattatataaaaatatatactatatattatatataatatacatatacattatatacagtgtatatatacactatgtatttatatatactatatattatatacactatatatttatatatactatagtagtgtatatgtatactatatatagtgtatatatactagtatactatagtagtgtatatatagtgtatatatactagtatatatactagtgtatatatactagtatatatactagtgtatatacactagtatatatactagtgtatatacactactatatatactagtgtatatacactactatatatactagtatatatacactactatatatactagtatatatacactactatatatactagtatatatacactatatatatactatagtagtgtatatatagtgtatatatactctatatatatactatagtagtgtatatatagtgtatatatactagtatatatacactatatatatttatatatatataaaatcacctcacatacttaatattttggtggtgagaacatttaagatttattcttttagaactttcaagtatacaatacatcattaactatagttgccatgctctacattaggtctccagaatatattcattctgtttaactgaaattttgtatcctttgaccaacatttccctattctcccacctccaccccaccccaagcccctggcaaccaccattgctttccttctactctttgcttctgagtttgacatttttagattccacatgtgagtgagacaatgcagtgtctgtctttctgtgcctgacttatttcacttattataatatccaggcccatttatgttgttgcaagtgacagaatttctttttttaagtctaaatagtattccattgtttgtgtgtgtgtgtgtgtgtatacacacacgtttatacatgtctatccgtgggtcaatggataaagaaaatatggtattcacccattaatagacacttcagttgattccgtatcttgactattgtgaatattgctgcaatgaacataggaatatagatatctcttcaatttcatttcctttggacatatgctaactagaagactagaagtgggattgcaggatcatatggtagttctatttttaattttttgaggaatctccataatggctgtactaatttacattcccatcaacagtatacaagggttccttttctccacattcttgtcaacacttgatatcttttgtcttgttgataatagccattctaacaaatacggggtaatctatctcattgtggttttgatttacattttcctgatgattggtgatgttgagcattttttcatatacccgtcagccacttatgtgttattttttgagaaacgtcttttcaagtcttttgcccattttaaaattgggttgttgtattgctattgaattgtttgagttccttaaacatcttgcatattatcctctcatcagatgtatggtttgaaaatattttcaccctttatatagattgtgttttcattctgttgattgttttatttgctgtgcataagctttttagtttgatacaatctgatatgcctattgttgctttttgagtcatatccaaaatatcattgcctggaccaatgtcaggaggatcttttcctgtgttttcttcctgtggtttataggttcaggtgttatgtttcaatctttaattaattttagttgatttttgcatgtggtgtgagataagaatccaatttcattcgtctgcatgtggatatctaatttttttcaacactacctattgaagagacagacctttcccttgtatgttcttggcatcttggttgcagacaaattgaccataaacatacgggtttttatgggctctttcttctattccattggtctatatgtctatttttgtgccagtaccatgctgttttgattaagatagctttgcattatggtttgaaatcaggttgtgtgatgctttcagctttgttcttcttgccgaagactgtggtggctgctcaagattgtggtagctatttgcagtctttgatgatttcataccaaattttaggattttttttctatttgtgacaaatgccaatgacattttcataggaatggcatttagtctatggataactttgggtattatgaacattttcacaatattaattcttccaatacataaacacagactatcttttcatttatttgcatctttttcaatttctttcatcacagttctacagtttttagtgtacaaatcttttacctccttggcaaaacttatttctaagtgtttcatttttttgtagcaattgtaagtggacttttaaaaatgtttttggattatttattagtgtataaacacactattgattttgtatattgattttgtatcctgcaacattacttcattaattagttctgacaattttgtgatggagttttaggacttcataagattatgttatctgcaaacaaagataattttatttcttcttttccaacttgggtgccttgtattcctttcttttgcctaattggttgggctaggacttccagtactatattgaacagaagtgtcaagagtggacattcttgcagtgagccgagatcgcaccactgccctccagcctgggcgacagagcaagactctgtcccaaaaaaaaaaaaaaaggacattcttgtcttattccttgtctcagagaaaaagctttcagctgttcaccagttcaccattgagtataatgttatctgtgggacattattatgctgaggtacattctttctatacctaatttgttgagagtttgtagttaggaaattacgttgaattttttcaaatgcctcttctgcatctgtggagatgattatatgatttttatactttattctactaatgcgatgtagaatacttactgatttgcatatgttaaactattcttgcatcctgagataaatcctaattgatgatggtgtataatccttttcatgtgctgttgaattcagttggctagtattttgttgaggattttatctatgttcctaaagcatgttgatctatactcttccattcttgtagtgtacttttctggctatggtatccgggtaatgtcagtcttgtaaaatgagtttggaagtgtttcctgttctttaattaaaaaaaaaaaaaaaagaaaatgtgttgttaattatgctttaaatgtttggtagaattcaccagtgaatgtcttgggtttttctttgttgggaactttttgataattgatttaatctccttactgattgttggtgtgttcatattttctatttcttcataattcagtcttggtgggttgtatgcatctagaaatgcattcatttcttctaggttatccaatcattcatagtatctcttatgatgctttatatttctatatcagctataacatctcttttgtttataactttgagttccttttttcttagtttctcaatttagtttattttttcttaaaaaaaaaaacaactcttagtttcattgatattttctattgttttctaccctctttccactgactttgggcttagtttttcttcttttctagttctttggggtataaaggttggttgtcaggttgtttacttgagatctttttttccttaatgtaggtatttagcactataaacttttagaactgtttttgctgcattccataagttatggtatgttgtacttctgtttcattcgtctcaagttatgttttgatttctcttttgatttcttctttgactcattgattgtttaggagcatgtcatttaatttgtcagtatttgtgaatttccctattttcctcttcttacgggtttctaattttataccactgtaattagaaaagatgcttgatatgatttcagtcttctcaaatttattaagatttgttttgtggcataatcctcccattctggagaatgtttggtgttcacttaagaatatttattctgttgctgtttgatggtaggctcttcttgtctgttaggtccatttggtttatagtgtttgtctgttattttcttattgatttttctgtgtgaataatttattgttgaaagtgaggtattgaagtctcctactacttttgttcatttagtttggtttgttacatagatatagtgcatgatgctgaggtttaggggatagatcctatcacccaggtagctagcatactacacaataggtagtttttctttttttttttttgttattatactttaagttttagggtacatgtgcacagcatgcaggttagttacatatgtatacatgtgccatgttggtgtgctgcacccattaactcgtcatttagcattaggtatatctcctaatgctatccctcccccctcccccaaccccacaataggccccggtgtatgatgttccccttcctgtgtccatgtgttctcattgttcaattcccacctatgagtgagaacgtgcaatgtttggttttttgtccttgtgatagtttgctgagaatgatggtttccagtttcatccatgtccctacaaaggacatgaactcatcattttttatggctgcatagtattccatggtgtatatgtgccacattttcttaatccagtctatcactgttggacatttgggttggttccaagtctttgctattgtgaatagtgccgcaataaacatatgtgtgcatgtgtcttcatagcagcatgatttataatcctttgggtatatacccagtaatgggatggctgggtcaaatggtatttctagttctagatccctgaggaatcaccacactgacttccacagtggttgaactagtttacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgaggagcattttttcatgtgtctgttggctgcataaatgtcttcttttgagaagtgtctgttcatgtcattcgcccactttttgatggggttgtttgtttttttcttgtaaatttgtttgtgttcattgtagattctggatattagccctttgtcagatgagtagattgcgaaaattttctcccattctgtaggttgcctgttcactctgatggtagtttcttttgctgtgcagaagctccttagtttaattagatcccatttgtcaattttggcttttgttgccattgcttttggtgttttaggcatgaagtacttgcccatgcctatgtcctgaatggtattgcctaggttttcttctagggtttttatggctttaggtctaacatttaagtctttaatccatcttgaattaatttttgtataaggtgtaaggaagggatccagtttcagctttctacatatggctggccagttttcccagcaccatttattaaatagggaatcgtttccccatttctcccatttcttgtttctgtcaggtttgtccaagatcagatggttgtagatatgcggtgttatttctgagggctctgttctgttccattggtctatatctctgttttggtaccagttacatgctgttttggttaccgtagccttgtagtatagtttgaagttaggtagcgtgatgcctccagctttgttcttttggcttaggattgacttggcaatgcgggctctttgttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttctttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgtttttggtgtataagaatgtttgtgatttttgcacattgattttgtatcctgagactttgctgaagttgcttatcagcttaaggagattttgggctgagacgatggggttttctagataacaataggtagtttttcaactcacaacccctttcttcctcccaactttagtagtcaacagtgtctattgttctcatctttatgtccatagttacccaatgtttagttcctacagtgtggtatttggttttctgttcccgtgttaattgttaggattatggtctccagaagcctccatgctgctacaaagaacatgatttcatccttgtttgtggctgtgtagtattccatggtgtatgtgtatcacattttttcatccaatacaccattcatgggcatctagatggattccatgccattgctattgtgaatagcactgtgtggaagaaatgagtttatgtgtctttttggtgggaagatttatttttctttgagtatatacccagtaatggcattgttaggtcaagtgatagctctgttttaaattctttgagaaacctccaaactgctttccacagtagctgagctaatttacattctaatcaacagtgtataagcatttctttttctccacagtctcaccagcatgtgttatttgattttttaatagccattctgactcgtgtgagatgttattgatttgcatttctctgatgattagtgatgatgagcattttttcgtgtttattggccacttgtatgtcttctgtcttcttttgacaagtgttcatgtcctttgcctactttttaatgtggttatttggtttttgcttgttgatttgtttaaggtccttttagattctggatgttagacttttgtcagatgcatagtttgctagtattttctccaatgctgtagattgtctatttactttgttgatagtttcttttgctgggcagaaactttttagtttaatcaggccccacttgccaactttgtttgttgttgttgttgttgttgttggaattgctttcagggacttagccaaaaattctttgtcaagactgatattgagaagggtattccctaggttttcttttagaatttttataatttgaggtcttacctttaaatctttaatccatcttgagttaatttttgtatacggtaaaaagtagcgttccagtttcattcatttgcatatggctagccacttatcccagtaccgtttactgaatagtagaaagtccttgccctgttgcttgtttttgttgactttgtcaaagattagatggttgtaggcgtgcggctttatttctgggttctctattctgttccattggtttatgtgcttgtttttttttcaccagtaccatgctgttttggttactgtggccttatggaataattagaagtgtgatacgtctggctttgttctttttgctttggatcgtttgggctattcggtctcttttttggttccatatgaattttggaatactttttttctaattccatgaaaagaacatcggtagtttcatataaatagcattgaatctgtaaactgctttgggcagtgtggccattttaacaatatcgagtcttccaatccataagcacagattggtattccatctctggtttctttcaacagtgtttcgtagttcttgtagagatctttcacccccttggttagctgtattcctaggtatttccattttttgtgtgtggctatcataagtgggattatgtttttcatttgactatcagcttgaacattattggtgggtagatgctactgatttttgtacattgattttgtctctttgtccttcttaatagttgtttgtttaaagtctgttttatctgatgtaagaatagaaacctgctctttttattttcaacttgcatggtagattttttttttttttggtccctttactttaagcctgtttatgtcccttcatgtgagatgggtctcctgaagacaggagagaggtggctcttgtctttgtatgcagcttgccactttatgtcttaagtggggcattaagtacatttacattcagggctattattgatacatgagactttgatcctgtcattgtgttgttagctggttattatgtggacttgtttgtgtagttgctttatagtatctatgggatatgtgcgtaagtgtgtttttgtaggagcaggtgccatttcttggtttccatgtttagcactttttaaaggaactcttgtaatgcttgtctaattgtaaccaattccctcagcatttgcttgtctgagaaggattctatgtctcctttgattatgaaactcagtttggcaggacatgaaatttttggttggaatttctttcctttaaggatgttgaaaataggctcccaatattttctggcttatacgttttctgctgagaggtctgtctattgctagcctgatggggctccctttgtacatgatctgatctttctctagctgcctttaagatttttttttttttttgcatttatcttggtgactctgatgactgtgtgtcatggggaggggcatcttttgtagtatctagccagggttctctgtatttcttgaatttgaacgtcaatctctctagtgagattagagattttttttgtggactatatcttcgaatatatttttcaagttgcctactctctttcttcactcaggaatgccaacgagttataagtttggtctgtttacctaatcccatatttcttggaggttttgtttatttttttaaaattcctttttctttatttttgtctgactgagttaatttgaaaaaccagtgttggagctctgagattctttcctcagcttggtctattctactattaatgccttcaactaaattaagaaattcttgcagtcaacttttcaattccagaagtttagtttggttctttcttaaaatggctcttttatctttcagctcttggattattttactggattctttggattgagtttcaacttgcttctgaatcttgatgaacttccttgccatctatattctgaattatatgtctgtcattcagtcatttaatagtggttaagaagctttgctgaggagctagggggctcatttggaagtaaggggacactgtggctttttgaattggtagagttcttgcactgattcttgcactgatctgggagggctggtgttccttcacctgtggtgtaagttgagtattttcagttgggctcatttctggatgtttttagagggccaagactctgtacaggatctttatttgtgggtgaatgcctgtgcttggtttcacaggggtattagccaaataatttttggcaatgtagtttgagccatgatccagtagatggtgcttaaaagtaatggccagcaggtagggtcttagccacatggctcttttatatttcctcacgtttgcaggcatgctctgccatggcaaagggaggtggggagagatgacctcctcaccagatccactcctaggccttcgaggattcccctcttatcactggctccacacccatatttattttgttaggtgttcagggccgcagggctcccttgggcagaggctgtggcagagagacaggccacattctttctggactggccctatagagggaggtatgcctcactcccttgctggcccatgaacttggacattttaccattctcaatgctctgagtgtgggggctcctctcccactcaagtgctggccacagatctcagctcaacactcataagctgtgtaccatggctgagacatcaggatggcccaactgtggtggtggattcgaagtgctcccaggttgctgggaaagtgttcaggtggagcaaagcactcaggctgggcagtggaggctgtgctatgcagcctgtgctgtgcccgtggtcctgtggggcaggcaggcaggagtcctgggaaaggctagtgggcaggaaggcttatagaacagatgttccccagtcctgtgggaaggctgaccctgctctcttctggcctggtggtcaactggggctagaacctcttggagggagatggggagcactggggtatgcgtgtctgtggctacactctgccagaactacatttctgggttctctggtggctgaagccctgactctgcctattccctgggcagatccccctgctagctcacatgtccatggggaatgtggggccccctgtcctattacttttgtattgctgtctgcttctccctttagttgtgttaatatttgcattatataattaggtgttccattgtttagcacatatatatttaaacttattatatcttcttaagtgaattgactcttttatcattatttaatgaccttttttatctctgtcacagttttggacttaaacatctatttttttttcctgatgtacatatctctgcttttttgattactattatattttatttattacagcttatagaatatctctttacatcccataattttcagcttatatgtgtacttaaagctaaagcaaatctctagtaggcagcatgtagatgggttttggctttttactccattcagtcactctgtcatttgattagagaatttaactcatttacatttaaataataattcataggtaaggacttactacgaccatcttgttaattgttctctattttgtatttcttttgtctcatccttcccctcttgctatctttctttctgttttttgtttttgtttttgtttttttttgtagaggtatgctttgattattttctctttatcttttgtgtataccctacatattttttctttgtggttgttatgaggcttacataaacatcttgtagttataatagtctatttgaagctgataactacttaatttcaactatatacataaatatctacagtttaacttctccttcccccgtatttgtgtcattgatgtcacaatttacatcttttatgtatcatgtatccattaacaaattattgtacctatatttttaatacttttgtcttttaacttatatagcagagtcagaaattatttatggaccaccattacagttttagagtattctaaatttgactatattcttacctttgcagtgaattttatactttcatatattttcatattgttaacatccttttctttcaacttgaagaacttcttttagggtttttttttgtaaagcagatctagtggtgctgagtccccacagcttttgtttgtctgggaaagtctttatcttgccttttgccttcattttggaatgatgactttgctgggtatacattcttggtcgatagttcttttttttttttttttttttcccagcacttggggtaatatcatctcattctctccttgcctgcaaggtttctgctgaggagtatccttaaagttttagggaggtgcccttgtatgtgtgatcagttgcttttctcttgcgactttcaaattgtctctttgacttttgagaattttattataatgtgtctcaatgaacatatctttatagtgaacctacttagagttctttgggcttcatggatctggatgttcatgttcctcttcatccagacataggaagttttctgtcattatttatttaaataagctttttgcccttttttttctttttcttctccttctgaaactctcatcatgcatatattggctcacttaatggtgtccatagtcctgtaggttttcttcctcattttccctcagtttcattctttttgtcaccttaactgggtaattccaaaggacctgtctttgagctaattcttcttctgcttagccaagtggatgttgaagctctctgaaagttttcagctcaatcattgcgttcttactcaaaaatttctgtttggttctattttttttatttttatctatttactgaacttctcactttgttcatgaattattttcctgatttgacatagctgtctatctgtgttcttctgtagctcactgagcttctttaagatgattattttttattgtttgtcaggcaatttggagatcttcatttttttagggttggctactggtcctttattttgtttctctggtgatggtatgtttctccaattacacgtaatcctgtagtcttgcattagtatctgcacatttgaagaggtagataccactttcagtgttttaaggacaggctttggcagagaaagcactttaccagttagcctgtttagagactctggtcaggccatcttgcagggttcatgggttgcctgctgctggaatcctcaggtgggctgggagcactgatgtctactggagtgggtctgaaccttgagtctcttggagcctgggcctctggagacaagcctggagcctgggatgggcctggaggctgagcccacagtagtgggcctgggtcctgggccatcaggagcagtcatagaggttggatttataaggggctagcctagtgctaggtgggccaagagcctaggtctggagtggtcagcctggagcctgggcctgcaggtgctggcctggtgccttgggctgtgggagccaacatagtgctgaggtaggcctggaggctgagtctacgggggcaggcctgagtcctgggtctgtggcagtcatcctagagcttggaactataggggattctctggaactagggcttggtccccaggctggggcaagcctggagcctgagtctgccagggtaggtaggcctagatccatgggattatgagggctgacctggtgctggggtgggcctggaggcttgatctatgggtactggcctggggctcaaggccatggggctgacctggtgccaggtttcactggcacaggcctgatgtttgggtctgtggtgaattcacatgttcacttcactctccttcccccacagggagcacacgtgtctctgcactgtgctggggttgggaagcggtggtgtggataatgtgaaactgtccttattaccttcttcagtgcatttttttttcttatttgtgtgctacacctaggtgctgtaatctctcacttgaatctcttagctcttgtgaaggtatttttatgcatagattgttgtttaaactgatgtttctgtgaggggatgagaaccagaaagttctattctgccatcttgctggcatcgctcccctagggacctgttcatgaattcgtgaattcgtatagcgtgtaaaagtattattttacacccaagataatcaattttactagtttgtgttcgggtctgcatgatggaaatcaatcagccaactctgagtggcagagtctgttacattggtgttaaaaaccagtctatgttatattggtgtttaaaaagattctgaggtcacatttgggattagtaggaaagaatgctttgattgattagtgatgtcttccattggcatggaaatggagagggacacttttttgagacaggctctggctctgttgcccatgctagagtgcagtggcacaatctctgttcactgcaacctctgcctctcgggctcaagtagtcttcctatctcagcctcctgagtagctgggcccacaggtacgcaccaccacgcctggctaattttttcttttttcttttttctctctttttttttttttttgagacggagtctcgctctgtcgcccagcctggagtgcagtggcgcgatctcggctcactgcaagctccgcctcctgggttcacactattctcctgcctcagcctccccagtagctgggactacaggcgcctgccaccatgcccggctaatttctttgtatttttagtacagacggggtttcaccgtgttagccaggacagtctcgatctcgtgacctcgtgatccgcctgtctcggcatcgcaaagtgctgggattacaggcatgagccaccgcacctggccctggctaatttttttctatgtttttgtagagacatggtttcgccatgttgcccaggctggtctcaaattcctgagctcaagcaatccacctgcctcggctatctctcctgttccccatccctcaatctctttctgtctcttgttcttgagtgtgtcttttttagatcttgttctccctttgacagcttcctctttggcttggcattttatcatttttcttagcagctgggattctctggcatttctaagtctattttaaacactttgtaaggtttgatttagaggaaaatctgatttccatagtttgtgcattggtacctcaggggactcttagtttgattatgtcctgaaaaggttgtgataagctcgggctctggcagccctgataggcgtggctcagtggcctttcagctgcttccatctgggttattgaagctttttagcagcccaagagcaccaggctctttacctcattgtagagttccagtctcatttttgttttgccagaacccctggggaactgattaagatgattctgatttagcaggtctggggtgagacgtgagattctgcatttctaacaaacagacgtgagccaggcgcggtggctcacgcctataatcccagcactttgggaggctgaggcgggcggatcacttgagttcaggagttcaagaccagcctgactaacataaagaaaccccgtctctactaaaaatacaaaattagccgggcgtggtggcacacacctgtaatcccagttacttgggaggctgaggcaggagaatcacttgaacctgggaggcagaggttgcagtgagccaagactctgccattgcactgaagcctgggcatcaagggcaaaactttgtctcaaaaaacaaaaaaaaaaaggaaagaatgctccttctgtcttgaaacctaatttcacctggcaaatggagtttctcctcctatgtgctccctttgaacccacatgacattttatagtatttctgatgggcttcttcccaacttggactctaataatctctattcatttctctctccagttagaccgagtgccactccagggcttgctatggaaaaataaaaacgcaaaatagaacattccaggccagtacatgtagtaaagaccgtcatgatgccaaacatgacaactttggccttctccagtgtagtgatgcctgctgctctgaaaagcagcagccttatttacaagagctaaagcttggaagcaacctaagtgtccctggatggatgaacagataaacaaaatgtagtatacacatacaagggaatattagtctgcctttaaaaagaaggaacttctttttctttctttcttattttttgaagacagagtctcactctgtcacctaggctggagcgcagtggtacgatcatagctttctgcagctttcagctcccaaggtcaaccaatcctccctcctcagcctcccaagtagctgtgactatgggtgcatgcctgggtaactttaaaacaaaaagtttgtttgtttgtttgtttgtagagatgaggtgtcactatgttgctcaggctggtcttgaactcctgggttcaagcaatcctcttggctcaacctcccaaagtgctgggattacaggcatgagccaccatgcccagccaggaaggaacttctcacacaacgctgcaacatgaataaaccctgaggacattatgctaagggaaataggccagtcatcagagaacaaatgctgtatgagttcacatacatgaagtacttagaacagttacatgcatacagatagaaagcagaatgatggtttccaggggcttggggaaggggaaatggggagttactttttaacaggtgtagagtttttcttagttttacaagatgaaaagagttagtgagatggatggtatgatggctgcatattattaaattaatgctttctttttttttttttttttttttttaagacagggccttgctctgtctcccaggctggagtgcagtggtacagtctcggctcactgcagcctcaacctctcaggctccagcgatcctcccacctcagcccccccatgtagctgggattacaggcatgcaccaccacgcctggataatttttatatttttagtagtgacggggtttcgccatgttgactaggctggtcttgaattcctgggctcaagccttgacctcccaaagttctgggattacaggcctgagccaccgcggccagcctattaaggtatttaatacttctgaactgtacaatggttaattaaattaaggtatttaatacttcaatggttatgctggtaaactatattttatgtgtttttccctctcccttgtggttttcccctgcggcctcctacagggaaaagaggggaggacctatatccttcttcgatatcatctctatcctacagcttgtaggatatggtacagcttgtaggatatttttaccacaataaaaacttcttataaaaaagcattggccttgcacaaaaaggccagagttctagcctttcctggcaggaatacactgcactgggatcccttgaagccctagactagcccccacatgcaggagatttggaatatcctcactagacatcagatgaacaggggtctgtgtgacttctttaattttccatcacatatcttgtcttgccctaagtttccattcctgctgctgcctgggacagatatacaagagaaactggttttacataattttttccattgtaaatttattcttggcaaagaatcaaacattcaaattctttcacaggattatttcctttctctaggtctctttctcctttgtctcttgaaggtgacatctgagctcgtaaaacagtttgtttctgtccgtgtgctggacatcgtcctttctggcctctgctgcagaattctgagtctcaatttgaccctgagtgccctgcactggtgtccactgcagagaaactgctccttcctgatattttttgagcatgttactgatcgcccctgctgacattatagatctctgccattggctctggtcctaaggttacctcattctgtgatctcctcaccctaagccaggcctcttctgctctatcaattctctcagaaattctgagcccctctaaaaggaaggaggcagggaatcttgttaggtttttctgcaggatggctatgttggggagacaccataacatcctaatgtatgtttggggttggcaaacattggcccaaaggttgcttgtcacatgactttgtaaataaagttttattggaacagaactacacccactcagttacatattgtctatggctgcttttgcagtacagtggcagagttgatcgtggtgacaaaggttatatagcccgcaaggctgaaatatttactgtctggccctttgcagaaaaagtttgctggcctttggtctttgtggtggagtccagggttgtgcaggacatatcctatgtggctgtatgtgacagccctggctttctgtaccaggctgtagcaggtgggactcagtgaggtccctcagccatggctgtctgaccagtgccattccataccagcttggggaatgttgcaaggagtttctttttggattccagctttctgtcataccatttggggtttccaacttcaggttgagggacccagcagtatcttcatctttctttctcaaaatgtctttttttttttaatcggagtcttactctgtcacccaggctggagtgcaatggcgtgatcttggctcaatgcaacctccgcctcctaggttcaagcaattcttgtgtctcagccttccaagtagctgggactacaggcacatgccaccatgcccagctaatttttttgtatttttagtagagatgtggttttgccatgttggctaggctgttcttgaactcctgacctcaggtgatccacccgcctcagcccccaaagtgctgggattacaagtgacagccgctgtgcccagcctcaaaatttctttctcctgtggttttccccctttggactcccaccccttacccagggttggaactacttatcttctttgtaacaggtaggacctattgccttcttctatatcatctctatcctacaccttgtagaaagtctctatgctcagaactctaagggttgctttagaatttagaaatatacctttctctctcaagaaagcctggactattgtctcatgatgacattgacagcctattttggaaatcaaaaagtagacattgctccattctctttgtgtttctgctgcaactatcccaatccttcccaaagcaatagattctctgactggggagtggaggcattcatatattgcaagaacatcatcttctttgagtaattatatctggcactgtgcctggatcagagtagctgataaacaaatatgatcttgtggcagagggctacaggagagcgttagcatctagattccttgatctaatatgaaacccatccaaagagaatgagatattctgaagaatcattctttacagcaggaaacaaattctgccttagagactggaccctacattttgtgaaagggacctacgtccatgacatcatccaggtgtggccaagccgtcatggcattccagggaagctccggttacagcgacacgttctcacttttcctttatttgacattcagccactcatatggggatagctttcttcagtcaccataaccacagccagcttacacatttgtctctttgaaattaatcactctttagactgcttattctaatttctgcttcctgaaggcagagccagcaggcatctccacatggtttctccgttctccagctggaatttctgaaggacactgtgaggccacttccatttccgctgcctcctgaccctcttctacatcccagagtctaccttacatcccatgaatggacaagcagtggcgtatttctgactgcgtgggctccctgctgtcacagggcacttgctgtcaacagaaagcaggtgttctgggaagactggaggagctgtgggtggtgaggcagacactgggcttggctctggaagcccgaactcagaacattaagctgaaccatctgaagctcctccacgaaacaggttgtgcaagtctctcttcccctctctatgggttcatgcatattcataattagaacaactccaggccgaagataatgattcatgcaggaagcgccattctgaacattattatctgggagtgacaaatgaatttctaatttaacatgtgtattgcacaaatagatcacaagaactttaaagtcaaaagcatcctttggagtcatgcaacttctgttgtaatgtagcataaaatgataggggaaggaggggatctcccactggtgggctgtgcatagcggttcccttcaaagcagaggagaaataaaagggggtgagatttcagacactgtttgagtctactatagaagccaataacaatgaccaagaataaaacaacagcggcaacaacaaaaagccagtcactggcacaagcaataccattgttttgagttattatttgagaatcaacagaatcctccctatttttttctcctgctgacaacaaaaacggagggtaggccagttgggttcattggttgctcaataagaatcagagggcagtaactgcaagacaaggctgaagagggagtggtagaattgatttcagctgcatttcaataccggtttcatgttgaaatactaatttatagcatgataatatgatagcaacactgtctgcctggctgcaaagactggcctcttccagcttgtcaaagctgacagtcaagcgtaaaatggctactgtcaaggaatggcagctcttttaagactaggtcttaagccatttcttaaagttctgtatttctgtcatcactgtcccccatctcccaatcccttttctttctaaatgctagaataaactggctgcgcattctcctacctactacagcattcaccaaaagcctgtggaaaattcatactgtactagagcctggatatctacttttgatctctctcttctcttctcttctcttctcttctcttttcttctctatttcttttctttcttagctaataatgtattttaaaatgttaactaatcattttatgtaaaatcaggtgttatggtaaagcacattactttcatgacctcattaaattctcacaacaacctatgacaaaaatgctaccctgatttgctgatgataaaactgaggctctaagacataaagtgacttgcctgaattcacagagcctgtgatggcagaggcgggagtagtggaaaccagttctgcttgacttcagaggccactcctgtcattcctaaactggatatatttaatgctaaggaggcatgtctttttaagaatgtttgtacaaatattgatcgagtggaaccctggtgaaggaccttgcttggaactggacagtcaggttccctggcttcctccagctgcctcccaccctgtgggatgaggtggtgacaaagcccagaggatgtgcttgtctgggacgtagatcccttctgcaccacagtctgggacagtcaggcttgtaccctcaccactccagcccccaagaaaagcttctgcttatctcccagtagtcccatctctgaatggagcacctccccataactaaaccaatcactgagccgaggcaggggatgtggggtgctctgattggccaggtagtcacatgccccttcctggagttgtgaacgaagttaccaccatctgaatatggtagtctgagaataggagaaaggtcccggtacttgtcaggatgactaaggtgttgtgagcggaagcgggaagaaatgcccccaacacatgtccactggacttgtgaagcttccctgcctctcaactcctctgggctctgggggttgtaggagaatgtattaggaagagacacagaagggaatggaagataagagaaaaacaggccaggtgtggtggctcacacctgtaatcccagtacttttggaggccaggagtttgagaccagcctgagcaatatagtgagacccccatctctccaaaaaaaaaaaaaaaaaaaagccagatgtggtggtgcttgttgtcccagctactggagagactgaggcaggaggattatttgtcttcaggagttaaagcctaaagtgagctgtgattgtgccactgtgccctagcctggatgacagagcaagaccctgtctctaaaaaattaaaaggagggaaatacaaaagaatcctttcaggtaagtttgctcgcaaacagaaacacagaagtggagaagaatccgaaagggttcccttcaactcaagagagagaacacttaggaagaaatgctttaaaagcccagttcttggtggcaggcatctataatcccagctacccaggaggctgaagcaggagaatcgtttgaacccgggaggcagaggttgcagtgagccgagatcgcaccactgcactccagcctgggcgacagaggaagactctgtttaaaaaataaaaaaaataaaaaacagtcctgtcttattcccacatcccataccctgcagaccatacagcagtggtcttccacttttgtcctacagatacttacggctgtgggagggttcctcaggattctctgcaaagaatgaggttggggttcagaaggaagctcaatgggtagagctcacactctctcctggtttccaccagagcattctgtcattcgtcacccatttctgcatttttccgtaagaccttgttgttttgttttgttttttgttttgtttttgttttgttttgttttgtttttgaggtggagtctcactctgtcccccagggtggagtgcagtggtgtgatctccactcaatgcaacctctgcctcctgggttcaagcaattcttctgtctcagcctcccgagtagctgggattacaggtgcctgccaccatgcctgggtaatttttgtacttgtaggaaagacggggtttcaccatatgggccaggctggtctcgaaatcctgacctcaggtgatccacccaccttggcctcccaaagtgctgggattacaggcgtgagccaccgcacctgacccgttgttgtttttacaaaggccccttttctaaccattgatctacactgagacagtctcaagaataaagtcctctggttacctccacctggtgcttggtgtggtgcctgacacacagtaggcacttaataattgttgagctgtcaaatggaactgaaatgctgaatgacaaccagggaaaggtaattatgagtgaaaacttaagtcatagaaaggaaacagccttctgggcacacagagaactgatggtttccttcatgatggtatgaccatagacaaggcttgtgtacaaaggcagcctaccatttactgcatcctttttggctgccacaaagctgtaactaaacaggctcaatgtttgtgatgggccactggttaataataataacactctttgaacatttatcaagagctagatgcttgtgcattatctcatttaactctcataatggtcccatgaacggggatgttattattatgctccttttataggctggaagagattaagtaacttggccaaggtcacatacctctaatagggcaaggccagggtataaatccaccggtctgattccgaggtcccagtagttaagcactctgctacttacttaccaccagacagtgccgtaacggtggtcccgcaaaagtattttatggtttagagttcaggcaacaccagtgagaggaacactgataaactgaagtatctatcttaggaaaccagattaaagtgatggagggatggatggagaacctttgtgggagtctatttatcagggagaatgtaaagactctccaagaaaaagaagcaccttcaggtcccttggggaccatcagggaagcaagaactagatttgttttgggtagtttcaggcaaaacctagaaacatcatgttttctctaagttgacagattcccatacagtatgaaggacacactttctaacccagggcttctcaaacatgagtgtgcttatgtatcacctagagagcttgttaatgcacacacttctcaccccctactccccaaagagattctgattcagtacatctgggatggagtgtgacccattgcgcttctgataagcttctacatgctgccgttgctatgcttgggaccacactttgagtggcaatgccctagaccaggggtcaacaaactttctctgtaaagagcctgttgtagtttggatatttgtctcctcgttttgaaatgcgatccccagtgttgtaggtgggacctagtgggaggtgttttggtcataggggtccctcatgaatggcgtggtgtagtccctgcattgagtgagttctaactctattagttcatgaaagatctgattgttaaaaagagcatggcacccctcctctccctctcttgctctctgtctcaccgtatgacttgcctgttccctctttgccttcctgcatggtaaaagcttcctgaggcctcaccagaagcagaggctggtgccaggcttcttgtacagcctgcagaaccatgagctgaatacacctcttttctttataaattgcccagcctcaggtattcctttatagcaatgcaaaatggactaatacagagcctgaaagtgaatattttaggctcctggagcaactactctttcgttgtcatgcaaaagcagctatacacacaatgcaaatgaatgagcatgtgtttcaataaaactttatttacaaaaataggcagctaagcccttctgcatcagttagtgttcttagctggcagcaacagtaatcacttgctagtttaatgaggaaatgagttgcttacagcttccctttgggctaccacagagcctattaccactatcggctatgaccttgtccagtgttactgatgctttaagaagacccaagtcccaggccgggtacggtggctcatgcctgtaatcccagcacttcgcgaggttgaggcaggtggatcacctgagctcaggagttcgagaccagcctggccaacatggtgaaaccccatctgtactaaaaatacaaaaattagctgggcatagtggtggtgggcacctgtaaccccagctactcaagaggctgaggcaagagaatcgcttgaacctgggaggcagaggttgcagtgagcgagattgtgccattgtactccagccagggcaacaagagcgaaactccatctcaaaaaaaaaaaaaaaaaaaagaaaaaagaagacccaagttccatttctgccaagtcatctgctgcatcttagatctcagttggaagacagcagaagggtgtgttctgtctctgtgcctgtgtgtggctgacacacatgagcagctctcctctgaagctgaaagttgtctacgctcaagttactcacaatgggcaaagtatgatggcggggcattcccatcaagtgcattattccatccctcttgcaccatacacatcaacagaatctgccttatgcaagagctgatagacacagacagacatgcagggtgctgggagagccttgggtccaatcagtcaagtcatcaagtctgggacaaggagcatataattgaacccaactcaaggctaaactcaagttccaggaatgccagaaaatccttatccccaagaagcaagccttcatcaaattcagtttaactgttagtttgagtcatggtggcagaataacacttggttggttatgaagtcaaaaataatcccaaacgtggtctcttggataagagctggaaccctgggtcatgagggaactgatgtgtattctctttctagggaactccttgggctggtttcatctacttaaaaccataaccactggtaatctctctattctctctcatacacacacacatgtatgcttgtacacacacacacacacacacacatatagattcttactaaaggatatttgttgcagacactcagagaatctccagagaaacctggcttagaggccgtggattcagggacatcgctgaagccctgtgctggtggaattcccactactgatatcttgggccaggaactgcattctgggaaccagcactgggtatgggatgctattgcagggatctctgcctttgttatctctggaagctggacattcctactgctcctctctctgggatagattctgtgtgggaactagaggaaaagtctcacacagatatgactgaatggtggaccctaggccacacgcctctgccctctctgcaaaagcttctaggaaagaaagttttaagcttctgccacaacgtgggtaaacgcttcaaacaaaagaagggtacacagagaagcagagtgataaagagggattttacagtgcccattatacctctgaagacagctttttgggattaggttcaaggcatctagggcctttatccagtgttttttctacttttcccctctttttaaattaacctcaagtttcttccatatcctttatgttcttgagccctcaacacacacacacgcacacacacacgtcaatttctccccactaccagtccctcaggaagggcttagcttagtcataaaaatgaaacccaaattattagcaaagcaaaatctgcttctctctttcctagagagaaggaatccttcagttctcaaaaacacatggtagatagtttaaaaaaaaattgagaaagaatttgagttgaacaattcatattataatacaaagttaacttcagaccatttaataatcaaaattgcaaacaaattggtttgaattgcagcaagacagctttctggttttcaggcttgtggcaacatggaattcctttcctggaggtctttagggaattggctggatctaccaagtgggctggcataattatgtcatctttgggtgtggagatagagaagtggatcaaataaatggcgttcacatgtccctgctagccttgcttgaatactgttagtgtgtagtacccacatctaggagatggcggtgcaacgctaaacattccagcgaggacagactcacaagtgctcgcatgtctggcgggagaggcagaggtagctggaaccaggaacaaaggactgagtctggggttgggttaactactgcttattttattttatttatttgttttggtacagagtctcattctattgcccaggctggagcgcagtggtgtgatctcagctcactgcagcctccgcctcccgggttcaagtgattctcttgcctcagcctcctgaatagctgggactacaggcgctcaccaccatgcctggctaatctttgtatttttagtagagacagggtttcatcatgttggtcaggctgatctcgaactcctgaccttgtgatccgcccacctcagcctcccaaaatgctgggattacaggcgtgagccactgtgccgggccctactgcttattttatccccaatccaaccccaataagttttgcgattgctagagaccccgaaattgccagagtagttgaggagtactctaacattttctctgactcttagttaaacattggcaacttttccgagactataaatttgactggggcccagtcatttctctctttgtagtctgtgaaaattaactgagtctgcaggggctgcaatcaccgccaaaaaccgcaagtgtgggctgttcctccacactgacaaaaataacagctaattaggctgcaacaccccaaggaaagtgaacttacgccaccaatcgcaggatggcatgcaaaacgtcgccatggcaaccggcatttacagctcttcaattttaatatatcaaaggctaagggtaatttcccagcgagaatacaggagggtggatttctcccctctttattctttctgccggtcttttgccagtactgtgagtacggaagctctattcctgtggcaacaggttttaaaggaagagagccttgtgaaagcatgaaacacctggcgtgggactcctggaaatgctgggtgcctcgggaggcgcagggagaaaggcatggcattcttcttagagtctaggctgggtgaacagagctgagaggaggtgaagtgtgagctgtgaacttttgccctcaattgcaggtgaactttctgtttgcataaaaatgttttcttttctcccctctttcccctcctctgcccttccctcccctcccctctcctctctcctctcctctcccctctcctctcccctctcctctcctctcctctcctctccccgctcctcccctccacgctcctccccgctcctcccctccacgttcctcccctcccctctcctccccgctcctcccctccccgctcctcccctcccgtcccctcccctcccctcccctctcctcccatcacctcccctcccctctcctcccatcccctctcctcccatcccctcccctcccctttcctcccatcccctccccttcccctcccctcccttcccctcccctttcctcccctcccttcccctcccctttcctcccctctcttcccctcccctccactcccctcccctccccttttctcttgttggccctccctttcttcctccctcccttcttccttttttacctccctccccctttgcttttcccccccttccctccctccttccttttttccctccctccctccctgccttctggttttgttgagtgcttactctgcatcaggcacccaataggcatcgtctcatgtattcttcatcactacattgtaagataaacactattcttattttagagatgaggacattgggatgacgagtcctaatctcacagtaagttgtagagcctggatttaagccaagtcagacctcacaacccaggacccttgtagtttgtgtctcctctgtgttactaaaacttactctgtaaaaatggaggtggatatatttattaaagtcactgccatcaccatcatgagttggtcagtgctgcataacaaacacccacacaatcttagtggcatgcagtgaataagcatctactttgctgcaggataggatgactctgtgattattctgggactcaggctgaagggaaagtgcttctcacggtgatgatgttagtcactagagggtatgcccaaccacataagtgcatttcaaatctatcccatgtcatatctgctaatatcccattggccaaagcaagtcacgaagttgagcccaaagtcaagaattgggaaagcataccctcccttttgttgaagtaattgcaaatttttatagtaagggtgtgaacacaaagagaggtaaagaattggggccccagaatcattctagttcagtaactgtctatcatcatcatcatcaacttcatgatctctgtgaaccaagcttctctttacctttgtctgtgtttaaataatgagtgatctctttataaagttcttcaaagaggacagtcattcgattgaagcaaaataataattattattgagcacatactatgtcccaggcactgcactggggctacatcagtgaacaaaacatcccatctcaaaataacttactgggaaccctaaagccctgtgctagacattgagaagcccgcaagaaattctaacacatgccaaaaccattctgaatatttcacagaagatgtctgtgcatcaaaatcacctgaggaacttgttaaacaccaagactttcagaacttgccaccaacaactctaggtcatagggttaactctcaacctatcccattgaaaaccttgccccaaactacagttgagttgtaggaaaagaaagttacaggaaataaactacacgtacaccctcttctttggctactccttgggcaacaggccttgattaaagtttccagtaaatctcttccagtccccagcccccattccaacagtgttagtgaaaccaggaagttggagccacatgtgatgaggaaagacacaggtcccctcttcctgtccctctagggaacctcggagagatgtggggctccagtcatattctggttgggagttggagacaatttcgttgaattctaaattaccagactctttagtgagcgtcaggatcatcatgatgactctagaagggaggtgttacgaattctattttggcagtcaaaaatgcaaacactgagagaaggatctcactgtgatcacatagctaatgactgagtccaaatcagagtccaggtgttctaaattcttaggtttctatcctaatagcagcactgcccatgagctcggtgagctggggcttattacttaatttgaccccagtttccacattttttaaaacggggagtggtgcacatagttatcagtaatttccagagttacatatatgcaaagtgctcagcagtgtacctggcacatgtaataaatttaaccaacaaaccccagtggtagcagcatttacctgtgattttgttatcaacagataacaaaaagtaattatctctttacagttgctagagacatctcaaaatagtattaatgctcatcacttcttcaaattcacactaatttcagacacaccattagttcttgttatttagtaaattaatgagggagcacacttggcaagaaacgaaacaaggagtcttctggggggatggaaagatttcccatttctttagaagtgtgagttacagaaccatatccatttgtcaaaattgttcagttcagaactgcagactcgcatgtaaattttccctacgttgaagacaatgaaaaaagggcaaatgatgttttctgcaagtttcaggaatctataaataaattgcaaggccatgtttaaacactttttttagagcactttatagttgttcaatcatcaacagtattgatatgccaatttcaatgcttttttccatcataatctgtttattatagcagatcttctaaaggtttcttaacagttactgcactagaacactagggcaaatttgtattgtaaatgtaaattttgcatatattggagatttcaacatcttaaagaatggtaggatattgatgatcgtggaaggtgggaaatgggtgcatgggttcattatactattctatttattctttttatgttggatgttttccatgatgaatttttaaagatatttttaatgataaatttttaaaagaacctcatatattagtttatcacaacttaaaaatattgtgataactgtagttcaatataattggtttttttctgagttactatgcattttactttatgcatagtaaaaacccactttttctgagatgagatccctaggcttcaccagacaactgaagatttccttgacactaaaatatttaagatctcttctcccttttcatgctttccctgagcatgagttttcagcttgcttcagaatcacagtcttacacatttgcagagagctttacagtttacaaagtcttttcccccatcttcacgcgtcatctgcctagctgtggggacttgcagatggtacctaggactaaagatcaagtttccaaaagttgttcctttggaaaatgagggatttaccagaaatgctgataatcccagtatctgaacctaataagcaatctgtgagattaattagataagaggtggtcagttttactttgagaatgatctgaaaaataggcatttttaaaattaacaaaaacaatttctttgcatgtgctgaagatctacgtttgtaaacctcaaaatcttgaaaacacctcacttgttcagaaacaaatcaagattaaggaaaattttgaattatgaaatatattgaattatgaaatacgttatttcttttaggtccaaccagacattctaactaagctaacagaatgttgccctagaggtctagtgtagtaactttttttttttttttttttttttttttgagacggagtctcgctgtgtcgcccaggctggagtgcagtggtgcgatctcagctcactgcaagctctgcctcccgggttcatgccattctcctgcctcagcctcccaagtagctggggctacaggcccccgccaccatgcctggctaattttttgtatttttagtagagatgggatttcaccgtgttagccagccagtacagtctcgatctcctgactcatgatccacccgcctcggcctcccaaagtgttgggattacaggtgtgagccactgcgcccagcctagagcagtaactattaagaaacctttaagccaggtgcagtggctcacgcttgtaatcccagcacttagggaggccaaagtgggtggatcacttgaggtcagcagttcgagaccagccgggccaatgtggtgaaacccatctctactaaaaatacaaaaattggttgggtgttatggcccattcctgtagccccagctacttgggaggctgaggcagaggaatctcttgaacctgggaggtggaggttgcagtgagccgagatcgcgccattgcactccagcctgggcaacagagtgagactccatctcaaaaacaaacaaacaaacaaaaacaaaaacctttttttaacctgctataatgaacagatcatgatagaaaaaaaagcgttgaaattggcacgtcaatgctgttgacaattgaacaactataaagtgctctaaaaaagtttgtttaaacaatctcttgcaatttatttatatattcccgaaagttgcagaaaacattatttgcccatttttcacagtcttgtttgatatgtgtccctagcatttagtgaaacagctagtacaggtatatgctccataaatattgactacattcacgaatgaatggaaatttttggaaaggcaaatcccaattctggaatagctcagatggttcatagagtcagaatctgtgagttttccccgatttataggcagctctgcagaggggtggggcagatctggaataaacagaaaagcagcagatgaaaaggccattcttgttgcaatgacgcattggcaccatgcgattatttgttttctctaatacaatgtgaaaagtgctaatgggattagccttttgtgatgaatgctaatatgatatgaaaacaaatgctaatatgcaatgtgaaattgctaacaaaggagaaaattgctaataaaattcaatggacctcaatgacaaatgcttcatacatctccctcatctggccagggctgtctcatagcacagaaatgaaagtgaactggggagaaatgctagcctacgcgttgcttggtgagatgtggatttcagtcacttcctctgaaatgacctctgtgtgggtggggacaggagagaaggtacacgttggacacacacaaacatacacacacacacacacgagctccaagggctgaaggctccagctagaaggtatccgtacggaagctacaacatgccccatttctgtttttgtattaggcctttgaacttttccagaatgctctcctatcttttgcactgattggccttactgtaacctgtgcaattggttgggcagacacttagattctcaatcccccaaatggaaaagcagccacagagagaatggacttgcttatggccactaaaatagcagtgccagaactagattccacgtcttgggtccttcccttccctgcccaacttgccatttcatcctctccctccgtctcctcccctccattttccttactcatctccttcctctccatcactccctttcttctctttctcttcccttccccctttaccttctccaccccccatcatccacctctttcctctccctcttctcttttttctacttctcctctgtctctttgccatatccttctccatcttctctttctccaaaactgttggttcttgtcattattgtccaagggtcattggtataccagcaaaagctagtgattgtgaaaaaggactttggttggggagcagcccactttggagtgaaagttagagtaagaacctggctcagctactcacaaattctctgaagatgcataacttctctgagccttggttttcccatccgcaaaatgggttttttcaaagggtgggtgtgaatggttaatatgacaatgtgaactaaaattgtgactattcagaagtggtcatgtgtgcgggagaatactgggagggaatattgaaaagctagaaataggttattagggtgatttttttttcttcaacaatgtcctttattaatgtttcgtgatatttttatgattttcaacactttcaggcacaatgtcttcttttccttttgatatttattaaatggtttattttaaattattgtggctgggcgcggtggctcacacctgtaaatcccagcactttaggaggctgaggcgggtggatcatgaggtcaggagttcaagactagtctggccaacgtggtgaaaccccgtctctactaaaagtacaaaaaaattagctggttgcagtggcaggcacctgtaatcccaattacttgggaggctgaggcgagagaatcacttgaacttgggggaaggaggttgcagtgagccgagatggtgccactgcactccagcctgggtgacagagtgagactccatctcaaaaaaaaaataaataaaataaaataaattattgtggatcataattgaacatatttatgtggtgcatatgatattttgatacaggtaaattaatattttgtgacatctctttagtatcctgaaataaaattcatagattatataactcacagacacacataatttcataaaaatttaatgctctaatggtattataaaggaggtggaaggaaagtaatttatataaaataagtattttagtatgcaaatacttggccatgaacatagaagacatgctgaggtaggtagatgcttgtacctatattgggaatcaccataaatgggagagccacagaagcccactgatgcggatgtgttttattgataactatagtaccatatgtggctttgccagcagtggtgttgttttctgaattgatgcgcaacagctcgtcaggttctgaataacaaagtgaaatttacaattgaatcccagacctagaagtttcgttgtaaattaagaccgtgaaaaataactttgtgtttatgggaaaaattgagtttataagtaggtttttcatctacctgagtgtccagaatggcatttgaaagttaactaggatatggggcaattctgcatgggctgaggttgtcctctctaccacacggacctgaccctctaaatgcctgtagtgaccccctcctaccattttggcaacaaaaagcaacctcatacatttctaaaacgcctcctggggaggtaggatcttccctgctgagaccacagctatatttaaataataataataataataataataataataataataataataataaagcaaccaaagagaaaaccatcctctgctttgggcagtctttgacaagctctcggcttttttctctcccgcctccctctctctcgttgaggctaaaagtaaatgagaatggtggcactgatcccacatctagaaaattgaaaaagaattcatttttttttaatcatcaaacctgacagattaggcatgtctctcctgtcacatttctgtctgtcctcagagttgttgaacggaatctttccacggatccatgttattgctaataggatttgtctcagagtaagcattcagcctccccttgtttcctgagaccacagtggacactttcctcttctccctaagcccaaccttcattgtatttcagctaataaaataatttcctgccagatggtgggggaaaacatagcccctgggagaaatgatgttgctgtcatgaaagattggactggtcatgatgcatttggattaaagccagcctttccgaaggtgagattggcagttgggtttgcaacaggcagtcccatctgggcaaagtagacactccaggacatcagatctcgccggtggcaagtgggatttatttcatgcaatgggtccatgtaagtcttttcccacatcagtgttgtgtctgcttcagagttggggggattttcgtaggacttggaatttcaaagggaaaacatttggctcaagttagaatttaaggttcttcgggaaaaaaaatttctattcagtcctgtgatcccagccccagcctggaggaggcagaacccttcattccaagccattttcctgaattatattatcttctaagtttctttcaattccttatttgagactttagactaggtttcctgttctttagagtcttgaaggaaggtacagttaaggactattcctctctcctcaactttctccaaagtattgtcttgcaagagttcccatgattacttctaaccacttaaatgtttattaaaggcaatcaatcacttcaaagcaaaaatcttagatctcagtgaaatgaggttccttttgttccccatgacattctgctctatttcctctaggactcaatgttacacaaatcctgccactcatccttgaaccacaacttaatcactcatgcaaaaattaagattcgatcacttgtgtagaaattaaactgaccttttcctttacctgtaaaatagaggcaatactagcattttcccttaggagaattgtgaggattaaataagattcaggtgtacaatgctcattgcagtgcctggctaataacaagccctcagtaaactgtcgatctagcttcatgttaaacctgtgcaggaaatctcatcttcactcaactcttgggctccaagcatcctagtccaaaagttgccccagccaaaacttaggattcttctcttttgcttatgctctgtgcatctaactcattggtaagtgcagtgagctctatctaaaaaaaagtctgagtccatttctgtttcctgatctctaccaccaccaacatccactttcctcctccaccttccattatcttggctgtggcaattacatcctaattgatctttctattttgactcatggctttttaaaatccattttcttcattgcagctgagtcatcttaatttttttttaaatttaagttctgaatgtgcaggtttgtttttaatttaagtgcattatgtgcaggtttgttacataggtatatatgtgccatggtggtttgctgcacctatcaacccatcatctaagttttaagccccatatgcattaggtatttgtctcaatgttctccctcccctttccccccacccccgacaggccctggtatgtgatgttcccctccctgtgtccatgtgttctcattgttcaactcccacttatgagtgagaacatgaagtgtttggttttctgttcctgtgttagtttgctgagaatgatggtttccagcttcgtctgtgtccctgcaaaggacatgaactcattctttttatggctgcatagtattccatggtatatatgtgccacattttctttatccagtctatcattgatgggcatttgggttggtttcaagtctttgctattataaataatgctgcaatagtcatcttttaaaaattgaacttttgtcacttctttctttaaaactaccagcggctccccatgcctcttagaaataaatttagactctgtacccaaattttcatgatttcatgtgatcagatccctgcccatatctacaatctcatcttgtgcttttccttttcttcatcacgttcctgctacactgctcctctgtaagagactcatttctccctccagactttgaacttggatttgtgaacccagaattatctgagacaggtctcaatcaatttagaaagtttattttgccaaggttaaggacacactgtgacacagcctctggagatcttgatgacatgtgcccaaggtagtcaggatacgggttgtgttcatagattttagggagacatgagacatcaatcaatacatgtaagatgcacctttgttctatctggaaaggtgggacaactcgaagcagaggtttcccagtcatagatagacttaaagattttctgattggcaattggttgaaagagttattatctaaatacaaaggaatgtctggggtacaataatgggttgtggagaccaaagctgtatcatgcagatgaagcttccaggtagcaggcttctgggagaatagattgtaaatgtttcttatcagacttaaggtcggtgttgatgttaatgctggtcagcttttcctgagttccaactggcctttccattatggcctgaactagtttttcaagttaactttggattgcccttggccaagaggagggatctgttcagatggttggggggcttagaattttatttttcatttacaagttctttcagcctaggaggactttcctttggatcctcctgtggctggtttattgtcatattctgccttagcaaaattgttacctcctcaggccttctctgcccacctacctatagtctcatgtagctatagagtgacaggcatcctgctatagtcacttgtaaggtgatcatataatttattattcaacctggagcacttataaggggtaaaaggggacttttactccaattcagccaggatggtgggtttaaagcaggatagtcctggatgaattgagatgtggtcagccttcctgtttatcattcacaccttctctatatcaccatgctttattatctccatagcccttgtcgttagctgatatttttatttatgtcacaggtcaaaccccaaaattggggttcagtccagaagaccacatgggctcttggcttcacacaggaaggaattcaagagccagtagatagttaagtgaaagcaagtttattaagaaagtaaaggcacaaaaggacggctactccacaggcagagcagtgatatgggctgctcaactgagcatacttatggttatttcttgattatatgctaaacaaagggtggattattcatgagttttgtgaaaggactagggaattcctagaactgagggttcctccccttttcagactacttagggtaacttctagacatcgtcatggcatttgtaagctgtcgtagtgctggtgggagtgtcttttagcatgctaatgcattctaattcacgtataagcagtggggacgaccagaggtcacttttgtctccatcttggatttggcaagtgttggctggcttctttactgtatgctgttttatcagcagggtctttatgacctgtatcttgtgataccagtcctgctgacctcctatctcatcctgtgactaagaatgcctaacctcctgggaatgcagcccagcaggtctcattctcattttacctagcccctattcaagatggagtcactctggttagagcacctctgaaaaagcaggaaattgctggaattgagggttcctccccctttcagaccatatagggtaacttccagatgttgccggggcatttgaaaactgtcatggcgctggtgggagttttctttggtatgctaatgcattttaattactgtataatgagcagtgaggatgaccagaggtcactttcatcacatttctttctttcatcaccatcttggtattggtgggttttggccagcttctgtggtgcatcctgttttatccgcggggtccttgtgacctgtatcttgtgaaaccagtcctactgacctcctgtctcatttacatacttgttatctcttggcttaatgtaaactttaagaggaggaggatattgtctctctggttcaccattaaatcttcatcttcttgaatatgtttagcaggtggtagagattctataagtatctgtggaataaaatatgttgaatgtcaggtcctttgattgttgtaggttaggtagctatggattagttttccttgctacacctcttttgtcattttgaatggtgactcgtaaagcctgtctttctgtgctgatcaggaatcatgttcttttccagaccaggagattccaaccaaaggtagcttgtggagcaaatagggcttctctgaagtttcttacttccctttagtggcccccttgtttgaattaggtttgataagcacaaagaaggaaatagttccaggagtaagagacacttactcagcctgcatagaagacgtcatagtttcccagcagtcagggccataaaataagtggtctccctgcttatggactggaaatgccaaaaatgcaatgttgaaaataataccgcaggatcactgaattaattattgtgggtcctgattgtgtaaaatctgattattgtggagtggggattggattgcatgttaatatttaagtcctttggaaatggcactgaaggaagaaccctcccatactgtttggttcctccagcccatcccccatgagacaggatttcttgggacccgaacagaaatcaccttatcacatcagcacagattgcaggcagggcttgcacttgcactatttgcatttgtataaagaaagggcctggtattatgtaactgcatgtgggttctgagggcttctaatgggcctccttttgtacagtctcttagcaaccaattgaagtttgtaagctgaaacaaagagactggagtccatcactcctttagcacattcctctgagtctggcctgcctctaagagagccagcctagtggaggcataccttttcttccttgccaaagctcagcaatccttgttcaatcattgcttcaccttaggaaggaaaggagttgagagttggggagataggctagggactagttgtgttgtgcttagaacttcaacttagtcaagtaaagtctttaaggcaactgacctgcactcattcattcttaaaagaggcaatgttacttgacagttaagagtgttctttagggtcagaaggaatcctggctctgccactcaacagctgcatgtccttggacaaattacattatatttctgggcttcagtttcttcattttgttatgcacgaacaaaaaaatgtacccttctcattggttcactgaaagtattaaggcacgttattaatgtaaacaaatattcagggttggggttccctatgtgtccagtactgtccttggtgctgaaggcactgaagtaaatgtaacaggcaaaaattccctgctcatatatgcaaggataacactatggagggagatagaaaagctgatggtattaatgacagcatcatggaagatctcactgaaaatgtgaccactgagcaagacttgaaacacaatcccaagtgaaggccttaacatggtgcacaaaggttgtaaatgctaagtacatgttagcttttatttaatttattcactaattaatgtcgttattcatctacttatttattcatctggctaattctgaattacttactcatccacctgtccattcatccatccacccattcattctttcatctgacattacctgaaggatatgaataatattatttctatattcaacataccaagtgccataataaaggcagatgtagatgaggtttagagcaaaatttcttagcttcagcactactatcatacctggtcatatgattctttgtgtgtgtaggaggggttgtcctgtgaattataggatgttgacagcatccctagcttctgttcactagattcccatagtactcccaagccgtgacaaccaaatatgtctccaaacattgccaagtgtcccatgggtagtggggtggcggcgggggaggaattgtcttcagttgagaatcccacatttagaggaacacctttctcaggaaggaaaattaatctactgcatttctctagaaaggaaatgaatctaagactttaatttcagtagaaataatagcattttccaacattttgtttcttagaggcatattttcttgtgctgaaaagcagaagggacttggggactatttgaaattgaaaacagaatcttaccccacaggaactctttgcattgcctttgagaattgtggctcattcaaaaaacatctccaaggcttaccgaagaagtggttacaacagggaaatcttcactaacctgaaggaatgcaggctcatgcttggtgcctttggaattcttgcctgattttattgatgactccacaactacaaagctcagcccaagattcctcaatggaataacaaacagcaagactttctctctaaagaattctgttgagagcagccacgtgacttgattccttggaaaaagaaccatgccttacagggtatcatgtcgaggccagagcagccatctctgcctaagggcacctttccaggtcaatctcttccaaggacagctcctgactactaggaaggtaacttaacttgcccggtttctcactgccctgcatatatctattcctggagacatctatggtgcaagcaagttgtctggaaatcctgcagtgtcttaagcagctcttgaattttaccatttccccccattcccactgtatctcttctttcctcctctcccatcctggtcaatcaagtcccatttggtcaatcacggtagctgaataactgttcacctcattcctatggagggttgctcacttccacctgtcctctgcacagtagagttcagtcttttcactaaacacagacttcagtgccagctccgagtcctggcctgcagggtaatgcatgatctgcccttctctccaacttccacaccaaccgctctcccttcgtgctcaatctgcttttgtccccccagcctccttagctcatttacactttaagacgccaatagggttatcttatcccctcccagcaccccccaacaccagtcaaatctttgctggtagcccattgttttgtggctgagaatcctaacaaggcttccaagtccaccactgtctggttcttgtctactgtaacaccatcttccactatctcccatccctgtggtccagctgctgtgtctcctctgcccctcatgtgcacagggctcttcccacactagggcctttgctcatgtgactatctccactctagaagctcttcccttccctgcatgctgtttaagccttcaccatgtatcaaagctcagattcagcctctatttctcatgaagacttctcttacctccctgacaagttcctgtgccctgattatacattcttatagcattatattctctcattcactgcttcctagttgcaattttatatttatttacaagcttattatattatcagctctcatctatccagtttctaagcacctcaagaaatgggaccatatttgttatgttaccattttgaacttagtataaagtgcctgacacatagtaggcactgagtaaatattatatagttgggaaattgaataaatacaccccagcactcctcaactacgaagacttatgtttgcaaaattaggctaacgtgagcttttctggagccatgggggaagggttgaggatggaatagactagagaatttgtaactggggaggtatgagggcaggtcagcatcaggaaattacatcacttgacattttcttactcccttttgtgtctgtaccttcatcttatattatccaatattacaagccccttgaatgtaggcatagagccttttatttctaaaactacagtgagcacctagcccacgacctggcatatagtaggtgcttaacaaagctgcactgaatgaatagatgccacgcattctagatttaatacagaccttaccatctaagctgaggttcattcaggagggactgggaaaggaatgtgaaggctcatgattgttatttatttatttatgagatggagtttcactctgttgcccaggctggagtgcagtggcacgatcttggctcactgcaacctctgcctcccgaattcaagcaattctcctgcctcagcctccggagtagctaggattatcggcatgtaccaccatgcccggctaatttttgtatttttagtagagatggggtttcaccatgttggccaggctggtctcgaactcctgacctcaggtgattagcctgcgttggcctcccaaagtgctgggattacaggcgtgagccactgcggccgatcgttatttatttattcatttatttgagacagggtctggctctgttgcccaggctggagtgcagtggtgtgttcatatctctctgtaccttcaaacgcccggtctcaaatgatcctcccacctcagcctcccgagttgctgggagtacaagcgtgcaccaccgtgcctggctaatttttaatttttttttttttttttttttgtagagacagggtcttagtatgttgcccaggctggtctcaaattcctgacctgacctcaagtgatcctcctgccttagcctcccaaagtgttgggattacaggtgtgagccaccgtgcccagccaagatggttatttattaggaaaacatggtacattgaagtttttcacaaaacatacgacagaaagagcctggatagtttttctttttaagctaacatttatcaagaacatatttttttttttgccagccctgtgataaacgcattatatgcattatctagttaatttgtagatgctgctaaatttgcagatgaggaaactggggcttggagacattcacttatcagtctaaggccagagaatagtggcaaaattagcattcaaacttgggcctgattttaaaattcatgggcttagcaagtttgctacaaggactcttgcgctaactctgggttcataaatgagtcatccaacaccttttgccttcatgccctcacccattggatagatgaatccattcctactcacatctcaaggctaaatgaaagaacgcgtgtttgtgaacaggcatcagaatacatataactggaaggggtgccataattcatttattgtgttctggctccccaccagcctaacagggcctgttattatgtgacctcccattgcttaagcctctgataagacagtaagtctgtatacaaggtgaccatgaactgctacctgctttccaattgctgttggaagagctccttataccttacgaggctaagaagatagaagaggtatttcgctctggttttgagcaatttgttctactctgtgaacttctgtgtctgcttatccagtttcatgaaaattagattaacgagtactaattggtgctgactccgctagcttaaaatggatggtgtcaaatggaagaggagcccaccagtgtgatgtttggatcccaaagctgctgggaattaagtttctgcatggatgtcgatatcataggttacttgtggcagcttgctccaagctacttttatggaacacagtgtcacccccacagatctttgaaaggaggaaggatgctttttccaaagaggatttgcttcagatgatttggtcaaaatgctcattcattcgaggaatcttttttgagcacctattagatgccaggctctgttttggactcaggggtaccagtggtgaataaaacaggcaaagttccatccacattaagcatacattctacctaaggttggtagacaataatgaagtaaatatataatgtcaagcagcatttccatctgatacttgtatattgattaaatatgagataaacacatattttaaaaatgctttgttgagatataattcatataccatagaattcatccattgaaaatatacaaatcagtgggttttggtatattgagttgtgtaattatcaccacagtcaattttataacattttcatcactccaaaaagaaactcagcaatctttagttatcaccctcctataccccataccctacctccagtcctagacaaccacaaatctactttatatatagatttgtctattctggatagagaaaatatcatcttttgagagtgaggaggcatgggaggagactttactgtcctcacctcccagatgaggcattttggatttagttttccttggagctccctctaagatccagacttttaatcgcttcacaggctcagtttctgggggatagtaggggtgctggccagtgtcctgatacagatcctcttttttaccactttacctttcacctctaagtcctacttgagataacaggtgcagagccagtcagcaactgagagtaaatatgcatatatggaaacagaagacactccagtcagctgtgcagtcacatctccaagcaataaataagcacatcatgtttatagaagcctcactgtagtccaaattactgtaatctcttacctggactgttttagtagcctggtctccggtctccccatgtttcatcttgcctctctttcagcctgttcttcccaagataccacaataaatgtttcaaagtgtgaatctgtccatgtcactctcatgctgatgaaaatcccacatagtcctcaaggtagtcaaggctttcctttatagcccctgagggcctgcaaaacctgatccctggaagcctttccggcatcatctgtcactattcttcctccagtgtctaaatcacttttaattcctgcgaagtgtcacataatctctagccggcctttgccctctctggaacattctttcctacctgcattgcctgactagcttccatatgcccttcaggtcctagattagagatgacttcctttagtgggaggccttccttgtttcttcaggatgtggttaggtacctgtattagctttctactgctgcttaacaaatcaccccaaacttaacaccttaaaacaacaaacatttcacattttctgtgggtcaggaattcaggagtggtttagttgtatgcttctggatcaaggtctctcatgagttgtagtcatggtgttggccagagctgctgtcatctgaaagcttgactggggctggagggtctgccttgaagatggtacattcccatgggtgttggcagagggcctcagttcctcatctcgtgggcctcttcataggactatttaatgcccttacaacctgacagttgacttctcccgtgataaggtttgtgtgtccccacccaaatctcatctccaattgtagctcccataattgccacatgtcatgggagggacctagtgggaggtaattgaatcatggggacagtttcccccatactgttcttgtggcagtgaataagtctcatgagatctgatttttttttttttttttttttcctgagatgaagtctcactctgtcactcaggccatagtgcggtggcacgatctcagctcactgccacttccgcctcctaggttcaaacgattctcctgactcagtctcccaagtagctgggattacaggtgtgtgccaccacgcccagctaatttttatatttttagtagagacggggttttgccatgttggctaggctggtctcaaactcctgacctcaggtgatcagcccgcctcagcctcccaaagtgctgggattacacatatgagccaccgcgcctcgccaatctgatggttttataaaggggagttcccctgcacaagctttctcttgcctgctgccatgtaaggtgtccctttgctcttcctttgtcttctgccatgattgtgaggcctccccagccgtgtggagctgtgagtccattaaacccccttcctttataaattacccagttttgggtatgtctttattagcagtgtgagagcagactaatacaccccagaatgatcaattcaagaaagagttgggggaagctgcaatgccttgtatgccctggcctctgaagtcacacacttctatcgtaatctatttgttagaagcaattccagtcaatccatctcacatttaagggggaagaaaactatgctctacccattgaaagaaggagtttcaaagaattggtgaacattagtgacccttgtatcctgtccttacagttcctgcacttacccctaaattagctgttagcacactgagttgtcattgtctatctctttgaccatgagttcttcaaggatgaagacttacttcctttcacaatatttagaatatttctaaattctgtcacagttccttaaatactgtttagtaaccacttatttggtgaatcaatgacctgttctagatgcctgaaaggtatagatcagtgcttctcaaacattaatgggcatccctgcaaatcacccaggtgtcttgctaaaatgaggattttgattcagtaggtctggggtacagcccgagactgttttcctaacaagctccaaggggatgctgtgctccatggagcacactttgagtgggttagggtttagaagatatgatcccatttctagataagcttcataacccaactgggaagacacacttcccccagtagggcagcccaaggctggccatgaagtagtgtcagcctagtcatgggcaaacctgcagtatactggactcgctttccctccagcagccctgattgattgaagagatgtcagtgaaggacagtcaaggaagggtctgtgtgatataggaagccttccaagtaggcagcatattgtcatttggctctggaaggtagagctgggcgggggccactcatgtatatgccaaggggttgcatagcgtgagcaagggtggagggaggctgagtcaactccttgggggggatctgaaagaaagctggggttgagtggtggcaggtgatggagtccccatctacacctcagagaactcatgagcccagactgtctgctgtggttgaagcactacttttgctggaggaaaagggttagactatgaaacgtatttgtactattcctgccagttcttgagatatgtgattctaaggctcatattttagagaaaattgagcaaatccagatgttttctgttcataccctgaatctcaccttcatccttgctgttctgattttaccaaggtgaggcacgtgtgtgtgtgagtgtgtgtgtgtgtgtgtgtgtgtgagagagagagagagagagagaaatctgtcatctcaagtggggcattgtcttcttatcacatgaagggccaatgtaagcgtagggtaataataataatccccaatgtttggggaaaggtttcacatccatttagtctagtggtgctcagctgtaactgcacattggaaacccctgtgagctttaaaaattactgatgccagcagggcgcagtggctcacgcctgtaatcccagcactttgggatgccgaggcgggaggatcacctgaaagaacagcctgaccaacatggtgaaaccctgtctctacaaaaatacaaaaattagccgggcatgatggtgggtgcctgtaatcccggctactcaggaggctgagtgggaagaatcgctcaaacccaggaggcagtgagctaagatcacaccattgagctccagcctggacaacagaggaagactcagtctcaaaacaaacaacagaacacctactgatgcctgggttccacctccagagattctgatttaatgggtctagagtgtaagttgggcatcagaatgtttaaaaccttcccaggtgatgctactgtgtggccatggttgagagccactagtttaatcttagatgaacccttcactaataaaggtaagggttcatgtaagattaaactagtggttctcaacaactagataagatgacctgtctttttttatttttaaagaaatgaaaaaattgtttttcagcaagttgagtgactgcttgaaattcatacaaccaataagtaggaaggtcagaactcaaactcaagttagttggttagtgctcgttcaatttgcattaccaatgttgcctccaggtagctagtattatgcacatgacaaaggaagagaacttgaatttagatatctggttaaaggtcagactttgagttagggtgtagttagggctctatatttgtttttctgttttttgttgttgttgtttgttttttttactataaatcagtttattgtggttcaaatagataaactgacattcaaacatcttaaactttaggaacaaaagtttaacatttaaacagaagtacagttttcaggaaacatccagaaaataatttgttatctaatccagagtactgacaaagatttcttcatgataaataaagtgtgtttcaccagcagattttttttcttttttttttcattccttcataaaaatcactggcagtttgattcagaccaacttcctaatgactgtggctctgtaccttagaggaaactgctaaataaatcccttaggttaaccaatgagattggcctataattcagagggtataagcaaagcatgtaagtgaacaaattaaattgttctttagagatgatgtaaaagcatgtccattacagtaattttcgcctctgacagattattcaattttcagtgttttacttttttctgggggtgggcagggggtgatgtgggagggaagggagggtcttgctctgttcccaggctgaagtgcagtgacatgttcatggctcactgcagcctcaacctcctgggttaaatgcaatcctcttacctccgcctcctgagtagctggaattacaggcacacactaccttgcccagctaattttttaatgttttatagaggcatggtcccactatgctgcccaggctgttctcaaacacctgggctcaagcaatcctcccacctcagcctcccgaaatatgtggattacttgtgtaagccactgtgcccagccttacctgctttaaaacacaaacaaacgagcaaaaaaaaaaacccaaaaaaaaaaacacttaggttttcttggagtctgtgctagttgcatcttgcaaatgcaaaccatataatgctctttaatgaaaacctttccatgcacaccactgttaggaagagcatcattaaatcactgccttctatacccataaaaggatgattttgagtttcaagttaaatttactagagatagcttgtatatatcaatcatgtcacaaaaaaatatttccaaagtgttctctgttcataaatgtcacaaatgcttctcctatttgtcagatcattttgcaacaggttaactaatacttatctacataaaaacctgaaaattggcacaggcaagcattttgaattagtagattacccccatggaacagtattcagacttactttgtcttgtgggctctgaggctctgggaggtagaggtggaccctgacagtccaggtcatcaacatccacattcagttgaagcctctcctcaggcacagtccagtactgaataccatttatcattctgcaaaatgttgtctacatctttcaggtgctggtcattcttagattagcttcttagctgttctgttgacgaacagaagacttcaattttcaggatggatgttccagcatcttccacaagctttcactttcacatttttcactaaattatttgttataaatttgatctccttcaaaagtcccctgaagtcaactttggttgtaatgtatttgtctctaacgtattcttcaaattctctttgttttttttcctgtcattggaggagaactgcacccagaatcttatttttactacttccacgtgaatgttaaggtacacacagaggtttcatccagaagtcttccctcttctttctgttaagtacttcaatgtgctcattaagcttctctttctcttccctttccaacaaagatctagattccaagtagtgatctttttgatgagtcctctatcaaactatgacacatgtgaagaacatacctgaacaaccctcagggataatgcaggattttttgagaaagttccagggtatctcctggtgtcagtgtactttcagtcctacacctcagagttttttctttttaataacagctttattgagatacaattcataccttacatttaaaatgtatgattcagtggatttgagtatattcagagttgtgcagcctacaccacaagctaactgtaggatattttcatcaccctgaaaaggaaccctacacccattagcagttactccattctacctacagccagcctaggcaaccactaatctttctgcttattctggacatttcatatgaatggaatcatcatgtgatattttgtgactggcttttttcacttaatgttttcaaggtttatccacgtttagcatatatcaatcctttgtttctttttagtgccaaataatggctatgggcatggggtagaattgctaaatcatacagcagctgtttcatctttcaaggaactgacagtctgttttctgaagttgctacaccattttacgttcccacccgcaatttctgtacatcttcaccaacagttactattatttctctttttaactacagccattctaatgaatgtgaatctcagggtttgttttgttttttgttttttgtttttgtttttgttttttttgagacagagtctcactctgtcacccaggctgaagtgcagtggcacgatctcagctcactgcaacctccacctcctgggctcaagtgactctcctgcctcagcctcccaagtaggcgggaccacaggcatgcaccaccacaccaggctaatttttgtatttttagtagagataaggtttcaccatgttggccaggctggtcttgaactcctgacctcaagtgatccacctaccttggcctcccaaagtactgagaccacaagcgtgagccactgtgcccggcctcatagtagttttgatttacacttccctaatgattgtgtccagcatctactggccatttgttagtggttttttcttctttaaaaaactgctgagacatccataaacattttcaaaatgcagggtatgtttttcagtgttaaggcaactgttttgatgtgttttcctttgctctctatcaccaaatactgtacatacaaatagtaagactgggctttgtgttgtccactgtcaatcctaaatgaaacaaaatacatggagactttgaaaatccgtcagaataatgctatagttaagattttgctaaagcaagtgttttttctaactccttgagctgcatattgccttgagtaatcatcaaccggattgtatcctcttcggtggcagttttgtttcttctgaattcttcccttgcccagtccttcaggtatttgcaatcagaatcatttggaacttgccaaattgtttgcaaaatccttctgtagaggagaagaatttgttgccttcttatgaacgtgggcactgggcagctgaggcaccgggactcagggacatcaagcgcctgatgcatctcatgcgaccgcaccaaaacccagggctctatatttctaatgtccctgtttgctcttctcctgtttctttgaagccaagtttgggccgatacccatattagattaataaatcctaggctccttgatgacaaaggtgatattactatctgctgatccaaaccatgaatagtcaaggttgaaaaatgaaattggcaggaagaagtgtactttattggacccaaccttgcaatgtcaatgttcttagttctgagaaattcttgctcctggaattcatccagtttcatctttggatacctgcaacctccctgctcacaactcattcttgattaaattagcagatgctgatgatagaatgagactgaggccagtgatgctaaaataatttcttgctggtgaaggaggccccagaggttttacaaaaaaatttttaaaagcaccacctagggaatagagccaaaatgctcagacactgcatggaagccagggattgtattaaatccgagtaattggagtggagagggagagtgttttgtagtaattgtcatcatagctggcaccagatctcctctcaggtaagaacatagaagcttggaacttacgagagaacttagctttccagtattttttaggtgtggaatgtgaagtcatgaggggggctggtctgcgaagagtcagcaaggtgaaaagagataacagagtgtcttgggaggtgcaggagagcagacagaacaggcagggaataaagagagggagatggaaacgtgtctggaagctggaaattgcccaggcaggtggccattgagagatttctaaaacttctgagaatgggggtatgtaatattctaaatcatttgaaatcttatgcaatcctttatctgaatgccttgatggaatctgctttctacatagctctacaattgtattttgaggaataaagggaccagggtacttattagggagaggtcatacagtgcagaaaggagaaaaaaaaaaaagaacttgcagaataaaggggtgatctgtaaaatgaaccaattcagtggaaatgagacccagggttgtagctgaagttgactccccaagaccctccaaagagattggggggcaatactgtgtctcccacagtttggggtgttttgaaaaaatctcatttaaatctctgaagtcaaggtgatgccactttgtcgcaaatggagtcttcaggaagatatccagtctgcaatagcaaatgtggaggccagactaaatggaacgcccctgaggaaattatggatgtagcagcagtccagttcacacgctcattcattcattcatcaaacactggcacaacatcttacattgtcaaggcatgtaatgtgtgccgagaatatagacactgtccttgccttcaaggaactttcacctttggagtgagaaggcgaaaataactgatatttactgagctctttctgtatgcagatactaggctatctatttcacaggctttgtctttttaaaattctcccagcagctttataggtaattattatcccctatacgtgtgtgtgtgtgtatatatatatatgtgtatatatatgtgtatatatatatgtatacatatgtgtatatacatatgtgtatatatatgtgtatatacatatatgtgtgtatatatatgtatatacatatatatgtgtatatatgtatatacatatatatgtgtgtgtatatatatgtatatacatatatatgtgtgtatatatatatgtgtgtgtgtgtgtatatatatatatatatatatatatatatatatatatatatggaatctgaggcccagagagattagggaatttgtctcaaatctgacttagctaatctatgataaaaaaacaaatgtttggacacaggattatctgacccttaagttgggggaggggttcttattttggtcagaggcaattgaaaattggcagtaggtggatcagtctggatgtgtaatttggaaaatattcccggtgtttttctggagtctcacctaatctgctctgatgcctaatagcccgtccgttaccagtgctttctaacacagggttagccattgctattctcatcagctctatgtttagaagcttaacgcatcgactcagcaagccacaaacaccgtatcatggatgcgctggctagcacgagcattctgtgggcctgctaaggggacggggcagtggagagcgcagtgtggagcctggaatactgatgctccagaaacgtggagagagatgccgctcttcatggcaggtacgcaggccttgcttcctgcagcaagttaaaatcatccaccatcattagcaaagggctgttacaagggcctttttaaagtgtcctgtgcccaggctacaaggagcaatccatcatgttccataagcataaacactccacagctaattaagtgagggtgaaatcatctgcaccatccatgtgatatttatttaaaatgatttgcttaagataggcccagagtccttctccttagggaggtatagaggaactgggaggagaaaatttgggcacttgaggagcagaaacgaattggactggcaagcggagaagccacctgggcctgcagttggctgtggcagtgaatggacatctgttgtttttgtctgttcgacaccatcctctcccgccggggatccatttctcttctactcctatcatgtaatggggatggggctgccaatcacagtttaccgtccaatgccctggtcgcaggggtcagcataccatccaggttcagccaatcgtagtgccttgtttgcctgatctgagtgataggtccagagttagagccagcccttttggcagtgaggacaaaggacgttgatatttttgtgttatggagttcaaaggacaagcagcaagaacttctggggccttctttatttaccatgtggaattagctgtctgtaggagataatatcaaacaaaggccagcaaaaatggaggaagagagggctgtgagtattggggctccagtttcagttcttgagtcccctgagtgctgtcctagttcttgtaatttgcgttttaattgttgtcttctaacgtttcataacttaatacattccccttctgattacacgtctgtgaattgggttactgttacttgaaagtgaaagaaccttgactaacatagatgtgaacatcaacaatcacatcttgggaacattttcttgcatggagctggcaccttaacatgttctgtatttggtgctgggtggcaattggactgtacacttacacgtctgaacttgaatggaccccaggtatcaataggccccattctcccatttatttggcagttgagggggctgagactcatcatggaagagagactcgccatgatcacacagcaaatcagtggcacaaccaaagctgtgaagggcctgggcctcttggttctcaggccagtactccctgtcagggttagggctgatgatgtttccaggcagagcagtggaacaaatgaactaactatgaatgcacaggatcaagagtctccaaaacatgtcaggccagccatacctcctttttgccccagctctaagtttccacccttacaacttgccaacaccaggtggactgaattattcttggtttggtctcatgctcagagacccagcctagaactcaactttcagcaccttggcagcaaggcctcaaagccaaccgtacaaaaagcctagatgttttcaacatcggtgtggtgtgacttcaaagcatggtcatctacgtatcccatggagccatgaaagaggcgggctggtgggggtgggtgcacttgctgagacaaagctttctactctcacttcacccagggcacccctcctaatcacccatttttaagtctttttttttttttaaatatatatatatgtggaggtttaaggtacactgcttgaaaaagcattccccttaaagaagaaaaaaaaaactcttaaaatcacgaatttaatgaacttaaacccagtaaataagcaggaaagaaattccaactgacccttcagtaggcccagaaacctcattattgaaggtaaaaaatcacagcttactttacaatgacccatattttgacaaatactatccatcaaatgatggttttaaagacagaatcttggacaaatggccccatgcccatattgttaattaattaagatatatggtctcattcacttgtccgttcactgaatattcactgagtgcccatacgctggactcactgtgctaaatactggaggtaccacagtgaataagataactgtgatccttactcctacgcagattttagaaatttattcttcccttgcaactgaactcattttttgaggaattatctccgggcagaggaaagggaagttggctgtaagatcaggctggaaagaggttttgacaaatgaatcttgggtccatccatctgtctaaatatggagtcagtcaccatctctcctgagccaagctcaaggaggctgaagctgacacagctctccatatatttgcccctctgtgtgtctaatggggagatatctagcctattttgttctagctgctaaaatcctatctgtgtctcagtgcctgtcttcctttaaggattttgaagggtgaattagaagcatctttacaacccaggcatctaggctcccaacccctgggcatagccctcagaaaccacatatatacataatagtgagctaacctcaggggtggaggaactggtcttcccagtgacttatgaaagtctcattggaagatgggaaactttggttctagacttgaccctgatgaccatgggtagcttcaggcaaatcccttcacctgtctggctctctactttaccgactgagtgaaggaaccaaaatgtggattttcccaaagaaacatttgaatttccatttctgattggattaattaaggtaaggctagcctgctgtaattgaaagtctcaggggcataacaaaatacatatttatttcttttcatgtcatagtcaataggggtgactctggtcaagcattcttttatgtggctatgcaggggctcagttaccttccaaactgtggctctgccttcctttaaggtagaggctgtgcaaagtttccaaaaagaccacctgaataggccaagtggatgaatgtacaaaatcaaggtgattcaaaacatctgagctggcaaatagggaaagattgagagaggagagactccagtgggaggttttagggaccagggctagaggtgccatgtacctattctacctacattccattggcctgagtcagtcacatggccatggctaagagcaaggcagtctggaagatgcagtctagctgttccattggcctggtcacatggtcacagctaagagcaaggcagtctgggaaatgtagtctctgtggtaaagaggaaaggaaaacacgtttgccaaccaaccaaccagttgggtataggaaactgcaactttccatggcagtcccttcttgttattctctactcagtacgggtttaaaaatcatatacttctgcctcaaccaggaggtacttataggaggttgttgctataatccagttagaagatgacagcagtttttatgagggaaatgtgtccacacacccaggttttcccaggataggccatttatgcctgcagtctcagcatcccatccacgtggtgcttcctttaactctcaaaagtatcccagtttggatgataaattatatagtcatcctatcttcaccatgcagatgacagaagagaatatgagattgtgtaaagatgcacaatgttgctgaaaagaagccacatatagtcactgttccataaaggcagtgtttttttaattttaaaattctgcatctgaaaacacagtatgacagaaagcatctatatacacctgcagtgtttttggtatgatacagtatttaatacatccactgttttctgcaaaaaatgttgctttgtcagacagaaacaaactcccctagacaaaaaaatacagctaaggcacaattttgttgttgttgttgttctgcaaaataaaaagacagaaaaggtgcaaaaaagggcaggtaatgcagtcatttctgagactcacattctacctcaaggaaaagcattcagatgattggaactttgattactggtcaatttcagatagttcaatatctcttaaaatactcctttaaataaatagcaaaatatctacatatttcagcgtgtgccatttgaattctttttttaaaactttatttacagattttttttaaaatcaacacattacaaaatatttctgtacagttttatgcatattatgatctataacaaaatagttatttttaaaaactatatcaccacatgtctttgaaaacaatgaaggggacggtaataacttagagtgaggcctctaaaacaaatacccaaacaaatgctattgacaacataatatttaaaaaaaaaaaaggcaaaaggactacaaagacaattgcgcacaattccagtgaatttcctatgaaaaccctggggttgtctttggcctccatcagcactggagcaatggaagggtaaagaatagagtctgaaggtagggaaagggtgattcctttgagaacactacccatctgctgggaatatttagtgctatcactttccaggcaggaaggacgaagagataaatggagaacgtctcctgatttacccttgaatgaagtacatataaagtcacccagtcttgggggcaggggaggtctgcaaagccttttcaagcactctgccgataattaagccagcccattacagcagcagtatgctctgagagagtgcttcaggagttggctgagctttagatgagcacccaagccttcattttgcccataggaaaaatataagaacatttttcttaaagacgacatttgtaagcaattcctatagcatctgccaactacagattggcagccccttccttaggaggctgccacagaagcttcacgatgctgtcttctctgatgttggtggagatgggagggaaaggatggatggtcagcttcccaaaaataatgttaaggccacatttcaaaaaggagaaacctaaggcttttgttttgttttgttttgtttttgaaggagggatgggagaagcaagttggaggaacatgagggatggagtagatgacgttagggagggggatgacaaggtgcagaacccgctttctggtggtatctgtaggcagaggcagttggaatattcccagccaagtggagagggaagagaggtcactttctccctgcatacgcctggtaagaccagagccaaagacaacgtgaggggtagacacaggtggcgcaagaaagccctcctccatcttaagagggtcctatacagtatcttgtttgcaaggtaaacacaaaacaaaacaaaacaaaacaaaaaaacttctaagagagccagagaggaagagagagaggagagagagaatttgcatagatcatacattcagctcaagcagatttggacaactttgttcccccctcccaggtaaacttctcagcagacacaatgaggtagcgcctgtggtagacccatgggcaaagtaaggtaactgaggcagaagcaaacaggacatcccgtgagccagcacagctctatgtggtttccaaagaggcttccagggatgggacaagatggctgtgtcaacacttgggatttggagagagcctggctgtttcacaccctacctcctcctcctcctagactgtctttgccatttcggcctggtttgatggagtcccacaagctgtagccccaggcagatgtggacctctgcatatctaaggggcagcagtccagatctccagattctattccttcttcccttcagcacaatcttgggaccaggagagctgaatgatccatcccccctctgtggaatggtctcttgaggagtggaatgacttagcaagaggtccccattccgagttcaacatgggctgttatttttgccctgacctgatgctggcttttttcctcttctaccagggcaatgcataatctcactttaaaccacctctccagagagcagaggttgctggcagtgtacacgtggaacagtggaatttttctttgcccactatctgttaaaaaaaacaaaaacaaacaaacaaacaacccgacgttgaaaaatcagattttttccattaaatctggatttccggcttcccttccaaattggaagattccactacactgtgcttacatttttacaaacaatgacaggttggggctgagtagcagctgctcattctgggtaggtcacgtgcatgccagtaagaccacagtccccatccttgcccccaccatgcccttttgcctcacaccaaccatttcacgcatctatgctagtattctgggccccataaacatttgtaacccctaccacagtgtgtggctttgatcctgcaggtctagcttgctgtctttaaagtggagtgtgttaacagctgtttctagaatgtacacctctccacccctagatgtacccctccacctgaatgtacacctctccacccctcgatactgctgggaagctggtgctccaaatcctcagtgaacttggttgtgaaaggactctttattcacaccccactgccagtagctactgccctgctctctgcatctttttggcagaaagcttaaggttctagccagtgtcttctgtgttatctgcaaactagagaaccagagggaaacatggtcttcagacaccctacttgtgcccagagtagaagcaattgcagtgagtgagagatgggggcaggtcctgtggttctgctcatcctctctaaactccatttgcgttttagaagttaaacccacaatgagaaatgaagccggaaggactcatgatctcaccaggaaagccttttttttcccctgcaaagggagaaagcagcgcgcttctcacaacacggggaccttgggaattgctcactgcctccttggagacacactgctttacgtgtggaccgggaagtgaagtgggatgtgggaaggctggctgtctcctgagctcaatttctgcctgaatgtcactcggtgggtgggaaactataaggagtgccgcagcctaaagaatgcttccttctccacaaaccaataccccaaggcccacctgtcagccttcctgagtttccagggacctcgtcactggctcagctcacagctgcaggctgtaataggtttccagagaccacagccctatgcttttgaaatcttccacagcccaagctccaggctgtctgaccaatggcctccaacaaataaataaatcattctcaggcaggttaaaaaaattattttccctgggaaaacatcctcttttctcaaatcatgctgggctttgtttgggattttccttaaaaaaaaaaacaaaacacaaaaacacaacaaatgtaatatctgcaaccttattctctggtctattaattaataacatcagagaagggagaggaataccctgtgtgacttctcagctccccgaattagttgtggtgaggaagaaatgaagccatgggaaaaagggaagggtccccagagtcagccagctctgccatttctccacttgttccaggataaaaacaaaaaaaggcagacatgttagtgggtgcaggaggggccccatcttgaagtctgcaggttcacattatgcacagggacttgccactgctgagtccccaaagccactgcaaataacgctgcgaacacaaagcactggtggcccagcaaggagggtgaaagggaagctcccaaagtggcttcggcagccccagggaaaccctggccagaggcagaggccgggggcagaaagaggatgtggcacccagcgcgtggccaccatagagtctgtaaaagagatcataggggctttctgagaaaagtaccctgagatccctggaatcgctgttgagaatggctatctcccggactctgctgcctggatctgacgaccctcctcctaagatggatctctctcaaaggagcctgtttccctctgttaaggtcgcatgaatgcccataattagatgggccatgggaaggcaaccacggagcaagcaggaatggcccaaactctctgcagctagcacattccccacaaactctctgcagctagcacattccccactcaccctccacgttttctgcctgtcacctccttgtgcctgtgacggggggtgagtagggggaggatgggaggctcaggaattccaatactcttggaatccgagggagagtgaggctgacactctgcataaggaaaaaaacaaggctccaacggtccccaaggcaccccactcaaagccagtggaagatgcgggttggagctttctttgcgtggtgttcgatgcccctgctttactctgaggatgaggaggatggggggtagacgcagagaaagagaaaccgagagagagagagacaccagggggtgggaaaagatgggaaaaggggccttttgtgaataaaggcagcttcagttagtaaggtaacataattgacaagctgcaaaaacagcacctactaattagtcatcgactaaaacatgtaaataataaatatctaaagtgtcccttctctacgtcctccattgccaacaggacaccctgccttgcgaggcttgggatggggcaacacatctggctaggattaggacaagtcacacaaagcgaagggcagccccttcaaacccacgctggagagaagtgtcaggactggctctccatgggaagggcagatggctaccaggggtgagacctttttccaagggaatcccatcattcaggggaggtgggattacaggagcaagggaggcctcctgcgaagagctctcctggtgaacagggatgacactccagggggctcgtggcaaggaaaccttttgggtttctggtaactcaacacttaaatcatactgttttttgttgtttaaataaccttcccatttttatgttgcatgtcccgttgagcctgtggccgaagggcatgaaattaaaaaccaaatctgaaatgctatttcctggacgggaaaagtctggttcatgtggtttggtcactcccaacagcaccggtgtgcaattgacgaaggttttgtgtgtctgacctcagaacggaagggctctggcaggggatgggtgctgctgtgctgtctagctcaggagttttgctccaagcattgctttgtgagtttcatcgcgttgccttgtgagtttcatggtcatggctgtcaaagttcccattttcaaggatcaaagaaggtcatggtcttgagtctggtgctcacaaacatcatcctatttctgctactttgtgtggcagccttgagggaaggaggcccagacccctggacaggtggcagttgcacttgtggctggaccttggccatgccacatcaaaaggctttcccacttacctagttactaaggagaatagttcaacccaaggagggctgctgagaggctcagagctctcctaaggctgcagcctccatgggaaagggcccacgaccatgactttcaaggctggcaccagagtcccccagccaagagaagcagaaaaatgaaccaaagggcagggctggagtttgaacccatggttggtctgggcagtgcttgtcaaactggcatttgcagagcccttgggttctgaagaggtaccgtaggagataccctgggcaaggggaccgcccagagggctgagctttgggagggaacctcgcacttgtcagcttcaaccagagcagcttggatttcgtcagcaccctgaacctccacttatgactgtgctccgtaaacgaagttctgctgctcgaaagaaaagtctgaaaatcacacgtctggggtcaggggtgggtcactggaaggggaagacaaggaacctgtaggacttgaggatcaaccagaagaggtgagacagtcacagtgcagggactgagccatcccacccgcagcttgccaaaggcaggttgttggctgatcctgctttgacctgctgaccttccctttccatcattctatggccaggagagacccattcacagagggcctcccccagggtgggaggccggggttcaggccccacaacccctctggctgctttcccgttgagatcctgctgtggcccactcctcgtgcccagtgctacctgagccggccatcaggtttgactgcccccagctccgacttggggtcagggctgaaggagctccaggccgtctggctgcaggtctgcatgaccgggcaggctgtggggcccgtggcacagatgtccatggcagtccacatcccgcccaccaacgagtccagccatccctccagcgctgtgcccgtggaggctgcgttcctccgtgcctgttccacctgggcggggttgatgggcaggctgaggacggggtttaggctctggaagctctgctccatgtaggcattgcggaggggcccattgtgcagcttcagtgcctcctctgaaagccaaagggaacaatttcaggatcagaagagccaccaataggatgcctattcatacttaccctgtgcctggtgctgcactgggtgccatgcatcgcctcatttaattcacatgacaatctcatgaggaagttcttttagcagtcccatttcacagctgagaaaactgagcccgtaaggacagagcccactttgtacagggcacggtgcatgcctttattcattcaacacatgtttatagcgcatctttgatagtgcagacactgattcagccaatatatatttttaagcacctacattgtgccaggcattcagtcaacacatatttactaaacacccatgatctgcaaggcactgtctcatttgataaagacatattaagtacctattaggtaccaggatctattctaggtggtggagcaaaccagataggaaggttaagatccagtggagggagaacaacaacaaagaaataagtagataaataaggttatttcaggcagtgataagtgtcatgaaggcaaaaaaacagggtattgagacaagagggttggcaaactgcagtccttgggccaaatgtggcccaccacttgtgtttgtaaataaagttttattggaacatggctgtgcccatttatttgcatattgtctgtggctgcttttgtgctaccagagctgagtatttgagacagactgtattttacccaacaagctgaaaatatatctagccctttacagaaaaattttgctgactcctgggttggagagtgacagtgacctgtacccaggtctgtttgggaagtccagatctcagctgccgagcgtccaccttgtactctgcgtaagttggatttctgcttcctagaagcctaagggtgcatgaactgaccacagaacaatcactctgaaagcatgaagcttggacccgggtgaggtggggtgggaggtcaaactagctctcataacagtgctgccttgctgggcccctcctatgtgccagtcactttgtgaagcacttcatacaagagcccaggtactgcagtcatgctgtctggttttgcagccccacgtccaacataccaggtgtgtgacttctgacctccatgccttgtacctcagtttcttcatcaataaaatgggtaaagtactaatgccttccttctcactttgtgaggcttaagtgtgctgactcatataaagtatttacaaatgacacctggcatatactaagtgctgggaaaagcttagctagtgatatggtttggccgtgtccccacccaaatctcaccttgaattgtagctcccagaatccccacgtgttgtgggagggacctggtgggaagtaattgaatcatgatgagtttttgccatgttgttcttgtgatagtgaataagtaagtctcatgagatctgatggttttttaaaggggagtgtccttgcacaggcgctctggcctgccaccgtgtaagatgtgcctttgcttctcctttgccttccatcatgatggtgaggcctccctgaccattgaaactgtgagtccattaaacttcttacttttataaattacccagcctcaggtcattattagcagcatgagaacagacaaatacagctaggattattactgttggtattagtccataatcctcacacacctaaaaaactagggggctggttttatcattcctactttacagatggggaaagagaggcagctggagttagagacagatctggggttaaatccaggaccgactgactccaaaggcagtgcttatcactcaccctgatactctactgctcaaggccatcaccaaggtctgatttttcactcatgcaaaaattcaaacaattgggccaggcacgatggcttacacctgtaatcctagcgctttgtgaggctgaggcaggtggatcacctgaggtcaggagttcgagaccagcctggccaacatggtgaaaccccgtctctactaaaaatacaaaaataagccgggcgtgatggctgatgcctgtaatcccaggtactcgggagggtgaggcaggagaatcgtttgaacctgggaggcggaggtttcattgagccgagatcacaccattgcactccagcctggtcgatagagtgagacttcatctcaaaaaaaaattttaaaaattgcaacctcaggcataaatgggttaaacagtaacatgtacgtaagagtgactactactactacctcccagggctgcacgatgaggaatcaggaagtatagcaatttggggtgaaggaaagaagctaaacacttctattatttctaatagatgctatttctaatattttgaagacgttcacattcattgcttgttttattgctcagtagaagcacatatatatttttaaaaaggctggccaatgagtctggtgagttgcgctttaccaaatcaggctttgcgagagctgagatagctaggattacaagaaaccttccaagataatgcagtgttcagaagacagtgcttcctgtttgcctgacagcagctgccaccaccaaaggcacccaggacagcctggatattaacaagtgtccagagcaggcaagaagaaggaagaaagaccatatgctaacccttctaaaagcagtgagaatagtagatgaattcaaaatttgccttgactaacacagacaagatcgccactccttcaattcccaatgccccaggaagcaaaagggttgggttctgtggtttggatgggcacaagtgggaggaaggaggtgagcagtcattgagcacatactctgtctcgcaaggggtttagcaaagctgctttctcccacggtagttaggagccacagtgtttggaagtctggtcctaacccatctttctctaatacagggtagggtgggcagcttcagccccacctgccaggagaacagagcctgctgtctttggtgcgggccctaatttctctatcagagccccttagtgcctctattctgcagagtgagaaagtggagaatgaggagataccgaaactgacaaaaggcaggacattcaaagggaaaagagcagctaacaaacctgcgaacgctgggagccaaatattgtggttgatgcaaaaaaacccttatgagaaatgaggttaatgtgggaaacgctattacaatattagcttgcgatgctcgtctctataattaaattttcctcaattccacctcatcggatttcttgcgattaccagggacgcatcaatagaaaattactcttgatgaatcattttacaaattgcattgctcccacctttgtgttcactgtcattcattggaacatcgctaacaaatacaattaccaaggacaggagggctgctctcggtgggggtaaaatgactcctgggtcatcctgggcatgtgtagggagagccctgccttccttagaaaccctagaagaaaacactggaaaaatcaggaccccatgaatggcccccaggctactccactggcgtgggggtgtgttcaggagcactgcttcattctgaccaacaggtgtacctgaagcagcgaagacacagccatttactcccctctcctccatgtctggcattagacatcgttagagatggtaaagatgtgaactagatcaagaaggaacctaagacctctaagggggtgggattgggcctggtcagctctggaggggctgtcttttgcctggttcatggggaagaaggagcaggcttccagctcaagaaaacatgaggtctctgtctttctgcttgctctgcacaaagacagcagaagctgagcgtttacttcgagactcctatgatagaggattgattgattctttttttgagacggagtctcgctcttgttgccaggctggagtgcaatggcatgatctcagctcactgcaacctccacctcctgggttcaagcaattctcctgcctcagcctcccgagtagctgggatcacaggcacacgtcaccacacccggctaattttgtatttttagtagagacggggtttctccacgttggtcaggctggtcttgaactcccgagctcaggtgatccgcccacctcagcctcccaaagtgctgggattacaggcgtgagccaccgtgtctggcctatttatttattgttttggagatgatagagtctcgctctgtcacccaggctggagtgcagtggtgtgatcttggctcactgcaacctccacctcccaggttcaagcgattctcatgcctcagcctcctgagtagctgggatttcaggcacccgtcaccatgcctggctaattttttgtacttttaggagagacagggtttcaccacattggccaggctggtcttgaactcctgaccttgagtaatccgtccacctcagcctcccaaagtgctgggatttcaggcgtgagccactgcaccaggccatgatagtggtttttgtccacggttcttggctcagaactcctgtaacccttcttacagtcttttcttacaatgttgggcactttaggactcagcaaatagaatctctctctcgctctggcctcctcctgtcccccttctcctgcctaatgccagagtctaatcagattgtgggtgataggactctcattccagagagggccctgacacactccctggaggaaggaattactgcacagagaggccaaggagaatctgaacagacagggcttgctgagttaggtcagaccctttttgtccaatcacattttgacacagttgtcatgcttcagtcatgggtaaccaatgaagtcttcataaaaggcccaaaggacagggttcaaggagcttctggagagctgaatacatggtagcatcttcacaggaaggtgaggaagaactcatccacctgccgggacggtgggcaccccaatgccatggggacagactcatccacctgccaggagggtggtgcaccccaatgccatggggacagattcatccacctgctaggagggtgggcatccctatgccatggggacagactcatccacctgccgggagggtggtgcaccccaatgccatggggacagattcatccacctgttgggagggtgggcaccccaatgccatggggacagaagctcctgcactcaggactcctctggaccttgccctctgtatagcttcatttggctgtttatctgcatcctttaaaatatctttcataacaaaccaatagacataagtgtttccctgagttctgtgagctgctctagcagagtaattgagcccaaagagggggttgtgggaaccccagtttgaaaccatttggtcagaagttccaaaggcccagacttgtgattagcgggcagaagggggtggtcttatggcactgagccctcactctgtggtgtctgatgctacctctggggtggagagtgttggaactgaattgggggacacccagctggtgtctgctgcagaactgattgcttgcttgctgacggggaaaatttccccatgtattttgctgtcacagaaatcttctgtgttgatcatggcagtgtgagagcagaggaaaagtggtttgagagtttttcccaaacaactccctttgctaggactcaaggcacctcctccccatgctgtgtccccatccccttgcatcattggctaaaaggcacccaatccagaactcttcaaagctaagaggctgtaatgcatttctggcttttgagtttgtgatctgttagagatggacatgaataattccaaatatagagagacccagaaatcctgtttctacgagtttgtgttatggatgtaactgcatgggaacatacaatttttttttcttttttgtttttgttgttgttttttgagacagagtctcgctttgtcacccaggctggagtgcagtggcgtgatctcagttcactgcaagctccgcttcccgggttcacgccattctcctgcctcagcctcccgagtagctgggactacaggcacccaccaccatgcccagctaattttttgtatttttagtagagacagggtttcactgtgttagccaggatggtctcgatctcctgacatcgtgatccacccgcctcggcctcccagtgtgctgggattacaggtgtgaccaccgcacccggctgggcacatacaattttatgtttaagactcttccttgttggggctgggtgtggtgggtggctcacgcctgtaatcccagctctttgggtggccaaggtgggagggttggtttagatccaggagtttgagaccagccaggacaacacagaccacacaaccacaaaaatagttaaaaaaaaaaaaaaaaaaaaaaaaagccgggcatggtggcacactcgtgtagtttcagctacttaggaggctgaggtgagagaattacttgagcccaggagctcgaggctgcagtgagctatgattgcatgactgcactccagcctaggcaaaagagcctgacctaaattcttttttttttttttgagacagaacctcgctctgtcacccaactggagtgcagtggcatgatttcggttcactgcaacctccgcctcacaggttcaaacgattctcgtgcctcagcctcccaagtagctgggactatagacgccggccaccacactcggctaatttttgtatttttagtagatggggtttcaccatgttggccaggctggtcaggctggtctcgaactcctggtgtcaagtgatccgcctgccttggcctcccaaagtgctgggattacacgtgtaaaccatggcacccagccaacctctgttatattaaaaaaaaaaaaaaaaaaaaaaaaagacttttccttgcactattatcagtaacatcatcatcatcagcagcaacaacagaaacttatgtgtccaccaataggggaacagatagattgtggttccttaacccagtggaatatcatgtagctggtagctttatatatactgacttagaaagtaaaaaaaaaaaaaaaaaagcaatcttacagtacacaatgtattatttcatttttaaaaaatagcaaaggttttgtgatttatggtgtgtattatgtttatgctttacaagtatggaaaaacttctaaaaggattcacaccagactgttggcagtggtttctctagaggtaggatttgagcagggagaaagactttccccttaataaaaggaggtgaaaaggggcgggggaaatagaagtataaaagtaaaccctttcaatggacaaagaaaaaagtcaggcaggataggaactgacatcccagtccctgttctccatggggatggaaaccctgacctgaatttcatgttaatttcatgtttcatttcctaacagctgcctttgacatacgactcctgaaataagatattgttgactttgcctgtttttgaacttgacataaatacatcataattatgatttatctgtgatatttccccctcaacactatgttttagggactcatccaagccaacacatgcccatgctttactgctattcacggctgcatagtactccattgtatgaacagccagccaattgtttctcctttccagtgtcaggcaatcagaccgtttctggttttgtgctattaagaataattctcatgtgagcatttctgcacatgtctctagggcctataccttggggtcagacgtctgtggtagggtgtgtgtatgttcagctttactaggagatactaaaacattttctaaactcgtcttagcacttcaccctcccactagcactgcatgaatgcctattgctctcagccttagtaacacaggttcttatctgtcacgcatttcccaatatgatgggtgtgaagtggaacctctctttgctttcaattttcatttctcccatttttaatgaggctgaacatgtttttgcgtgtgtgaggggccattcatgttctctcctccatttttttcctctcttttatagcagggttggtggtctttttttttgtaaagagccagatagtatctttggctttgtgggccatgcagtctctgtcacaactattcagttctgccactgtagctctaaagcagaagcaggcaacatgtacatgaatgagcatggtgactgtgttccaataaaactttatttacaaaaacaggtagtgggctggattggccaacttctgatgaatagcatttctttataaattctgaacatgagtactttaaaaaaatgtagcaaatatcttctactattatgtggttcatcttttccacctagtgtatcatatttttgatgaacagaatttcctgttttgatttttttaaaatagtaaacaagatttgctgatccttaatacctgcctgggtttatttcccatcttgtcttcaatatgatctaggctttctggaagttgaatgggggagcgtctaacaaatagctacctaatacctagacagatgacatcatctccgtgtgcaggtaggacattagatggtttctctagggaaacacagagaaaagtattgagagcaaggagtgctgttctgtgaggccgctgcttaccctatgtctgagcagtgctgcctaccaacaccaaagaccctcaaggtccccagggaaggagtatttctcccacatagacactgggagtacttaccaggtttgatgggctgcctgttcgagaaggtcagaggcgcaacgaggaatttggtctctgcaactggcacccagtggtggagaattttcactgtccagaccccaggcctcaggggcaagttcaaagggggcttgtagtgtgtgaattcggcagtggactcaatgaggatgtcgtaggtggctgcgatgacattgacgggatccacccaaatgacggtcacggtcacattaggtcccttcccccacttctgcatacccaccggctcatccatgggccccagaagacccccaaagttgcggaatagcctctccttggcatcccagtcagtgccgacctgaaacaggggagtgaattctgaagtcactgggcctgaactagggggctaggtctcagaaaggtctaggatcccctttgttagctttcatatacccattttacagatgaagaaactgaggctccaactaagtcacctgctcaaggttgcacagcttgtaagcagaagatctggcatctggactcagtctgaaggatcaaaaggcctgtggtccttttattaaaccaccgggcctcctgtgcctggtgtatggcatgtgctttgaaaagaaaaccacacatgagctgaatgagtgaatgaatgaacgaatgaatgaatgaatgaatgcatgtcttgcttgcaggccattccacagaaacatacaccctgccactcaacaggtacagcgggtttccaattccatccttggttttctaaatcacacacctccacttggtgcaatggttctgaacaagaatagagatcatgtttttacagctgctctatcataagctagagaccctcagcattgcctgtcatctacaggggttcaaataggtttcctaggaagagacagctttggctttcccaaggcacctagatctggactgtaagcatgagagtcatcctgcgatccttccttcctgccagccagctgggggtgtgtgcagctgtgacccacagcaatcctctctggtgggcttccctccttccacttgtgccacctgcaatttcttctatatcctgtagtcagaaaggccttgtaaaatgtcctcttactgctgcccccaggcttcttagtgcactcagagtctgagctcaccccatcctccatctccatgaccccctccccatctttctccaggatgccttgttttagccacctcaatcaaggcaggctcattcccagctcagctttcctgcaccatctgccctgtgtggaatactcctttcttgcacagccagccccttatgtctaaagctgcctcacagagtctttatctgaccaccccccaccccaaatttcaaatggaccttcagtcaatctgtgtcattccctactgctttattttcttcctatcagtggtgataagcactatctcagagttgtatgttgatgtatttattctttatctcctccagctgtaatataagctctgtgtgaacaggggttttacctggctggttccctgctctttcttggtgcctactaccatgcttagtacacagcaggtgctcgagtaatgtttgttgaatgaatgggtgaatggcttgaccaaaaactgaatgaactagggagattcctgacaaggacctttgttgctatttcaaatcaaattaaattaggggtcatctaatttgaaaaaaagatctcccccaggtggattaacttagtggttttgaggacacagcatgtgggcatgttggggcaaataacgggtacagtatgaagcttgcactgcctctgctgtcttcccataattagcatctctaatgtgtgtgtgcacgaaggtcgggtgtggatacacatacccacattctgagatttcctatgtgcaggggaaataggagctgatctagcttctcattgttcttgcaagaggtactatgtcagtccattctttacccagcttacagagcttcactgctaatatttgctgagggattacagtgtgccaggcagacgtgtccattcagttgatactcccaaatccataaaggggagacccttgtcattatctttactttacagatgtggaaactgagtctcagagaagtgagataactcgctatggtcagagggggcagagccagcatgggaacccataaagtccagccccagaggctgcattctcatccactgtgctacatattgccttccattcatgaattcattcactctctcagtcattcattcacccaacacacataaaccaaatccctactgcctaccaggggtggctgccatctgtgtacactcactggcatgtgtcttgctttcagttttcatcaggccagagactaaagattaggactaagaaagcatcctgagagtaacagaggtagttactgctctgatgttcctgtgggggctgccatccctcccagacttatgaaatcttggtatttttctactaccctgtggatcagcagggaccagcaccttctgggaccctccagtgcctagcatagtgcccggaacacagtaggaattaaaaggatactatttattgaaggaataaatgaatgatcaacaggattcagttcaagcttcaaggtcttagaggtttttctaaagaaacccgatttctattttcctgcttacaacccctttcagcaactcttggtttctaagtccagttgctttacctgtcctggagacctttctggtctggctccggcttcacttctgtcatctctatccctctccctcccttccacttgctccttgctccaggccaccctgggttattcccagcacctcatccggaagggctctgtgtttcctcttgatcttctggccatgatccgcctgttctctggaccggtctacctttccccgcatcctccaggccacctcaaacttgtaatctagattttggctcaggcatcacctctactcataagtctttcctggatagaggcaccactgaggtacatatctaagcatttgatcatcatagcttttctcctgacccccacagtactgcatcttttaatttacaggtctctctctctccagatctagaccgtcaactccaagagggcagggactatatatggcatgctcaccaatatgtctctagtgtctgaaacagtgctgaacatagagtaggtgctcaatatatctctatagagatctaaaaataaagatatattgagcacctattgtctattgatcgatcaatgatctatacagattgatcatctacttatgtgtgtttatcatctatctctaccaatctgtcacattaatctgtcaactctattgtaaccattaatcatctatccatctgtttgcctattaacgtatccacccatctgtctgtctgttaatcaatctatgtatcacctgtctatcaatctatcttgaacacatattgaatgagtaggggctgaacacatggacttccctccatgcactagtttccaacagatactaacaaaacagatgaatggccacaaaactactttagggtcatatttaaggaggtgatttttcaccagttaggggaagatgggaaccctccagaacactgcccttggatcctccaaagaaatgaggataaacacttccctgaaatcgagttttaaaaccaagataacctgggcaggagagttctggagcagctgacaaacaacctggatcttgtttttcaaccgaggagcgtgaagggtgaggtgtggggcagcctgagctagggccctgctgctgtcacatcctccaagaccttctcaaggggcctcattgtggaagtccaccaccatccactgcagaatggtcaattacccaaattcaaatacatattcaaattcaagcttaacatactgctccctggcttccaaccaaccaatggctttccattgcgtttatttatttattttttgagtttataatgtgtatgtatatgtatatatttcaataggtttttggggaacaggtggtgtttgcttacatgaataagttctttagtggtgacttctgagattttggtgcacccatcacttgaacagtatacactgcaccccatgtgtagtcttttatcccctatatcccctcccctatatcccccaacccttgcccatgagtccccaaactcactgtatcattcttaagccttgatttcctcatagcttagctccctcttatgagtgagaacatacaacgtttgcttttccattcctgaattacttcatttagaataatggtctccaattccatccaggttgctgcaaataccattgtttcgttcctttttatggctgagtagtattccatggggtatatatatatatatgcgcacacacacacacacacaatttattcactgattgatgggctgcttccattttttttgcaattgtgaattgtgctgctataaacatgcgtgtgcaagaatcttttttgtataatgacttacttttctctggtagatagcccacagtggaattgctggatcaaatggtagaactacttgtagttctttaaggaatctccacattgttttccatagtggttgtcctagtttacagtcccaccaacagcataaaagcgttcccttttcaccacatccatgccaacatctgttattttttggttatggccattcttgcaggagtaaggtggtattgcattgtggttttgatttgcattttcctgatcgttagtgatgttgagcattttttcatatgttcgttggccatttgtatatcttcttttgagaacggtctattcatggccttagcccactttttgatgggattgttttttcttgctgatttgagttccttgtagattctagatattagtcctttgttggatctacagattgcaaagattttctcccactctctgggttgtctgtttactctgctgattatttcttttgccttgcagaaacttttaaaattaagtcctatctacttatctttgtttttgttgcatttgcttttgggttcttggtcattaagtctttgcctaagccagtgtctagaagggtttttccaattttatcttctagaatttgtatggtttcatgtcttagatttaagtctttgatccatcctcagttgattattgtataaggtgagagatgaggattcggttccattcttctacacgtggcttgccaattatttctgcaccatttgttgaatagggtgttcttttcccactttgtttttgtgtgccgtgttgaagatcagtaagtatttggctttatttctgggttctctattctgttccactgttctatatgcctttttttataccagtaccatgctgttctggtgactatggccttatagtatgctttaaggttgggtaatgcaatgcctccagatttgttctttttgcttagtcttgttttggctatgcaggctcttttttagttccatatgaattttaggattgctttttctagttctgtgaagaatgatggtggtattctgatgggaattgcattgaatttgtagattgcttttggcagtatggtcatggtcacaatattgattctacccatccatgagcatgacatttgcttgtgtcatctatgacttcttgcagcagtgttttgcagttttccttgtagaggtctttcacctctccttggtgggtttgggtttgttcttgtttctctagctcattaaggtgtgaccttagattgtctatttgggctctttcagactttttgatgtgggcatttaatgctatgaactttgcacttagcactggctttgctgtatcccagaagtgttgaattcaggagcaagttatttagtttccatgtatttgcatgaatttgggggttccttttggagttaatttccaattttattccactgtggtctgagagagtatgtgctgtaattttgattttcttaaaattgttgagacttgttttgtggcctatcatatggtctatcttggagaatgttccatgtgctgatgaacagcatgtatattctgcagtcgttgggtaaaatgttctgtaagtacctgttaagtccatttgttgtagggtatagcataagtccattgtttctttattgactttctgtcttgatgaactgtgccaatattactgtgttgctgtccatctcatttcttaggtctagtagtattgttttgggagccccagtgttagtgcatgtatatttagattgtggtgttttcctgttggactagtccttttatcattatataatgtccctctttgtcttttttaattgctgttgctttaaagttttgttttgtctggtaagaattgctactcctgctcacttttggtgtccatttgcatggagtatcttttttcacctttttaccttaagttcatgtgagtcctcaggtgccaggcaagtctcttgaagacagcagacacttggttggtgaattcttatccgttctgtatcttttaagtgaagcttttaggccatttacattcaacattagtattgagatgtgaggtactattctattcatcatactatttgttgcctgaataccttggtttgtttcattgtgttgttttgcaggacctgtgagatttatgctttaaagagattctattttggtttattttgaggatttgtttcaagatttacagctccttttagcagttcttgtagtgctggcttggtagtggtgaattatcttagcatttttctgaaaaaactgtatctttcatttatgaagcttagtttcactggatacacgatgcgtggctggtaactgttttgtttaaggaggctaaagacaggacccttctggcttgtagtgtttctgctgtgagaaatctgctgttaatctgatgggttttcctttataggttacctgatgcttttgcctcttaaggttatttcctttgtcttgactttagataacttgatgactatgtgcctaggcatgatctttttgcaatgaatttcccaggtgttctttgaacttcttgtatttagatgtctagatctctagcaaggctggggaagttttcctcaattattccattattcaaacttttagatttctcttcttcctcaggaacgccaattattcttaagtttggttgtttaacatactcccaaacttcgtgaaggctttgttcattttttaaaaattcttttttgtgtttgttggagtgagttaatttgaaagccttgtcttcaagttctgaagttctttcttttactcgtttgattcgattgctgagactttccagtgcattttgcaattttgtaagtgtgtccttcattttcagaagttgtgattgtgttctatttaggctatatttcactggagatttttccattcgtatcctatatctttttttttaagttggacttcacctttctctggtgcctccttaattggcttaatagtcgaacttcttaattgtttttctggtaattcagagatttcttcttgatttgaatccattgctggtgagctagtgtgatcttttggggatgttaaagcaagccaattcacaattccttggctgtcccacagtgcctgcaggggcaatccacctccttcaaaggctctatggattctcttggctttcctggcatgtttctgcagtagttcttggagcaaaagttcatgatgtggggctccatacactgctctgtccatccgagtggaagctgcaagtttgtcttgcctcctatccgccattttccctctatctttccattgcatttaaaatgcaacctgaacatctttcccgggcctgcaagactactccctgaggcctctttcctaccagtttccttctcacttgctgcacccagtacattggtctccctgcaactcgagtactcctagctcattcccagtgcctaagggcctttgtatatgctcttctctctgcttggaatgctccagatctcccgaggactggctcttttacaggctttagctttgcagtgatctccttagaaaagccttcctagatgaatcaatcattctattgaaggttgtccccatcaatgtcctgagtccccagcaatcacatgaatgaagttttctctagaatacctgtcattagctgagctgtttgtttttgtttatctatttgctcactcactggctggctgtctcattggaatgcaattccatgaccacaggggcctggtttgtttggttcaccacaatccctcctgaacctggcacactgtaggcacttggtgactacctgcagaaagaatgagcatcttttatttccaagtcaacagcatgagattcccatgtattggagaaatgtatctgagctgttcagccacctgctgtgagccaggcactgtacaaggccctgggatagtgctaacaccaaggagatcctaaatagcccacagagtggtcctgtagttcttccttgcctttctgttcatttgctactaaaattaagagtttagaaaaaattcaaaatacaagttagggctctctgcatcacatgctgttatttttgccagtgattttgatggttctcactccaagggtaccagacctgtgtagtgaggaccatcccccaaaagcactagccatggagcggccaacatcatttgtcactgccagaagtacccagtcacccaacagcaggctgataaacagggagagcccagacaccaggcattcatctctttaatgggacattaatgttgtcaattggctgctcaggcccctagcacagaatcgaactggggcagtatctaattgccccctgatgccagtaatttatggaatgggctcccttggctgctcacatccagcaaatccactgggagtcttaattgaaaacagtggcttaacaagaaactctcactggtgcctgtttgtcatggggatacatacattcgttaggcagggccacagaagctagagaaggactgtcaaggaaaatataagagggtgggactccccctctccccaacatactcttagcccctcaagatgtaccatagtctacaatcagactcttggtccctaatccagcagtcagaaccattgtgacaaatcacgtccttagcacttagggatgtgaggaaggcagaaaccaggtgctgcagttttgtgtgaataacacgcaccaggcttgatcatgcttccccttccttcctgcaccacgacccaagtacactcattcattcattcaaaagtcttactcagcatctacaaagactacatactgtctgtgtgctggggataccacagtgaagagggagacacagttccagctctcttgtgaacaatcaatgagtgaccagataaagcaacaagataattttagatagtaaatgctaagaaaaagtattaaaatagggaagggttggatggagaatgtagctattgcagcagcttaagtgggtgccggggaaggtttctctgaaggtgtatcatttggatttagatcagaatgatcaaaaacaaagctagctatgtgacccatctgtccatccatccttccttcaatccatcattcatctactcatctaatcatatattcagtgattgatctggtacttcccttgagcgaatccaggtgtgctaaaaactgtggagacaaaaccacaactaagcataggatttgtggccaaagagacctaggttgaattttgagctctcccacttcctagcaatccagaaaatctttggatctctataagcctcagttctccattcggtaaaatgggactaatattactgacattggtttaggagtcatcactggaaaaattcagaggagcagaaattctaccctaaaaaatacaactgtgttccagttggtttgatcctcccctgtttaagatgctggtgccagtgactggggccggagaaccttcttcgggcacagggttagcttatctttagggatctccaagtcctcttctcctccatctccaactagaagtgtcagatagtggagtagaatctggccgagggaaatgcaaaatacaatgaaatgtgacaagacctggcctcttacctcggaaaactgaagcctcccaaagtcactgggtgggcttgcgatcttgaagacttttttcggcatcacccaggtctccagagtctctagtttgctcacagccagattggtagcatgatgcttgatcagaaagccctggaagcggtcagcaaggaagtagaggtgcacagatgctgggtggcccattgggtagtatctgaaaacacaggcgctcatgcattagggcccaaggtgtgtaggatcacagtgaggctccccacccaccaagctagttttgttcctaaagcagtccccattgtgcacaatgcctactgttttccttgcgtcctctgtatctatgatctcaatgactatgaatacttttttcttctgctgattatgaatgaaaaacatgctgactgtaggaaagtacaacaaagaaagtgaaatgactactttccatgcctcttcccatacataatgtccattcacagatattgagtcctctggtgcttggtaccgggcagtgaaaatggtgtgtgaacactcatattgatggatttcccttcggccttatttcctatgcatctatttgcataaatactatttgcataaatactacatagttggcatctatctatcctagctattattctgtcttcattgtatagtatttcctgaggattatcacatctttgaaaagtctctgaagacacgattttgtatgtgttgatgctcggtgtgtttcatcatagttaataccagatttgatagagcaagttctctagcattggatgataactctaattttttgcttctctaaacaatgctgcattcaacatctttgagcaaaacctttcattcgtctctctctctgtttaaatgtctgaggctcttcgtgtctgcagcttaactgtttcagaagtactgatttattctctcacagtccttaccacttacactggttatcatctttaaccatgattgccaatctgagataaacacacatgcacatacatgcaaaagtggtttgttgttttaaaatgcacgtctttgatccacaaaaacttgctggctgaaaagggcagggaagtgaagcagagatgtccggagaaaagggggaagcagatggcaaaaaaggagtacctcggaggagaccagtttggtatatttcctacttgtcagataaatagctgccgcttctgcaatgtgtaaattgcacagctttataaggcgcttgtgggtccttcataatagcatttcacaaatcattgtccctgctcagctaaacgcagccttccctctggtcctgatctggagttttaagtctttatgtccaattataacagttagggaagctgccttcctgtgttcacacatctcctgaaatcattgccttgttactgggatgccttccagggagcatagaaaaaaaaaaaaaaaaaaaaaaaaacttgaacagtcttcagatggtttgttgggcattcaccgttcatgcaaacctgttttaaatctggactttgggagtggaaagtccagcgactgtgctgtcattctaccactgcagcaacatctaggcagggctatcacataaaacctcctgcgatgacagaaatattttatttatttatttttgaggcagagtctcactctgttgcccaggctggagtgcagtggcatgatcttggctcactgcaacctccgcctcctgggttcaagcgattctcctgactcagcctcctgagtagctgggattacaggcatcagccaccatgcccggctaatttttgtatttttagtagagacggggtttcaccatgttggccaggctggtctcaaactcactcctgacctcaagtgatccgcccgcctcggcctcccaaagtgctgggattacaggtgtcagccactgcgccaggccaaaagctttttatttccataggattttggggaacaggtggtgtttggttgcatgagtaagttctttagtgatgatttgtgagactttgggaaagctgtctcccaacccactagcaaagtgtgactgttcagcccttgaaatatggccaatgtgactgaggaactgaattttaaattgtatttagttttagttaatttacactgaagtagccacttgtggctaccgtattggacagcaaagatagtcatgaaagagccagtggtcacctgcattaatgtcccaaatctcccatctcctttatcttatgctttcttccatgtgactttgcaagtttccttgtacccgggaggcagaacctatttttctacctctggaatcttctttggacaacagaaagtggtagaagggctgtcacgtcagttctgagccagggcctcaagatgccttgcacatttctgtttgctttcttgctcttttgaggtcaccatgagagcatgcctgggctagcttgctggagaaggagacatttgaaacagcagagctacgccagttgtcccagctgaagccatcctaggctcaggcaactattcccagccaaggaccacagagccacctcccgacttgcagttggctgcagataggggagcaaggcctgcccatactgggaaaactgtccagctgatctgcgaacttgagcattacatgaatgcatattgtttcaaaacactgatttgggagttgtttgtttcacagtgttatcgtgacaatagacaaagcactgccagtgtgtgttctgtgaggtgggtaaagcaggagaatttgctgttacgggagtcaaaggaagagagtgtttccagaaagcagcagtccaaaaaatttagaagtcaatctttgattacttgcctcccttcaccttctttatattttttgagatggagtctctgtcacccaggctagagtgcagtgtcgtgaaactggctcactgcaacctctgcctcccgggttcaagcagttctccctgactcagcctcccgagtagctgggattacaggtgtcagccatcacacctggccccttccatcctctattctccttacacactgccagaatcccggtcaaagccaccatccttttatacctgggcctctgcaggagcttccttaattgtcaccctctcttacttttgcccactataacctgttcccatagtagccacgtccatcgtccctcacttaaatgccacaagcactttgcttcatgctttcagtaaaatccaaactccttacctggtccacaaagccctaccgctttctctagcccccttttgtttcctgctaccctaatccaccacttccttcctcattgctgcctctgacttgtcactctcacatgactttatcttcattttttgcacagcatttacccttattgatcttatattctggtttacttgtgcttaggtactgtctgtctgcacactagaatgggagggctttgagttcacaggcctggtccgcctggatcaaggctgaattctccgtgcctaacacacaggctgacacacgatagctactcaatcagtacttattgaaggagtgaaaattctagaaggattttctcttgaacctcaagttacatctacagtccctgtaaccaaggagtgagcacaaaagccctctgatgcctcatcctgactgtatttggtatctaagtaatgaaaactgttaatgtctcaaaacagaaaaataatcaagatgccgcacaaccaatcatcatctacaggaatgcaaccgaagtattcgtttggcccaaagctgtttttctttcttatttaaatacgatgagcactaaaaaaaattaggagatttggttggcaactccatctgcattcccacggaatgtactggggttcagctccatggacctccaggttcccatggtcagcccaccctgcagggggcacactgagtgattctagtgcttcgtgcctgccccggagggcatttggggacctgcaataaaatgctgacatccttatttctggatggtagattatatgcaaactttactctgattctctcaacctgccatttcagaaacttctgcaatgcatatgtgttagtttataatgagaaaaaaaaatcaataaacattatttaatgaaaggttatattatagactggaaaggcacaatttgcctaaaatacccagataaaatgagactgttaaagttttcacttgctgtttccccacatgccccggggctaggaatccattctcttctgccttttgggataagggtcttttgtcctgatttattttcaggctcctattcataaatacattggctttgcccacagcaaggcaccacagttccattacaataaaaaacgaggtggataccagaggattcctggctcgaggcaacgtgacggctcacttcattccaaaatgaatactagggagcaaccttcaacaaccctagataaattgggggtgtcttttggaatttcctgtaagatcatttaccttatacattctaggaagcctgcaactgtaattattatggaacgacatttgccttccaagtggcaggcactgcactgtctactggggatacatgcagggattctgcttccagactagcagtgggggggagagagactccctggtgaccttgagccaagataccgcacatactgaaggtgaagtccctgaactactttcagcttgggagacggtgggtgtggggtgagctatcttaataagtgtcatagaggaggtggtccttggatggctttgttgacttgagaaggggtggctgtgcagtgggaggcagtgagcaaagaaaatacagggagagaacaaggaattgttaccatcacacacagcaggttcactgttggctgcatcataatggcaactggcaactaagataccagcaatgacctgaaccctgagcagttagtacatggcaactggcaactaagataccagcaatgacctgaaccctgagcagttagtacataaaatgctgttaaaatgggaataacaaggctgggcgcaatggctcatgcctgtaatctcagcacttagggaggctgaagcgggaggattgcctgaggtcaggagttcgagaccagcctggccaacctggtgaaatcctgtctctactaaaaatacaaaaattagctgggtgtgctggtacatgcctatagtctcagctactcaggaggctgaggcagaagaatcgcttgaacctgggaggtggaggttgcagagatcacatcactgcactccagcttgggcaacagagtaagactctgtctcaaaagagcactgtataactaactcatcaggtagtttttgatgattatctcctttacacttcacaacaccttatgatacaaaaatgatgagtattactcttctcatttcacagatgaggaaaccgaagctcagagagatgaatgacttgcccaaggtcaatagcttgtaagcagagtttaaactgcaggtcctgggttcctaacccacactagtctccctttaaactaaatcagaaactttacggagagagaagccgagggatgtgaggaggtgatgggacagtgtcacagccctgcggaaaccttgctggccagggatgagacaccaggtgggaaacctgcctgtgttttcagagagttagtgaacaatcttcttccccccagccccgtcagagactgacgctaaaaaaaaaagatgctatgttgttaaatgaacaagaaaaagaaggagagtgattagaggcacttctgggaatctatcctaaggaaataatcaaaagagagaatggaaaaaaagggctttctgagaaaagatattcatcagaacattatttacaagggtacattactgacaatggcaacagtgaagggccagattaagcaaactctggaacttctgctcaatggaatactagaggcattaaaaggaatcattatcattgcggaagctactgagcagcgtggagaaatgggggctaatagtataatgccaagggaagaaaacaggatacccaattcttgttgcaattatgtaaatatccaaaatgcatattgcttcagaacaaaagaaagggtacacaacgtgaaagtcttgactggcttagggaaagagatgagaggagaagggattatgttgaattattttcctacctccccctcatcttctagaacactctttcctgaagtgttggcagttagtggtagatgagacaattgtaaggggtggttgagaagtttcaacaatagttctgcctattaattttctttgtgatatttttaggtgtgatgacattatggtgaatgtttttaaaagagttatttttcagagatacattattaaaatattgatggctgaaatgataggatgtctgggattgacttcaaactgatccgggaggaggcggaaggtgggtgaagatgaaaatgaaacaagatcagccccgagttggaaactgccggggctgggtgacgggaacatggggttccactgttctatgttgtacatctttgacattttccatcaaaaaaagttttgtaccttccacttaagacaaatgctacatatgatatggtgacaaaaagcttccttctaaagtatatatatgtagcatgaagaatgagtaaaatcattgggtacataggatatctggtatctgagaaagtaaagcacagcttggattggaaatgccacgcacgctaggagggtggcgttagatgagttttgggcaaaggaagagagaaagcatagggtggcattgcattgcagatccctaaagaggaagaaggacccccactctgtaccctgagcctcccctcctgcttctcagctctcctctctgcatcccatatagggctcaccggcagctgttctccccatccgtgtgcagggacgtctcggcccgtcgaagacccaggcgggcaaaggagtggtacaaggtgagtgtcacgtcgctcaggctgtggatgccgtcaggctcatcgtagacattctcccagtaggagcgcaggcccggggtacctgcagggtagttcccgtacaggtaatagtccagctgcccaatgatttcctgattcaccacggcttcaaacttgcgggcaaagaaggtaggccgggctgtctgctgtactcatgggattaaaaatagaaaagccacatcagcgagtgctgggggttggggggaacctaagggcatatcctgtggttagaagcaaagctctgctggacccgaattagctccgatactttttgcacctctgtgttctcagtttcaacatctgtaaaatgggttataataagggtgtgagttaatctgtgcagaacatctaaagcaatgataggcacttagtaagcatcatttcttagtaagcatcatttagatgtctgttaaataaactaaataattttagatggtaatagctgggatggatctcagacatcatttaggtacaggtcacaggctagtaatctagggcaaataaatacagcctgcagatgtattttagctagccatatttaaaacatgaaagagttcacggaaattcttttggcttctctttaaacagcaatagatctggcaaccccaggcccacactccacatggtaacaactggttaaagctgaagggtggtggctgttcctttagacagcacctaggttcttctgctcactgcagtctccaccatgccctattgcctctttggtatttcagccaacttgcagactcacaagggatcggaatctctgggactttgaaaaattcagattccaggccaggcacacacctgtagtcccagctgctcaggaggctgagacaggagaatcacttgaacctaggaggtggaggttgcagtgagccgagactgccgctgcactccagcctgggtgacagaacaagactctgtctcagagaaaaaggacctactgagtcaatagctctggagtgtagctcaaaaaaaaaaaaaaaaaattcccaggtgattatgattcagtgtttcaggaccactgatagcaaccaaactctcaaggcaacaggcccagagatggtaagggacttagctgagaacacacagcaagtcactatcagagatgggacgaagagtcagggtccagggttaaagaaatactaagcacctgtaagctaccaggtgttatactttatattcagtaaaaggccagacagtaaatatttaaaatagctttgaaaccttcagcttcgcttttatagcataaaagcagccacagacagacaagagactaaataaataggtatggctgtgttccaactaaacttcatttatagaagcaggcagtgggctgactttggcccccagggctagagtttgctgaccccttgtgtagggctgcggagacaaataaaacacaggtctctcccttgaggagcttattattgtctagtgttattattgacctaaagttgggtccagcactgttttcatggtggtagattaatagcagcaacaactactgaccacacacaatacgcagggcaatggacttatgtcattacctctaattttccctgtaacttggcaaggcaggtattatgattcccattttacagatgagaaaactgagctcagagaggcaaagcgatatgtacagactcacaccattgtaagatttgaagcccaaatgcatgactccaaaatccaagccctttctactgtatcactccaggactgaggcaactgagtaaactgggaagccccctgatcgtaagtacccttggtgttattctaaacatctcattgccagtctgcttcaggaaacctctctgtggtggggagcacagcttagcactgtagagagttagaccacctgaattcaaatcctcatttggctaccgtctagctgtgcaggtcaagttactcaaactctctgggcctcagcatccttaaaatgggttactagcatagtgtctagcacatagtgtaggctgctctttgattattatcaccagccccttgttaccaggaacccatctaggggcagaacaaactcctttctctgcctgcgattccgaccatagctggatcttctaacaaacagggcacgttaccatattattctttctctccaagttcttcgcgcaagaactctgagttccttacaggcagcagtgtcttgactctagatcttgggggatattcttaatctctgcttgctgtgaacacatgaggcactccttgtcagaggctacaatgtccccaggatgccgggctaggatacaaatgcttgtgcctgggggagtgcagggctctgggaatcagcacgtggaggttttgtgctctaagtgatgaagattctctgcgattagggcagtgagggacgggtcctctccaaacatgggaattcattgaataggtcaaacaaacattcccctgcaaccctctttcggctcagcatatcctttctgcagggaagatgtgagtttaggcagccccctgtctgccagcttaaggtggctggagctgctgtgtgggaaccttaaggggaatacgaacgacagaaaacctgcagtgtactctgcattcatacaggcacaaaaaccaggaaggcagcagggactgctggaaaaaaaccccacttggaacacccctccatgccttcgtttccttacctgaacaataaaagtgatgtctgccccagtaaagccaatgcccacacagcccggcacagaggagatcaaacacaaacaaacagcatcccgctccacatcaagggcaccttggctgggttatgagcctggcattgtgtccctgccttcctgtgttagtggtttgggaagtagcataccgtctctacacggtggctctagtgacctcagagtgattcgcttaaccattcagtggcactcatatttgtgctctctgctgctaggtgtggggagggctggaggaagaagccaccatgctggcttggagggagcagagcaggaaggggtgcccatcttggggccaagcactctcagggctcatggtaagtggatgagcattccccaccctcctgctctgcccttccccagaactgtaaattgttaggctgcccagagacagctgtaaaggggataatgttctacctcttcttactccttcaagtacacagaacacagtgttttcccacagaacacagtggtttccaaacctggctgctcctcagaaaagtgcaattcattaaaaatacaaattcgtcgatatcactgatgagggtttctcaaccagaggtgctgctaagcatcctacccatgcatgggacagcatgtcccaacagagaatcatccagccacaatggcaagagttctgaggttgaaaagctcagccctagatatatacttaaaagcatattcctgggtacaaatgtaacaaatattttgggagattctgatgaaaagggaataaagagaagatgatatgagtatggcctttggaaagttttttttaacctttctgtgcctcacagttttcatatccctaaaatggaataataatgaaaggtcatttgttgtttttgggttaatgagtcaatgtggttagaacatccctgaagtaagtgctcaataaacactggctattgttgatactgttaactattattaattatcaacagccaggtttgggcaccatgtgataagatgacctgcaggtctggccttggatttctgcagaggtttgttgggaaggcatcacttaggaggctggcagaccatgagaaagtctcacctggaagcggtggaagtcctgcggcttgaagtcattgggggagcagccgcaccagtccacgatgtgcttgtactggcacttgcagcccagcttgcgattccagttggtgatgcgcaggttgttgtccaccatggtgtcgcagtgggggctgttctccaggaccgtatggaagaaggactgcaggggagagagggacccagcctgagacctctcccagcctcccacagatgaactggggtgggaaatggtgaacccttgctctgagttcatgtaagaactggttgtttaaaagaatgtggcatctcatcagaagctgggcggcttcctgtacagcttgcagaactgcaagccaaataaacctcttttctttataaattaccaagcctcagattttccttcatagcaatgcaaaaatgtataacacaactacctgactgtcaagggactcttatgttctctgcatgcatttgaggtcagctgcccatgtggtccaactcagagcgcaggcggatgctctgtccaacagacaaatcaaagggattcaagtctgactgactgactggtgtgctggaatttcacccctggggtagggagaccagattgatggttgcattagacccagggcttcctgcatcgccagacggcaacatagggaagggagtgggtggggctgcttgctgtccatggtactgaaccaggtgccatattttctccctaatcccaggattcttggccaactgctttaagggatctgagaaagaggccatgttggatctgaaaagaaaaactagaggagaaacaatcaatcactggagtacttgagagactgccagagagtgagagaaagatttctataatagacagtcccaggcaaatatatttcctccctgttctctctccctaagggaagctgttggggaatctgtgtctgcccgttacaagttaatgggcacagccttctgatttcttctaaaccagtcctcttgaagtggtctgggagaagggagggaaggcagagatgcaggaggtgggactgaacagagaccctggagtatatgtgcttgtgtgtgctggggccagggaggggcagagaaagcacacacacggagctttggtcaccagtatcgtggtgggcgtcttgattaaaaatagccaaactcccaaacaatctcttctaaatggatgggtgggtaaatgaggctccagccgccaccccctgctgaccttcctgtgacactaaatgacaagcccatgaacctggattttaagcttgaattgcctacaagcccagggaggcatacattctccaacaagcagtgggaagatgtacccaattactgattgccctgtgtcctttcataatgatacagaaattccctgcaatataatggatgaggaggttatcagaattgagagaagaggtgattgatttttgctgaaataggattaaaagctgattacttaacatgtgtgcagaatagtaaaacctggcccagtgatgacaagctcatcatccctctgggtgatgggggcagtcagccctccccggagcttggcactgccccagacacaggtgagagatgtgctgggagtgtggcctgcagaaacacacataacctatgtggtcccgggaaggaacaagggaccgttcatgagaaatgccatagactcaatagaaacggaaccagctctgcactgttctcaagctggattggaaatgagggtgcaatcaacctggaggtcaggaagatgaatctggaatccctcaacccagctctgaccggcaggcagctaagggaatgtcagtgacaatccttcagaactggatcccctccccacttctagatggggctaggactgttttagaatactctggattaatggagtatgacttatgaaaccaacacccttttcttcagggaataatagagcaatgttcaacatgagaaaaggcatgcttggtgtaaaaaggtggtcattacatgattggtcattgtgaaggatgcgtcaaaagttgatgtggcggccgggcatggtggctcatgcctgcaatcccagcactttgagaggctgaggcaggaggaccacttgaggccaggagttcaagaccagcctggccaacatggcaaaaccccatctctactaaaaatacaaaaattagctgggtgtggtggtgggcgcctataatcccagctactcaggaggctgaggcagcagaattgcttgaactctggaggtagaggttgcagtgagcagagactgtgccactgcagtccagcctggatgacagaggaagactgtctcaaaaaaaaaaaaaaaaaaaaaaaaaaaaaaaaagttgatgtgggtgtgtcctgaaagggtcagcatatacagttgtgcaggttacacactacataccttttaggggtgccatcagcattgtggatgtcagaagggttttttaaataacagttttctggaaaatagccataaggttcttgttctaacaaaatctgtgtatcatgtgatttttatgaccaatgaaagccaagtatcttgaggaagagctgccttttctattttgcacaaagacactgtgtggactgccggtggtagcaccgtgtgtctactccacgcagcctctgtgcagactggagggagaccaggcatcctgctaagacagcaaggatgtctgggtgtgtagaggacaatgtaggtggacccagaatctctttgccaaaaattcagcatctgctttgccacaaaggctagaacaagcccctatctttcttgggaaaattttcccagatactcacctcagcaggaagcagggtgtaggagtagaactgtttcatcttggtcaccagatcgtctgtggagaaggtcacatattctacaaacctccggttcagcaggaaccagtccgaaccgccatccacggcaatgccctctgggatccgccgatctcccaggcgccacatgtgagcgtcgcactccaggaagagccgatccaggccctgcttccgaatgaacctgggagggagaaagctgcccttagcccagaggtgtcctgaaagacagaactccagccagagtccaaataaaacaacacaatcatagcgatgatggcaattattgagtgcctgctgtgtgccaggtactgctccagggctctgcgtggagtttatcacttgatccccacaagtgaggcatgtcaccgtatttacccctatgacgcaggtactatttgacccccaactttcatatgagggcactgaggcttagagagcccaggggacttacccagcacagtcagatgacagtgatcatctgctacagctactccttctctagagaactttggcaacaacctccttatgccatagaggtcttggcagtttagtgaatgcagaccatggacccttgtctcagaatagtactcttcaatgcatacaacaaaatatacagggttatgaaacagcgaaaaataaaaatccaccaaagttctgatataaagtaatgcctgtgcttcttgactcacacattatatacaggattacaacatttttaaaatttttattttttgagacagggtcgtgttccgttgcctaggctggagagcactagtgtgatcctagctccccgcagcctcaaactcctgggctcctgtgaccctcctgcctccagctcctgagtagctaggactacaggcatgcatcaccatgtttggctgatttttaaaattatttttgtagagatgggatcttactatgttgcctagactggtcttgaacttctggcttcaggctcccaaagcactgggattacaggcatgcaccgccatgtctggctgctgcttaaatttttttgtagagacagggtctcacgatgttgcttaggctggcgtaaaactcctggcctcaagcaatcctcccaccttggcctctcaaagtgctgggattataggtgtgagctactgcatggggcctggattacaaaatacattttaaaacactgaatgtatggtactacgtgtgtttctttattaatacattaaataacaagatatcatggcaggtctattaaatcctgtaattttttttttttttttttttgagacagggtctcactcggtagctcaggctggagtgcagtggcatgatcttggctcacagtaacctccgcttcctgggttcaagtgattctcctgcctcagcctcctgagtagctgggattacaggcacacaccacctcacccagctaattttttttttttttgtatttttagtagagatggggtttcaccatgttggccaggctggccttgaactcctgacctcaggtgatccacccaccttggcctcacagagtgctggggttataggtgtaagccattgcgcctggcctaactcctgaaattttgaagtagtggtgagcataaatgatatttagaggtatctgcaccaactataatgtgacaggaaaatagatgattcctactggtgaccgagtcagttagttactgctaatactactgtgatttgttacctacctttagctagatttcagttagaattccattaaaaaagatatcattttcttctcatccaaaatcacgaacctcccctgaatttttcccatgaaccctagattaataactcctactgtagtaactatatacatataatcatcttgtttagaattttgcaaggcaggctgggcagagttggcatttcctattttgtagatgcagaaaccaaagctgttcaggtcccagagctggtgacgtgggcatgttgggagggtggacagagctagaaccaaggcttttgggccaaacgctcagtccattagcaattagcattcattgcacacataaccatcattgccattaccatcatcaccattttcattatcatcactgtcactgccaccatcatcatcatctccatcttcattatcagcaccactatcaccattttcacgtattacgtgccaggtactgtgctggcccatggtacaggtcaaggagaagtaaggacgagctctgctcctaaggagctagttatctagatgggagcttacagtctagagttgaactcagggacctttctgctccttcaggctgctggcccttacacacgaccaggactctggatttttcaagcccttatgaataactctattgtatgaatgcttctccacaccaccacagtttccctacacatgtgcctttggtcatggactccgtatgtgctgggaatgattgtcttcttcctctccccttcagtgttccctgagtgaacttcacttcatcgatcagattgcagaccaaaagctactctctcagtccttacagtcttacaacactgtaatttcttccaccatcattgccattaccatcatcacaatttccattatcaccactgtcatcaccaccatcgtcatcatcaccatcatcatcacaatttccattatcaccactgtcatcaccaccatcgtcatcatcaccatcatcatcacaatttccattatcaccactgtcatcaccaccatcgtcatcatcaccatcatcgtcaccaatttcagtatcaccaccatcttcatccccattatcactaccaccatcaccatggcaatgaaaacatatgagcattatcattacaagggctttatatggattatctactttaattctcatgaaaaccccagagacagtacttttattaacccatatttacaggtgtatgaactcagcaacttgccatagcacatttctgtgattctgtgattactgtctaccctttccagtagactacaagcttcatgtgagctagggttgttcttgtttttgctcatcactctgtgcctggcacacagtaagtgcttagcgagtattcacagaatggatagatactgaatccatcaataggcaaatacatgtccagcacctaccacaaccccagccttgtggtgggtacagtgaaagacaggaaacactataaacgacaggctttatcttctaggaactcatagtctgactgggcaaatatgatacaggcacatataaccataggttaaatgagtttcgaggaacttctggaaaaatggggactagggcaagggtgaaaagccagcatgctgtggacttggttggtggtcagggatggcgtcatggatgaggcagggcttgagtcagactaggaggggtgcagggaggagagaaaaatggacattctagacagaaaacagactcatcagagatctggggagcagaccagtttggcttaattgggagattgctctgggcagatgacacagattgaaaaggtcatacatttttaataaagataacatccacacaatgtaaaataacaagagaccaagaaatgattttatgatgaaggggatctaagtgtctcgaggaagagctgccttttctattttccacaaaggcgctgtgtggattgctacaggcagcaccgagtgcctactccatgcaggctccatgcagactggagggggatcaggggctctgctgtaacagcagtggtttaaaattaagcatttaaggtgtacagtttagtggaattagttcattaacaatgttgtccaactgtcacctctgcctggcttcaaaacatttcatcagcccccaaaagaaaaccccatacacattacacagccactccccattcatgctagcccctgataaccatcagtctgtcttctgcctctatggatttaccaattctagatatttcatataaaggcagtcatacaatatatggccttttgtgtctgcatcttttgcttcgcataatgttttccaggttcatccatgctgcagcaggtatcggtgctccatgccttgtttttgcctgctcagcatccatttatgatttttctgggaaccacattttgctttactttggactcatccttaaatctcagtttacttgggtctgtatcctcaccctagcaccagggggtgggaacatgacccaggatggatcagagcatcccatctgtctggcctccataatcaattcagggatgggccagcaatgcaagctgggtctgagactaggtcttggattgttgctggagttagtgagaaggaggggcttttctatgagatttctggcagggaggatgtcagcctagggctgctggtagccatctcatcaccatgaatatagaggttgtctgacaatggagcaaactggaaataggagacagaaagacacagtgccaagcgcttgatgggttcacttgagattctggatctcactgtgcctgaccctctcccagacttgtgtgttatgtgcttaaggcatttttgagatgagattcctcacttgcatttgaaaaagtcctaatacatgcctgaatgatttcaacttaatcacaaccatgatgtgtggggaggttcttaggctccagacagggcaggtagccagggctgtggcacaaaaatgcttcctcttccactgagccagtctgctcagagttctagagctgtctgcatttctgcaacagacctcgttactctgtcttcagactggagttacctgtctcctcgcaggtagcctttattctcactacaacacactttggctctggactttgtgcctcccttccaggtcctaggacagtgcaggtcagctgctcaagaaaagtctactgtgatgaggagacttcagggtttggaagctgaagatggtcctgccctggtagtcacgctgaattccagaaagaattccctctcaccgggcttcccacaaatccactgacattcactcaggggaattacttgaaacctcattagtaaacctacattcttagcatttcttttctgcatgagcagaaaacccacctctagacattggctactatggaagataatgacatagtacacctaagtcatcacaaaatggatgatggtgtaatgaaatggcgatgacggtaacgctggcagggaacagacttaattcggctgaaatgtgcttttcatctgtggggcagtgtggttttacctgtcaccagctgggtgacttcaaaatgttaaggagtcctctctgagtctcagtttctttcttggtaaaatacaaagttggtctagatatgggttgtaaagttagatccctacagggcggtcagacagataatggaagcgtgtgaagcagcctgaatacgaaaaaacaaggactgatgaaattagcagagaagtgaagaacacacattctgaaatgcacttccactcctttaaaataaaaaagcatttctggttgaataaaacatctctctaggatgaatccagcccataagccatcggtccagtcacaataatcctgggttaggtaattcccaaggtactctccagctttgacattctataagtcacattgttatactcaggaaaagggcatggggcaagcaatacatctcatatggatacacgggagcccagagaagactggcaacttttctaaggacacacagaggactcaacacaagggtagaaccaatcaaaagacccagctgtcctatgtcacgggtcttgctctttctctaacacatctttccacatgcaaaatctgagctcattagcaaagccatgttcttgctacagagcagtcctctctgtgtctcagtttcccccttggtaaaatacaaaattgggctaggtctgggttgtgaagttaaatccctataggggtcagacagacaatggaagacagataatccaagctcattagcaaagtcatgttcttgctgggaaggaactcagcgaagattttttgtaatacagtattaacccactgaaatgtaactgagctctaactgggtcatcaaaggaagcccctgagtttaggaaaataaaaccctgccttgactctggctagtgctaattatacaaaaatgtccagtcgatgcacttaaccatgcttgaaactttcaattttagataatttgtattcaaacttacatggttaccagactaaccatgagagacagacagagaagaaatacaggtgagaggactagcaaaatttttctttccagtttttaatttcatgttccattatatgggataatagcatcgtcttgcaattttaatgtgatgtcccggaccataatattcaaatacaatatttatgcagtcatctccaaaatgaaatattcatgggattgggagatgggttgctgtatttatcacattcaaaaactgatatgctgcaaacgcatgctttggttaactaagagtaaatggagacaaccaattccctaggtctcagaaaagtttctggagtcacaggggtgaatggggacttaagtcttggactaggagatggtggcagaggcccagcaacagggtatctaccaggggagaggcatcagctgtttgggcagggatttgcattttttcttccctttctttaccataacttgaaaaggtaaaattggaaggcaaggtaagtcagtgaacacctgagtgactttttataaaatatggctcaccaacaaggggcgcatggctctctcacctgaggcgtgaagcacagatctgtagcaataagccccatatacaaaaggtgaccaatgatacgctcttccttttcatttcccattgagtaggttacctggggcaactggggcaacaggtgacactacagcaaacagacattgggtgatctaggtactaatcctgcctctgcattcacaggctatgagatgtggggctggcttaacctctctgaatgccagtttcctcatctgtaagataagccccatgacacctgtgtcttgacagcctcctgaatcagctgcaaagtgtgatggatgatgcttctcacagggccttgcaaagtgtttagtaagcgctgttcacccaagcaatgaaccgactcaaccatcaatcccttcttacctaaggatgacatccctcccccatgcctggcatcctcaatcctcctttcatgctttgtatttctccacaggacttttcactttctaacacaatatacaagatatttatttagtctgttgtctatttccactcactagatgtaagctgcaagatggcagagatttttgcctatttttgttcactgctgtatccctactgcttacatcagtgcctaccatacaactggtgcttaataaatatttactgaaaaaatgaataaaaagaagggtaacagccacacctgttgggcaatcaggcagtcacagactttcgttaactaggtattggatccttctaacacacatttaacagaaaagaaaattgaagctcagaaaagttatgtaactttcccaaggtcacacagccagaagtcttgaatttaaatgcaggtctagctggatccaatgcaagctcttaactactctgccatctttgatgccctgattcaccatagtcccaccaaaaagatagaaagaacggatctgtgatcttctaatgcttgaaaaagacaatgcccagaaatgagagagaatcaaaagagaagggcttattgttggctttggaagaatctttctgccagacctctggaagatatctgtcttctacctgaggtcaaatatgaaatcatttgcattcagttttacttcctaggctatgaggaaggggcagctcaccttcctgatatttttacctattagcacactaaggaaaaagtcacagctaaatatgatcctattgggacatcccagggaccaaatctactcagctgagcatcaaagtaaatcagacagagggtgggaagaagtcctgattctcccccatgggagaagaagtcagttaaaaaaacatctgtggcttttggaaataatgtcagaaaggtggataacaaagaagtttctcaattcagttaattcactggctacaatcttggtatattcatcaagtatggaattattccagaattaagctgtcccactgtaagttttagaaggaataactctgctcttcaagtttacagcatgtctgagcaagaaggaatcttcacaagcagctaatatagctaatgctacaaattaaaaaaaaaacaacctgagaatgaaagtacaaatgatacatccaaagtcacaatgcctagaaaaaataaaatctcccccttttctgttttcctgtctggtaatctgtcattgaatctagattactccttcagcataagtacaacctaaggattttagttaaaaaataaagtcatggaataaatcatatagacccacaatgcatgaaatcagtcagctatgtgaacaggctcacacatctcttcctaggctctcaggaaagggcagtttagctgcctgagatttttctctactggcacaaagtcacagctaaatattattctattgggatgcagtggcaagattttgagtcctggaatcagattacttggcccaagtcttgtgtcttctactaaccttaggcaactttaatcatatggtactttggtttctcacaggggaaatggtgatcataatagctaattcacagagctggtgtgatgattcaaatgagattgtatacagggagggcttagcacatagtaagggctccataatgtccattacgatgctttatgtttttttcctttatcagggtgaatttctatctgtcctattctctcttctgggatttggtagacaggtacataggacacctccacagctaagaagaaatcctttagtctggcagagcaatgatatttcagcaccaaggacagaagtccttgttttagttgtgcaatagccatgattgtggcatgaaggtgacaagtgtcctggccatccttctaattctgtccaagctctggatgagctcgcgaggattcagctccctgattttgaagtttggcagttcctcagggcccctgctagccatttctctcaggcccacggtaggctgtgccccttctgggcctgagctggagtcaattgttattcctctatcctacagtagctggaagatcaagaatgcttgaggaattcattcctttagcagcactagagagcaccttcgatattccaggctctgctctatgcactgagaaaatggttttaaataaaatggacatcaccccgcccttctctctcttctaggcaagacaaaaagcgtaaataataacagctaccatttattgagcgtatactacattctaggctctgttctatgcacttaatatatattcttctgtttagaattcactgcaaccccatgagggctcattttacaaatgaaggaacagagacacagaaaggttaagtaaatttcccaagacccacacagctggtgagtggcaatgaggggaatcaagccttagtgtcaggctctgcattccacactctagccacaaggttctaataagtaagtagacatcgagaaatatgaaacacaaatataaaattacatgctatataggaacaaatatgggggtaatgatagaaaataaagagacagggacttaattagtggagatcattggggaaggcttcactgaggagcaggtggcatgcaagctcaaagagaaggaatcagtcctctaaggagttatggggaaggcctttatgagtgacagaaaattgaaagtgcaagggccctgtggctgccaaaggaagctacagggaagtcctcagcttcagaacctcacttcataggggccgacttgatctgattggtggaagggacataccacccacaagtccacgtggcttggatatggagggaaactccgcagtcagcacccttagggagtcagtgcagcatggtggttaagcaccctgacttcaggctgggcgtggtggctcacgcctgtaatcccagcactttgggaggccgaggcaggcggatcacttgagctcaagagtttgagaccagcctggacaacatggcgaaaccccatctctactgaaactacaaaaattagctaggcatggtggcacatgcctgtaatcccagctacctgggagactgagacacgagaatcgcttgtaccttgcaggtggaggttggagtgagctgagattgcactccagcctgggtgatggagcgagactctgtctcaaaaagaaaaataaaaagaaccccaactttggagtcactctgcttggcttcaagtctgtctcgccacctatgagctgtgtgttatttaatctttctagcctcagtgtccccatctggaaaatgggcacgatgatgatcgcatttatgtcatggggttgttgtagaaagagtgaatatctgtaaggtgcttaggataatcagtggcacatgtaccagttattattgctgccctgtgtggagaaagctgacttaggtttgacattcaaggatgatgattagttcaatgtcagaaaaggggagctagggaggcagctcagatgccatcccggcctccaataggagaatgctgcctctggcagatggggttcaggccagagaagagagagaaacttctctataccacttctgacctggggctggaatctacctgcctggctttcttatatttcccaaggagggcagaaaaagaagctcaagtagaaatgcagagtcagtggcctgaatcctgaggctggagtacctgggcttggtggctcacattcttcacagggctcacgtcactgaatcagcttgcatcgccaagcgtctaaaggtctgttgagggctaattggttttccacatttcatgtatttttgaaaacattgtttactgccttttttctgattataaaaggaatgcatagccttgatagatggtttggaacataaaaaaatgcaaagaagaaaataaaaatcatactctacctttcagagatgacactgggaatgtacttcccctctagtcttttgtctaacttctttgtgtattgtttggaaagaagaaaagttctaaagatgacctaaaaacacacgctgaggcccagggaggtatgtgtgtgcagttttgtgtgggtgcctacataatgccagactttattttgacgtggctgctataattggattaaataaagtgaacatgcaaacagtcatgaacgcatcggttgggtttaaggaaagcaaaagagaaatgcaatctgctttccctattggagatgagatattaatgatctccttgcatcagtcatggagctacaagttagccagaaacagagctcttctctcaataagcaagctggcaccaaaggccttcccgaatgcggatttgcctggaggaggttcctggccaggctctcgactgatttgccaacttttgtttaaacatttgcttgtttatacatcaaaggaggtttgggtctgatgattagttcaatgtcagaaaaggggagctagggaggcagctcagatgccatcccggcctccaataggagaatgctgcctctggcagatggggttcagaccagagaagagagagaaacttctctataccacttctgacctggggctggaatctacctgcctggctttcttatatttgaaatgatagctgtttctcttactatgctttgccttactttaagcataatacccataaatcatgggttggagtggctaattttataaattgttgtcgatacatataaggtcaatacctaactttcatcacatgcccacttataaagggcccaaaagaatctcccatgtccccagtggacatgagagttattgaacataagagttattgaacatttttgtaacatcttaattatgtgtatattatcatcaagattcttctcatatcaacaacaccatcattatcaccactactaccaccaccattgtgatcatcatcaacttaataggcgcaactaactgtccccaagggcttttccatatattaattcttgcaacaactctatgggattggtatgattatcctcattcccatcttacagatgagaaaactgatacacaggtaactcacgtaacttacccaaggtcacacactgtgagtgggtattagagttggcccgtgaatcttgacagtctggctccagagcctggattcttaactgctatgctatgtgctttatgtagcatcctatacaagaggccccttaatattctgctctaagccaactttattatttttagagacatgatctcgctttgtcacccaggctgcaatgcagtggtgcaagcctcaaactcctggccttaagcgatcctcctacatcagcctcccaggatgctgggattacaggtgtgagccactgtgcccggcctctaagctaactttaaatagcttcaactgttttctttcaatgtagccttattcgaagcataatatccataagtcatggttggagcagctaattttataaatttgttgatacacataagatcaatacctaactttcatagcatgcccacttataaaggacccaaaagaatcccccatgtcctggtggcacataaacacactttgcaaaatgctgaccctaggaagtaggggaaggacctaccctcacccatgcaaaaagataattctatttacattcagcaggattttctttcatctgcacacctcgagagcgtaaacctgcaggtcctctcaaatgcagtcactatggagtaataaaagaacacaggccttaaagtcagacggaaccaggttccatctcagctctgtcgttcactagctgtagggccttgagtaaggtaaagcgactctcaaacctcagctgtattcatttctgaaatggggtaacacctgctaaatgaaggtgaaatgagaaaatgtcctggaatgcgcccagcgtggggccttcctgtggccagtgaggatgctccatctccccaataccatgatcattatttgaattttataaagatggagaaacagaggcatggcctgtcgaagccatttgctgacatcccatggctgtggtatagaagagctggcatttcgacccaggtggctggactccagcatctatgctctggcacttcacacactgtgtcccagggctaacatgggggccctggtgaccctggatgaagtggagaaattagatcaaccagggaaggaaaagtctcagaaaaactccgattttcactttccagctccctggaagaggcctgtccccacacactgagacttgaacaggtttcagagatttgaaaaacttctctgatgctccctgagccaaggccagggacttgtagggatgtttccaaatacctgattattcaggctgagagtaaacatgcggccacctgcttctgcaagccctgctgaggctgcctgggaaaatgacaattgtgctacctgtcttgcaatgtatctagtgactttacttttggaggaaagcaaggagaaacagtgaacacaaccctccccttcatttaataacagaaacaatcaggaccaatttggcagctattagaatactagtttgcctttatgccatctcttcacagtgggagccagaagtccaaattggctgctaaaggttggagatgaagacagaaggtcaacattgctattaggagctacgtggaattaaaaaccgaggcaccccgtggcctattctgtatttcactgcttgcctttgttcatccccatctctctgtctttcaagatctctgcctctgtcacctcctcttttaccagggctggtctggacacatgaaataccagaatgggaagggaatttggagactttctcatgcaacccccttgtttttcaaagggagaaaatgaagtcaagagaagcagagtagctgcctcaaagtcaccagtgcattggaagaaagcaggcctagaacacagagaggcttcatcacgtgagaattatgagcttggactctgtgaacactcacttgggtgtgagtcctccccgctgccctagtgctgtgagtttgagcaagtaacttcatctttttgagtctcagttcccttatctataaaaggaggctaatatattgccaataatccccacccagtgccagaaaattaaacatacacacagaaaaacagaactaatagagagtctgggcctgatgatataatttgcacagcttgatttagccatacctgaagtcagccctaatgttttagttacctgatctggtaatgttctttacccttaagctagtttgagctgggtttctgtcatttcccaccaaaagagttctccctaacacatcaccagtgaaagaacttgagcaagccacgcccagctctggtcacttgggagggaccatggatgatgggctataggtaggcttattcgtgcagcaggtgaggccacagctaacaaagagggaagtggccagtgaatgggacattggcttgttttactattaaattaatgctgaatcactgccctaacttccggtaaatgagaaaatcccagctggggactcacacgcaagagttggaagttgtgagctattctgtcaagaggcctttgggttttagggtcttggagggaggtgtaagaagcatttcctcagcctgagacttctttatgttgtcccaagacatctgggtaccacctgtcaattacggatgcacatcaattatacaaaatgtactcaggcacctagaggcaaaattcaggcccattctccatctatttctttctcctaccagcaacaatttagttctatgcttatcataacaatgacataatcatcaccatcaccatcatcataaacatttactatgccaaatgctgtatatgcagcatctcatttaatcttctcaatgaataaatgagtataggtctattaatattttcaaatattatgaaaccagttcagagaggttaagtcactcgtccaatgcaacacagctagaacacagtagatcagaattccaaaccagaaggtgtaacctcacagtccctgtttttaacttgtgctatactcagttcctagcacagtgcctgacaaatagtgctcagagaataaatcctgactaggctgaaatagttaatactagggtggatgtaattcacacacaagttgatacatttacaatgggctcctttctcgagacacaactttgcacaaatcacctattagctgctacctggagaagaagaagggtttttccttctctacctgagggcgaggaataccaatgtctgagccacttctgacaattaaccacctccatggaatccttgcccagccccactttgctcctgcagctatggggccagaaaaacttgggttcaaattctagcatttaaccagctgtgtgatcttcagaaaaatcaggtaaactccagaagcttgacaaatggggagaataattcttacagctgcattgagtggctgtgaaaacaaatatggatcctatacaaaaagggcccacttagtaggaacacaatacacagtggccatgattcttcttactcatccagccaggcctctgtactcttagtggcctgagcgtagtaaactaatctgtgctaatttacagagcatcttcaagttcgggtgttgcagaaagaggcctcctttttaatgtaaagaaggtaggctgtgagtaggggcaggaacaatccataaatagcagaatgaaatcaaagtttcaatttagaaaaatgatacaacacaaggattctagggttacttttttttttttttctattttgagatggagtctccctctgtcacccaggctggagtgcagtggtacaatctccactcactgcaacctccgactcccaggatcaagcgattctcctgcctcagcctcccaagtagctgggattataggtgtgcaccaccacacccggctaatttttgtatttttagtagaaatggggttttaccatgttggccaggctggcctcgaactccagacctcaggtgatccgcctgcctcaccctcccaaagttctgggattacaggccttgagtcacggcacctggccagattacttctttaaagctcaggagacggagctacctgcttgcttttgttcctcccatgctgtggataactgggtaaactgtcacagagccagccaaaatgacactcccaccaacaacagcagtgaagatttaaagcagagattacaaacagagatgtggtcgggggccaggttggggaacggggacaggcaaggaccgagcgacctaagatccaggaaataactgccatgagaaaattcaggcacagacttaatggaccttcagattttttaagactggctagaaatctggattttcataggaaatactgctgtttttaaatggggctattaattttcaaatgaagcacctgaatgaaaacaagacaaaacaaaacactctgagagctaaaccatgcacgttaacaagctgaaatgatcccaagcactgccaggttcaatgctagaacaagaccccgggatgtcagagccaccctggactggtgtttaatggtgttttctttttttgttttcttttttagatggagtctcactctcttgcccagggtggagtgcagtggtgcaatcttggttcattgcaacctccgcctcccaggttcaagtgattctcctgtctcagcctcctgagtagctggaattacaggcatgtgccaccacacctggctaatttttgtatttttagtagagacagggttttaccatgttggtcaggctggtctcaaactcctgacctcatgatctgcccgcctcggcctcccaaagtgctgggattacaggcatgagccactgcgcctggcctttaatggtattttctattggaatgaggaatcccatcacgtgatgtcacctacagggggcgctcaatactgtatcccttccagttgatggaccatcatggagacttgggctcagctcaatgctgaactgcagagatgctatttttttgacattgttcattttaagcgagagaggtgtgagggatctgggttggggttctgggtgcctcccacccctgctgatgtgttggacaccagtgagggagtgaggaggacatggggctgggatcaggacccctgggttcaagtccatgctggtatgacactcttttccactacaggtcaattccctgagaggaaggacttggtcttgtttgcggctagaacagcaactggcacacgcccatgcttgttaagtatttgaatgagtggctgactgaatgaacgatctggggacgttgcttacattatgggcctcagtcttcccatcaataaaatgagaattaaccgtgggtgccctactgaaagggttgctgcaatgagatattggacttgtggaagtccttgggggaagtaatcaaaagggctgtcacaccatgagaaacatctatggttatcttgtccttggctgacagaagggactacttcagatcccacgcagacacagcgaaggacagctggtgccaagcctttctcccaccctcaacctttctgtggctgcatgaaaccagcctagaaaattccccaaatgatcactcagattttcatttccattttgtacaggggtaggggttgaggtgctaccttgcattgtcccggccgtgtgacttcaagaaattcatatctcggtatcgggagagaaacgccaccaactggtcatttgtcctgtggaaacaaaccaaggggagagtcaggccagacaccgtgggtactgtctttgtcacagaaagcaagtttcaccaattatgtcagtctgcttgaagcaccttctctgatcatttgcacacaggctgataaggcatcctctttatatcgccatttttatgtcaccatcactgactctatcacactatgttaaaatgggctgtttgtgcatttctctcctctatactccaatatactggagactctgtgagggcaagtgtggtgctccacatgtttgggaatctccagtgcctggcactgggcttggcaaacagcaagtcagcccaaagctaaatgcacagcaacctcaggacctttgcatttgcttgcctgggaaatttctcccagtattgctggcttggctttgtcatcaggtgtcctttcaaataccacctctttagagagaccttttctgaccacttaacctaaagtagtacctgcctcccgctctctccccacctttattacatcactctgtttataatacttcactcttgtatcaccagctgaaagcactgaccttgcttacattagaatgtaagttccacgaggacagagcccagctggatttgttcaacactggcatacagtaggagctatattaatatttgttgaataaacaaatgaatcaaagtgatgtgtgttcaaactgactccttcaaatgcactttgagcaatgaatgcatcaatgaatggacggataccaagtcctcgataaccacggggctactgattgagagagctttaaaaaatatgaagtccaatacaaacgagtgacatcgttgccagcattgttatcccaaatttatccccatcaatctcagcactagcagtgtaatcacagctaatccgcttgcgcatacagctgtgacagtattttaaaaggcagtcacacgggtctccatctgccagaaacgcagtcgcctcttctgctgaataaacccaaacaggtaaatggtgctgatgtgacagctcctttatcaccagccttctctgcttcggaatttttacttcaaaggaaagcgttaactattgtttcaaatgggaggaacagagaagagagcagaaagataaaaaaacatctctggggttataatagaagctagaccttcgagaagcaggacagtgctttagaaagcaatgcttgggcagaaacagaaagatctggggacagatcccagctccatgactgagtcagctgtgtgtccaaggatgtcatttaacctcactgaatggcagctttctctgaatgcgcctaggttgaaaattaaacatgcccagcacctagtaggcccatcatgcatatatactgaatggacaactgggtggatttaaagggcacacagtaggggcacaatcaatgcacgtcgtcctgctctgcctcccaactctttggtctgagctgcccctactgctcaccccctccttcatttccctgcgcctctgcagtctcgccactccaagcccctgttctctcattggatgactcatgttgaccaactcataattccagcggagggggcacaaagcagttaagagaggcagcagtgaaaatgagcgctgctcgtgtcccatcctattactgaaataaacaccaattcaaaaccagccattctagcagcggcaggcaccagaaacaccccgtgtgtctgcagggagttgaatacagcacacacacggaaagctaaaccttgctgatgggcacagaggtgaacccaggggatgctcgcaaagggctaaccccacgtgtccctacaatggtgcatctcccgcgtggttaaaccccatcgtgcatgccaaggtaaagtccactggtgcctccgacactgttacctgtagtttgtggggacagagcctctttaataagtcgctgggagaggtggaaactaaatcggcctataaaaaaatttaagcaatgtttctctccaaaccataaagaggcccattccaactgcgttttaacagctcttatttaccaaccccctcaccactctccgcaacagttcattattgttgtcctgatgaatacgagacaagttaacctctgaatgggtccccggcagttggaataataaataaggtctctcagacacccttagtgggaggattgaaggggccgggccggggctcctgggcccccttctcgtgaagcctcaggtctcccagggtcagcggctgcagttccatttggcaatcccagaaagcgcctttcagggctgtgagctggggccattttcacatttaccgcttcaccgagtccccatctgacggggatgaataggcatttagcgaatttacttagcgatgcttccacatgaaatcgtctcaaaagatgacatcttgggggagggagggtggatgaggagggggctgaggtttccaggcccagagcttttgggcaaagccgcctttcaaagccaagcgctgtgtgcttggcaaaggatcctgatggattgtctggaagggtggggcggggggacccctgcctaccccccttgctagggtctcgggcccctcgctctccctctgtgtgaaatgcttgctctgaatgctaaagcccatccccccagtccttctccaaagggagatggaatttggctgaggaccaaattctcctattgttgctttcagacgcctgtcgataattgcctacataatatttagttctctccagataattaacagcttgcgatctggtgacattttaccccgttccagtttctcgcgcgctctctctctctctctctctcttccactcacacacgtttctcactctctttttctggtgaagtcatttgccaaatggttcccatagttcatctcttgtatctatctcatcatcaatttcctcctactttttgctgaaatgattagaaatcatgtctcttggtctatgccagttcctctgcttcctgaggataactggggcctgttgctaccaccatgggagtcactgggaagtctctgctgaaataagtaagaaataaatgttaaaataaacttactgggagccatatgagaatctttttcgaaatgaataaaaaaatgagtaatacaataatctcccaagtcccagccatttactaaatgtgcaccatgccctaggccatggggaaagacttttgccacattttattgcatttgatagtcacaatgatgctaaaaaatgtaaattttggctgggtgtggtagctcatgcctgtaattccagcacttggggaggccgaggcaggtgggtcacttgaggtcaggagtttgagaccagcccggccaacatgatgaaaccctgtctctactaaaaatacaaacaaattagccaggtgtgggcatgtacacctgtagtcccagctactcaggaggctgaggctggagaattgcttgaacttgggaagtggaggttgcagtgaacacagatcgctccactccactccagcctgggtgaaagagtgagactctgtctcaaaaaaaaaaaaaaggaatttcacttcactctcattttacggacgggcaaccgagacttagataaatcatccatttagtaaagtgcagaaccagaactggaacctggggacaaatgtcacagcttgtgttctctactacgagactgcctctacaaatgatagtgaatgaacgagtgaatgaatgaatgaatgtattccatttcaagtgcagaagaaaaaaaatacaggcgcaataatgtcttcctcttcatagcctggtctgcagcccactgctattagaaatgccatacttcaggccccacccaatacctattgagcaacagagctcacccaatatctattgagcaaaaatgtgttttcaaacaagattccagatgatgcatgtgctctttaaaatttcagaagcattgctgtaagtcatgtatgactatgagtagttaattctctgctttccatctttatctgctcctcatggtttcttctggagaacccggactatgaatgaattactttcatttcaataagccttaggtcttgagagtattaaataaaaacaatgcacctaatatctgtgccacagtacttggcatatagtaatcccctgataaatgtcagctattatataatagcattattattaccatcttgaacatcagaagcttaagacaccttgaactgtggaaaacagtgtaaagacccaacctgatttgaacttggaaggctttctgtgcataagacccatggaatgttctgcagagcatagtttaagagatgtccaaggccccttcctggggatttgtccaaggtcccttcccagctggtgtcagacttagggactggctcccagagggccatggcaccattgtgtgtgtgtcttatctatataacagctctggacatgaagatatgaaggaagagagggcagagttctcaggttcccatagcacccaggagcccaggctgtatggaaaaggtgccctgggcacacagaggcacacaatgcctgtttgctggtggcatgtgacaagagatgaagcctgctcagcttccactaggaaggagcccaacacaaagccaactgcacctctctgggctcccggtgcccacctggcactcatgccccagaaccccttcccgactgcaggatactgtcaaggaccctgccagaggtgctcacagcccaacggtgaggtgacaggactaaagccaaagttatacgcaggattttgtgaatgtcaggattcaggatttcaaacctctgatgctgccaggtgtgcacagagcccaggggacactggagtaagtcctcctggactgcaatgaacgacccattgtggggcagaaacacacatgaaagactatggggaggccaggcatgcctgtaatcccagcactgtgggaggccaaggcgggtggatcatttgaggtcaggagttagagaccagcctgaccaacatggtgaaaccccgtctctactaaaaatacaaaaattagccaggtgtggtggcatgcgcctgtgatcccaggctgaggcaggagaatcgcttgaacccaggaggtggaggttgcagtgaggagagatcgcgccactgtactcccacctggaaaacaagagcgaaactctgtctcaaaaaaaaaaaaaaaaaaaaaaaaaaaaaaagaaagactatgctggtgcatgagggactgtgaagtcaggcaagttgaggaagttgagggttgaggtgctttcaacctaagctgagaatagactacaacagtgtttccccaacttctgcttctagtgtacccataatctttaagttatttcatatgtctatttaatttaaattctactttagctttatcttatgcaccaatgtttgtgatatttgatgtcacaaatttttttttttttttggagacagagtcttgccatcttaaccatttttctgagatcagacgaggttgggtgtgttcagggtgatatgtctgtagaccatcttaaccatttttcagtgtacagttcagtggtactggatggattcacattgttgtgcaaccatcaccaatatccatctccagaactcttttcatcttgcaaaactgacactctctacctgttaaataataattctctatttctctcttctatagcccctggcaacccccattctacttcctctctgctattttaactattctaggtacctgacataagtggaattgtacaggatttgtgttttgctggctgacttatttaactagcaccatgtcctccaggctcatccatattgtatcataccttagaatttctttcctttttaaggctgaataatactctctcatgtaccacctgtatgttatttttttccctgttacacattaaaaacattaacgaccacgtgtctgtatacttcttaaatcaactgggctaccagaggcacatatggaagaggtcaactgtcctggtttgcccaggactgagggagttcccacaacacaggacttttagttttaaaactggatggtcctgagcaaatgaagatgagctggtgaccccaggcacatggctccattgagggctgtgtaaccacaggagaagtgcacactccacagaggcaaaaatctcaccctcctgtgatcaacccaatgtatagaaaacaagataatggcagggcctattgtaaccttttcctatgcctttaaaatcattatgaaagcttagatcacagcaagataaagactgaaataccagcaatagcaacatcatcatcatctaacacttgaatgcctcctatgtggtatttgcatctattaacccacttaatcctcatgacaaccctaagaggtagatgctattatatttatatccatttgttattatataaacgggaacatgtatatacatggatttttgtgtaatgacctatgctgcttctctcactcatcagcacgtacaggcagacttcatccttttaacggttgcacaggatcctatagaatgggcgtagccagctgggcatggtggctcatgcctgtaatctcagcactttgggaggccaaggcaggcggatcatgaggtcaagagattgagaccatcctggccaacatggtgaaacctggtctctactaaaaatacaaaaaaaaaaaaattagccaggcatggtagtgggcgcctgtaatcccagctactcggaggctgaggcatgagaattgcttgaacctgggaggcggaggttgaagtgagccgagactgtgccattgcactccagcctgggtgacaagagtgaaactctgcctcaaaaaacaaacaaacaaaaagaatgggcatagccaatgccctagtgatggacacttaggtcatttccattttctcccccttacaactactgctccattgaacacccttgaataactatcttttcacatgtgggcatgataggtttctgtaggatcaaatttgcagatatggaattgttcactctaggattatttttcagtctttaatttcagaaagcaaactacacggaatgagacttctctaagaattgcccaagactcacatcattgcacagaaaccaagcctgtggctgccaggagcatggggaggaagaaggaaattgcaaaggtgatggagttgggatgtcttgcagagctggcaggctcttggctcctccagcaggctggtggggttaagcaggggccttctgggttccccaaaggaccaaccaccagcggaccctggaaaacaaaggaggctcacatggagatggaaaggaccttctgtcaagcaacggggtcagggcagaaccatcctctcccatgcctggagcagctgctgcagctggtgatcatctgtctgccaacagaaccagcatctggactatggggcagcacctcggacagtgcttttcaggaccatggctgtagtcctgggatgagcaggcattgagtccaattcccatctgttcctccaggacctgacacatagaaggtgctaagtaagtattcactgcttaatgcaagcccaagtagaggcccggtatgcagggttcatctctgtggcttctatgctcagcacagacagtacctgccccatgggaagggctcagtccatcattcacttttttttttttttgaggtagagtctcgctctgtcacccatgctggagtgcagtggcacgatctccgcttacagtaacctccacctcctgggttcgagagattctcctgcttcagcctcttgagtagctggaattataggcgtgcaccacaatgtccagctatttttttttttttttggtatttttagtagagatggggtttcgtcatgttggccaggctggtcctgacctcaggtgatctgcctgcctcagcctccaaagtgctgggaccacagacatgaggccctgtgcctggcccatcatccacttctgtatccacatctctgcccattccataccctctgccaggaatgctcctccctacgtctttgcccaatgaactggggggtgatttgggggaaggaatcccagagtcagggtactcatgagaaaatgcttcataataacaattgcagaaagatttccctttgttgctcaccaagtgttaagtgctcgtcctccttaattttacaatacacatccaggaggtactcatttgcggatgaataaactaggactggaagagccttcacagcttgtgccaggtcttatgagtggtggaggggagatgcagacctcagtgccccagggccagagcctgagctgttttcaatcccgctttccccgtggtgaataagcttcaggaatgtgatccatttctgtagacagaggcaggaaataaacaggaaactgcagctgccttctgaagcctactacttcccttcaaggggactgttgttgagtgcgagtcgcacaacaggaattgatacaggtagaacctctgttcagggtgtatgtctttttcctgtgctcctgtaaaatctgaagtccagtaagtttcctcctccccctgcctcatgaatggattctaacccatccttccatctcgtgaatggattctaacccatccttccatctcgtgaatgggttctaacccatccttccatctcgtgaatgggttctaacccatccttccatctcgtgaacggattctaacccatccttccatctcgtgaagggattctaacccatccttccatctcgtgaacggattctaacccatccttccatctcgtgaatggattctaacccatccttccatctcgtgaatggattctaacccatccttccatctcgtgaacggattctaacccatctttccatctcgtgaatggattctaacccatccttccatctcatgcatggattctaactcatccttccatctcgtgaatggattctaattcatccttccatctcatgcatggattctaactcatccttccatctcgtgcatggattctaacccatccttccatctcgtgaatggattctaaaccatctttccccacggcttatctgggggaggaggagacactgccagtgctctctcctccacactccagacggtttatgcaaggaccttactgacatcttctcacccactggaaaaatcagggaagtccagggttgcagaccaacagtgaataaaggccaagttcgggacttgctgaagaagagacaagagcaaaagaactggaaaaaaggcaaatccctgattcaaatgcagtcaaagcacatgcacttgtatgttcactgaagcactattaacaatagtaaagacatgggatcgatataggtgcccgttaatggtgaactggataaggaagatgcggtacatacacaccatggaacactgtgcagccatcaaaagaacaaaatcatgtcctttgctgcaatatggatgcagatggaggccactgtcctaagtgaattaacagaggaacagaaagctaaataccacatgttctcacttataagtgggagctaaaaattgggttctcacggacatgaaaatgggaacaaacactggggactactagagagggaagaggaggagggcaaaggctgaaaaataacctagtgggtacaatgctcacttacctaggtaatgggggccttcatacccaaaacctcagcatcacacaatatacccctggagcaaacctgcacacgtacccactgaatctaaaataaaaggtgacttttttttttaaagtttaaaaagtagtccaaatttacagagacttattttgctaagatacggaggaaaaggtatgaaaaatgctaaagagtatgttttcctggactccacaggcataattccagccaccatgagcaactgaggaaaagtgaactggataaaatgctggcccggcctccaggctcctctttacctcgtcctccaggaagcagctgcaggatcttcctaaaacatgagtctgaccatgtcaccctttgactcagtaccttcagcggctctccatcatctgaaggacaatgtccttaccccttggcaaggcatgcaaggttgtttgtgacccggcactgcctactcaatctttggaattacttgaagttttctaaatgttctgtgttctttcataactctaagactgtgcaagcactgtttggtctcctgggaaaaatatgacttccacttcttcaataggtcaggccctgtgacaaacgcctgggacaggagtgggtaagatggttgtggcacctgtcctcaaggaacgcacagaacactgggggatgcagacatataggtaggtccctgtgatatgaagtgagacagcagatgaattgaagcacgagcattcaggggaggctacaaaaagtatgctggggacaccagggggacagtacctccttctacaaaggcaggcagtaaactggagaactacctggttgttacaacccaatcagttttaattggatttacctttttgtactgacaaaaatgatgtggcattaaaacacactcattgtatttgaatggaccggcaaaccatttcacaaagcctcagtgctttcacaggacatttgtaagaaacacatttttcattttaaacatacatatgcctttctaagaggcagtttatctgatgttctatcaatgagaactcttaacacaccagcccttccttcagacggctgtaatggaaaggtaactgacaacaatcagcacccaggggccacgcaggaacccaggacgccaccggaatcatgaatgaactaaactgacattctgcttggtgggttggggggcgggcggggagggtggggatcgtgtgtgtgcacatatgtatatgaagtctatttaactgtattttgattctcttaagtctgcttgtcctcacatgccatgaggcatctcaaatgtgcacaacatttagttaaccaaattctgcattcccatacaatgattgattacagccagttatttgatttggtcttcagggaaccaggggaggtccacttcagagggcatcgaaagattgaatcttaaaagtaaatgcaatttaagtaggaaagccaagacacggctacaaggaaagctgttttcagagaggtgtttacagtagtttctctctgctccttgccactttcttgccgtttgatttttagcaagttcctcaggctcactgagccttggttttctaatctgccaaatgggagcatttaacaatggtctatgagttacttgtgtgttgtgggtatggtacatgcagtgcctggtgcatagcaggtgcgcagtaactggagttccttggaaagaagtttctatattcttcgctagaaatgcagagagaaaggcatgtccaccccttgctagtttcctaccaagctgtgacatttcaattcttacacacttgtggttcctagcaaaaatttaagttatgtatgttcaagttgcttgactgtaagctacctgaggacaagaactttatctgggtcatctatgttccccaactgtccagcacagaggccaggaacatgacaggttccatcagccttatgcctatttctctttgggtccccaggcccatttcactgtagcccacggaaactgctcagcacaactgtgttgcaggacagaatgagggcttttgtccataccatccctaatgccagaaacatccttcctacacctttgcctagagaactcctgcttgcctttgcaaaagctggctcaatgtcagttccactgggaaaggctggagtataaataaccattgaatggcactgaactgtactgacacgctgacctttctctttgtgcttatggctgagaacagatgcctttttcaccattcatcctgccctgggtttattcaaataatcaccatgacctataatactaatttgtccatttccatttcaccacataggtcttcctaacgcacctacactaatgtatcagaatttgcagtggttaaaataatgcagatctgacatcagagaaatgtaggtttgagtcctagttctactacttattggctgtgtggccttgggcaggtcatttttagctagtcgatgctcaattttgtcatttttaaaattgaggataataacactatttaccttatagagttgaagatgtaatgaaataagagggaataatctgttgcttgcaactacaaaattctagctgatacagaaactggtatcagaagtcgggtaatgagtgttgagccagtgaaaacaagagagatctagtacagcttaggtaacctagcccacagaatgctagaatgtcagatcttattattgttattatttttattatcatgaattctccaggactagagtctgcactgtgccaggagtaggatacagcaaggatctctaactcccagaactttgggactgggtcagtttggatttcagccccaaggtgagattgagcttgaaggacagttgatagtgtcaccaagcatctcattctccttgggcagcttgccacattcacctgcctgtctgtattggaacaaggtcaaaatgcactgcaacacaggcaagaagtcatacacaccatggaaaaacaaacactgtggtttctgcaacacagagatcgattctggaggatcaggacatgctgcgtccagtagactctttacccacagatttccaaggttacttgtttatctcagagggctgatgagaaatttcaaaaggatttttaaacggattttttctttttaaacagaggacacaggccttgaagtaacttgacagttcctaggcaaagaaaacttcagaaatgatttaaatgagacgttatcacatagatcatcggtttttaagctgcatctgggggaaccccaggttggggctgggcagctggggcctcaagacacctcagtagaggtttccttactgaggactcacttccacccctatattgggtaaaatttcaattgtgcaaaaatggtttagtagcctaaaaacaagtgttcaaaaatcatttaaaaaacggccaatttaacttccagttctcctttaggagaggaaggaggctggcatcttactcaatagcagaactggctgagctctgccctcactaactgcccaatcttgggcagatgacaatttttctgaacagcactgttgcctttataataacaggaatcgcaatatgacatgccttgtggagttgttttggggttagaaggaatgatatcaggttaacctgttagcatgggtactcggtgtacagtaaatacttagtaagtattaactatgttactcttgcagctgtgaattaaatttctttttattccctccttccttccctcctctctcccttttttttctctccctcttccatttctctttccttttcctttgtccttttctttcctttctcttcctgcatcctgcctactcaatctttggaattacttgaagttttctgaatgttttgtgctctttcataactctaagatcctgcaagctctattagctttcctggtaaatacaatttcccagttcttcagcaattcaggccctgccataagcatttgctgagcatcttcctatgtgccaaagactgcgttcatttcttttttttttttttttttttttgagacggagtctcgctcttgttgcccaggctggagtgcagtggcgtgatctcggctcactgcaacctctgcttcccaggttcaagcgattatcctgcctcagcctcctgagtagctgggattacaagcatccaccaccacatctggctaatttttgtactttttaatagagatggggttttgccatgttggccaggctggtctcaaactcctgacctcaggtgatccgcctgcctcagcctcccaaagtgctgggataacaggcgtgagccaccgcacctggccgactgtgttcatttctgacttgagacatgaattctgctttttcaacagctgggtatcactttgagttgtatgggcccatttcattgaggacatttaagcccgggttttatttgactctacatgagctcatacctcctgcttcttgggtaaaagctgttcatttacagatatttctttcttttcccagagaggtatttactcaggggcaataccttagtcctgctccttctgcgctcctatggtgactgatacagtgctttactaacaaacaaacaaacaaacaaaaaaaaccaaattagtaacaaatgtcatctgggatctgatcacataaactctgccgggaagatgctgacacaagttcattgctcgctgatgaattattttcagtgccaggtctctgagtatttaaatggctgcattgtaaaaacaggatcgtattataaattgtcaaacaggacgtgtagtagatgaaggcagatttgtgcacgccacactacctccacgtactcattcagcaaacatttatgttacagctactatgagtcacgtgctgtttcagatgctggagaaacagtgaagatgaagacaaaatccctctgagaatggagctttggtgttccgaggcatccacgtacatcctggattagcttccctctatgcattaagagcatactagtcacataccatccttgctagaatcaagaacacaggcactctgcccacttcctgtgttttgtggctcaaatgaggaacctcagttgagcaaggcttggctagcgccatgtctggcatattatagttgctcaatgcacacagggacaaaggttgaatgcaatctccgagtctgtgccaggttcctggaatggaattcacaaactcggacagaattcctttcatgctaaggcagatacatcagcaggtccagctgagacgagcctaactgagtgacagcttgacgtgctgctgttctgcagaatcatcattcggcaaaaggtgaaataggtttaaagatcatctctactccttaatccttgcggtaccaccttgcaggtttctttatccttctgagcctcaatttccttgtctaagttgagcaaagatttgatgagatcatgggtgtggaagactcaatccagtgcctgccacatagtaatcgcttgattatctggtagcccttgttttttatttggctctgagtgagggagaagggtggcaggcttccccaggctgcaatgtgcagtcatcaaaggttttctcagggaagctgtggtccttgggatgttgacgaacccaagagttagagaccaaaccaagaccaacctctctgtggttgttccctggctggccctccagagggtggccaaaaaaataaataaataaaacacaaaagaaagatatacatctacagaagctgaaattcctctgtttttctactttatcttattacttcttccctttttctctaaagtagctgaaccacatatgttaagagtcattgtaatactgaaaagaatggaaaacaggtgttcgaacaaaacttggccatgctattcatggcagcactactcacaatagcccaaagtagtaacagcccaaatgtccatcacctgctgaatggataaagccaaatgaggtctatccagacaatgggatattagtcagccatagaaagagatgaagtactgatacaagctacaatgcagatgaaccttgaaaacataatgctaagtgaaagaagccagacgtgaaatacccacatgatgtatgattccatttatatgaaatattcagagttggcaaatccacagaaacagaaagcagaccgggggttgccaggggttgggggtcagaggggaatgaggagtgactgcttaatgggtacaggttttccttctggggtaactaaaatgcttgtaactagatagtgattatgctcatataccattgtgaatgtattaagcgccactaatttcagttgtatattatttttggcatattaaatataacttgttttttgagatgaagcctcactctgttgcccagggtagagtgcactggtgcgatctccgctcactgcaacctccacctcctgggttgaagcgattctcttgcctcagcctctcaagtagctgggattacagacatgcaccaccacatctggctaattttttgtatttttagtagagacaggctttcatcatgttggccaggctggtctcgaattcctgacctcaagttaccgccctctttggcctcccaaattgctgggattacaggtgtgtgccaccacatccagccaacatattttaatgttattatttatgtttttatttttatgccacaataaaaatatgacagttgaaccccaaaatttcaaactgagaaataaaacaacagctacaataataaccatgtttggtgtatcctacctattttatatacgctatccacctaatcctcacaacccccctaaaataggcagcagtagctccattttacaatggagcaaacttctcaaaacttgggcaacgtgtctaataatcatgatgatcataacaataataagtatagaatataagagttgcttgctgaggcacttgttacatatcggctcagtttgccttcccaacatcatcatgatgtacatattatcattatcacccattttacagaggaagatgaacagagaggttaagtgacttggcctaggttagacagcccacaggtaacagaaacagggatttgcacccaggtcatttgacctcagagtccatatgcatcaccactggagcccgcaggcgtggtcatggagccgggaaggaatgtggacacctgcagaacttacctccctgtcctctctcatggaaaatgggaacagactaggtatctgctccatgacatcaagtgacttcatgggatccagaccttcccccaggctgcatggaagccagcatatagccagacaggtgtgatatgtgaatgtccctctggcctgccaggctcccagacacagatccttgatatctgtgcaggcacctccactttatgtggagaagcagctgagccaaccttaggattcatgagtacctaccacagctcactgtccttttgaaataaactctccagctctttggaatgttttctgttttcatggtggtgaaatctgaaaacgtctctaggtgaaaagacattaagtaaagacaaaacccctccactggtcctcaatctaggaataagcccagagatgtttttaataaatggggaatgcaaaaaaaaaatgcggtaaaatatcagtgactctcctggcacttagaaataaaggaccacagccactgcagccacagtggtgttatatgggacaaacactgagcactcatttgctccttcatgccttacttcagtaagtacttactgagctctcactatgtgccaggcactgtaccaggaataagacacagtggtgagcaaaacagatgtcatctctccacttgtggaactgtcacccgggcagcttgggtcaccatcactatcatcgtttctcgagccctttctctgggtcaggcaaggtgctacacatttcacagcttcatccttacagtaaaggctgaggcaggtaactgatggttcccattttacagatgagaaaactgaggcagagacaggttgagcaacatgcccaagggcacgtggccagtaaacagaacagctggaaattgaactcaggctctgctgcctcctcaagtgcacactttcaaccgctttgctgcactggcctgagggcctgagccctggaaaattcctgccgactagcagaaggaggtttgtaggtccagttccagatccagcttacagggtctctccaggaaacccagggccacgaagcctaagaataaggtatgctgcagaaaagctcaacaccaagagaaaataatagcaacaaagcaacaggaggcatttagcctggtggaaagtaattacctgagctataatgtacatatctactagcaaaaaatactagctatcatgtttcccctcctccagcaggctggtacagtcctctactttttttttttttttaactttctttttcccactgccaagcaactgattataaactgaaccaatctcatcatggcattttctaatagaaaacttttcaaaggcttcccattgcttataggataagcttggactccttaacctggctctaaaggtcccacacggtctggcccccacctgcctctctggcctcattctattggcttatccccttgccacactctgtccacataagcctcttttcatttaccacagaagccatgttttctcctgcctcagtgcctttgtgcatgcagcccctgctgcttgcaatgttcaccgccccctttttttcacccagttaattcctcctcttctttcaactctcaggaaaccactgggcagagggcactccagcctgctgcccatctccttcttagttttacataaaaggagggggaactgatggtaggattacttagtgccagtgagattgcttgagacgtggttatgggatgggtacttctccagggaagctttccctggtcctttagaagagaaggggtgatatgcatgtctgtttcctgcattatatgcatgcaaatttctttcctgacaatgtcatgaagatgtcattatttgatggcttaatctgtatattcctcaaaggcagcgatgttaatggttctattggtgtctgtaaccccaggtcctggcaaatgtctggcacacagtaggtttccaacaagcatctgttgactgactagaatgtatgaatgaatgaacaaattcacagtgacgccctacagctgatagttcattaaaatgtattttgcggacaccaccttggttaaaaatctctctcttcctgaattaacattgcaacctgagacagacttccaagataaattacaggaggggagcccagacacatccaggcagtgagtcagtagaaaaccagacacacaagatcaactggatttatagaaagtactagaggaacacatgtccagtcactctgggaaatctttgagaattagctggcattaaggcattagtcagcaacttgcctggtcaaccaaggaaagataaacgagctctgtgcttttagcgggggagcagaaacttggggtaagtgctgaaatcaacgagtctcaggattcaatgacattaacctttttgattcagattgaggaaggtggtgcagggtgaattacggtgctaatgaggaccaggtatttatcctgcgtttaggcagagaaggctgggtggtaagaaaaccggtatgctctggctggcaggaactctgcggggctggatagccatggaggactgtctgtgtgcaaactgcctgtctcctctcggccgcccctggtcaggcaacactgatgggtgagctgtgtttcatgtgctccttaccagctcaaggtcagaaatggcacacgaagtaggttaggggaacataaaataaagggagcctgctgtttaataaggggttcagctacccaggactgggtagaaatccaggtcaaggcctaggggaggtagagcagaaggccttggggatctccatcactcattctctatccagggtcctgaagtctgaagcacttgaggtgattcagattcaaccccacctgggttgacagaatcatctaagatagtgaagcaaaggccatgcctaggaagatgggtgagtgggttggcactaaatttgaaagggctgagatgtacgtgttctgggcaaggccacgatctgaaacatgggagatctggcagaatgatcaagtgcaaactattgcctgccacctgtttttagaaagaaaattttactggaacacagtcatacccattcatttacatactgtctatggccgccttagtattacaacagcagagtttcgtcatcctgagagacatatatgtaccacaaaacctaaaatatttactatctggccttttaataaaaacttttgaggctgggcgtggtggctcatgcctgtaatcccagaactttgtgagctcgaggcaggcagatggcttgagcccaggagtttgagactagcctgggcaacatggcaaaaccctgtctctacaaaaatacaaaaattatccaagtgtggtgacatgagcctgtaatcccagctactcaggaggctgagatgggaggaccacttgagcctgggaggtcagggcttcagtgagctgtgactgtgccactgcactccagccagggtgacagaatgagaccctgtctcaaaaaaaaaaaaaaagtttgttgaatgaacggagctggaggcttttatcctaagtgaactaacaaaggaagagaaaaccaaatacatattctcgcttgtaagggggagctaaacattgagtacacacggaaacaaagaagggaagggtagacaccagggtctccttgaggaggcagggagggtgaggatcgaaaaactatcaggtactccatttatcacctgaatgatgcagtaatttgtacaccaaacccccaggacacacaatttacctatgtaacacacctgcacatgtacccctgaacctcaaataaaagctagaaaagaagtttgttgatccctcgcctgataactctcttttttgggtcattcacaatcttcctcataactttctggcatatccgtctaatcgaagtgtcttcctgacccaccctatcctctttccatgcaatagttttcctggtactcatttctacctgatatatgacccgctcacttatctactgtctctttctctaatgagcatggaggatgcacaacagtgcttgctttctttactgccatattcccaacccccagcaaaatggctggagtataccaggcactcaataagtacttgccaaatgactgaagagccacttaccccttgtattgttgccttgttaatattttctcatttaaatcaactttcattttatttatttatttactttttatttttaaggaaacttcagcttccaaaatctgggctgaacatgttcctattcccttctatgtgttaatatagataaacatggacattttcaaagactcgcctgcatttctctttaaatcatcttacatactgcaagcggcccacaggccatacttgggaagtcctgactcattgttaaggacatgggtgggtttaagctccactgagctccacttctgggtagctgagcatctgctcaagtcccttctcttgcaaatggggacaatgaaggtcccatctcaccagatggctgagagattaaaggagaacatagaagaagcacttagcacctgcagaaactcagtggcagggaactctcaggggtggggccatctcccggtcgctcagttcatgacaaagcagtgcccccttggtactgcagccatcactgtcatgaagcctgtctgagacactgccccaattcctgaatggttgcaccacaacccagcaaagcaatttggattaatgggactatttagctgtaggtgtccagagaatgcattgtttaaagtaacttgttggaaacttccccagggtggcaaattttaaacaaagattgactctgtaatcaaaaattgcttctgcttggccttaaaccagattccggcatcctgaagagcatgattagactgagaaagggtggcaatgtttgtgcccctggctcggtttgccaagtaatgttgactgatgaatacaattaaattgcactgaggagaatccctccctggaggagaaaggacataggagacgggtgatggcttttaggggcacagtttttcattccttctccataagggaacaaccaccattgtgggattccccttcaccccctaccatgggaaaactggccagtactaccaaatggccttccccttcccattctccacttttggattaactggtcttataggcagtgggccaagactagattccaggttctagagacactccatctgaccttcatgggcctgcttcacctaagctgagtgggagtgggaggaggcagcaggggagtctcatgaaccatgaagactttgctctctgcgttggcttctgttccatgatgatttcctaggaagctgacctgcccagatgtccaaatcactttctgatattgcctggggccaccaggggagggtcagaggcaggccacttgagcatggggatggggtgagggttggtgaggctgggaattggaaggaagtttcccacttgaaatttcaggtagattgcagttgcattcaaaaagtaactggagaaatgcacttgatttttcaaagtaagtggagaaatggacttgagaaatggaatatgttgtttcacctcattggggtagagaaggccagtaaacactagggctgtcttcaaacagccttgcagcagggagggaatatgggggcccaactacaggcaaagaaggctcagctcaaggcaactaccttcctcactctcatcacgatcagacttcctcaaaggcaggtgccccctgcccaatctgcatttctgtattagtacaaggaatagagacataaaatataagaggaagaaagaaggagagaataaggaaagtgaccacacaaggccagaccatgtttttgtccagaattaataactatacaggattattaattatcattgtcatcactaccattatcatcaaaaaatttccttgttaaaaaatgcccaattccggattaggtcctgtgttccactatctttcatgtttctaacaatcctatgaggaaagtaccctggggagggcactctagcctgctgcccatagcaggttctcctctgcccatctctctcctacatttacccaaagggaggaactgagggtaggattacttagtgctggagagattgcttgagacatggttattagtgggctagatatctgttctgtgaacccttcctcctcccaaatgaattgcacttcttttttttttaatgtttcttgcctcaggcctgggtggtacttaagcctcttggggccacgatgagttaccccaaccgcttgatgcaacggggtgggtacagtaagctaaggtctccctggtggattcaaccatctctccttgctttgtatccatcagtatgaccaagcatcctggtcccaatgttttgatggtgagaaggtggagaggaggtcacatggagctgccagacctgagccaccatgctctgacctagctgtcatcaaacagcttgaaataaagcagtacctggagtcccacctggctattcttccttttaccgctccctgatgggtagcatggtcatgccctctcacaggtgagaaaaaggagactcacaaaggttggatttgttgcttgagagcatatagctctcatacaggggatgaggacaggtaccttggtctgtacaggctgctataacaagacaccataactgggtgggttaaacaatggagatttatttactcacagttctggagactggaaagtccaaagtgcctgtcaattagatgctggtgaggcctctcttcctggcttgcagaaggccaccttcttgctctgtccttacatggcagagaaagagagagcgagctctctggtgtctcttataaagaaggacactccttctataggatcagggctccatgcttatgatctcattttaccttaagtacctccttataggccctatctccaagtacaagggttagagcttcgacatataaattttagtggggcacggttcaatctatagcaacaggattcaaatccaggtcaggctgatattgcatggcctcttctacatcgtagtggaatgacttgatggtgtagaatatgccagcattgctttgagtttgctttgattttgctttgaaacaattaggcatatgtggggggtggggtggggggagggacagaagccattcctttctaattatgcttgcattaggctaatatttaaatgaatgagaattccactgggcaccaccagatagccagttagggtagagatatggagagtctgaggtccaatgggaacaggattacaaaggaatttgaaggttggggttgttcttgctaacgcaggacagatggttcctaggtctatgcttagagcacacagtcagtaaagcttggatattccattagagaaagaaagagaccatctggagatgggtctacactggcttttggctttggcagccacatcgtagtgttggcatccttgggtgatcggctttccctccctggggtcaaccacttacacaacacactgcataaagcatggtgaacttcagggtcagctaagcctgcattcaaatcccagcttggccacgatcaagtcatgtgacgttgggcaagtcacttgaacactctgagtcctggtgctgttctatatgtcatcttactgggatgccatggggactaaagcagaaagtgggggcaacttggcagttggctaaacattaggtcactctggatctcaggttctgatgtaccctgctcatctcttgatacgtggacaactctgcctcctggattctcatccagatacagaaaccaaggatttagatggggaagaaatgagtgagagagctttaccccagaactatccagcaggtgaaattatgacccgttggcaaaaaactcaggtcctttcctctctgcccctactccccgtgatgaaagaagcatgcatttaaatcctggctccaacccccaccagttgtgagacactgagaaaatccctttacttctcacagccttggtttcttcatactgcgatgcagtaacactatctaccttctgggattgttgtgagaattacatgagataatgcatggaaatcacttggcctagaatcctatgcacagtaagtagtcaagaaatgtcagcaaatatgattagctactggagtatggcaggtcttaaaaggctttcccaggcatctactttgagtggctactattgaccatgctggacaatgactcagggtgggagcaagggagagaaaatacttgaatgataataagaataatccacagagtccgtctgtgtgcctaatgatcagaccttaaccctgtcgcttggatcctatactcagtcaaatctttgccctcatcaatttttaaaagggtagaaacgctcctcccttatcccacttttaatacatgcggttcctccagattgcccttgaaaagaatcttcacctgcagttagatgtaaggaacaggcaagggaagaataatagactctacaataaagaccacccacattgtagaccaccccgggctcacatccaaattcccaggatgcacttggagcatcccagcatggataccgtccatactcttggccaccggagaaaaagtcacataaaagacggcttttttttttttttttttttgccaataagcaaaaatgctcaatgcactgggcaggaagatgccagggttggaaacgtcccatccacagacacatagagagccgctgccaagaggaaggagaattgtgagatctggagagggagggattcggaagaaaatacattgcaaaattcattgtgtggtcaagctgggatctggtgagaatatcaaattggcagaggacagagaccacatttatttctgtactatttagcctggactctcttttcttctggtaacagtagtataattctctctagtggaagtgtttgtaccccatggcatcgatgtaaggttcatgagcgcacagttttaatttaactttaaattaaaatcatatcaaattgaaaatttagttcctcagtcccacaaggcacgtttcaagctctcaatggccacctgtggctaacggctaccatacaggatggtgcttatagaacatttccatcacccccgaaagttccactggacagtgctggtctagagcattgcctaatatctagcagaatctcaatgagcatctatttaatgaatggatgaatggccaagtgctctattctctgctagccaaagaagggatacacaactcaagagagaactatcacatttttccccaggactctgaattttttttgttttccgttgtgaaagaaagagaaagcaaacaaaatagcaagcaaacaaacaatacaactaaaagttatttaagccagatgatggcatcccttgggtgaagcagtcacttcaattcttgtcttccaccacatccttcccagaaggtcctaagcccatagaccactcttggctttctgcagaaccttggttttcatgagatctccgagaactctaggctcactctgtttgtccagccgatggtctaggtcacttctggccttaagaaggcttaaagagctgaccagcctaaaatacagctcaggagacccaggacaactggcaagagggaagcaaactgcatttctgcaaaagcaggagtgtgtgctccatcagcctgaaaaataacagggctgaggatatgtttattttgtgactagaggcaaacaaaactgttaacggcataattactggcatgtttttccagtctccttgtgaacaacagtccgagcagatacaccctttcaaactcacacattatctgggtggaggttttattggatggtttcgaacccaggaactttggggtctcaggaagcagagtgtgtgtctctgaacgtcccaaagaacaaaagtggtttggatgctgagaaagcagaatgcaggggagatggtcacacccaaatatctgagtgttgggccaccaagtatgctttcccacgaagtactgaggctaacattttccaacacagcatgtagcttctatttatttttctaactatgtgaaagatgtctctctctctccctggaccagtggatttcaattctcactagtacaatcacctgcagggtgctggacactttaaaaatatatagattcttggctgggtgcagtggctcacacctgtaatcctagcactttgggaggctgaggtgcgcagatcacttgaggtcatgagtttgaggtcagcttagacaacaaggtgaaaccttgtctctactaaaaatacaaaaatcagccagatgtggtggagagtgcctgtaatcccaggtacttgggaggctgaagcaggagaatcacttgaactgggaggtggaagttgtaatgagctgagattgtaccacactccagcctgggtgacagagtgaagactctatctcaaatatctcaaatatatatatacacagagagagagagagaaattgattcttggcatccacaaggaatttacattcagttgatctggaacggaactctagatttcttttttatttttattttttaagacggaatttcactcttgctgcccaggctggagtgcagtggcgcgatctcggctcactgcaacctccacctcctgggttcaagcgattctcctgcctcagcctcccgagtatctgggattacaggcatgtgccaccatacccagctaattttgtatttttagtaaagacggggtttcaccatgttggtcaggctggtctcaaactcctcacctcaggtgatctgcctgccttggcctcccaaagggctgggattacagacgtgagccaccatgcccagccgatttctttattttgagcctcccaagtatctggcgttacaggggtgcaccaccacacctggttaatttttttttttttttttttagaaatgggggtcttgctttgttgcccaagctggtcttgaactcctgggatcaagtgatcctcccacctcggcctctcaaagtgctgggataggcatgagccactgcgcctgctgaactctgaatttctgagaatcacatagaaccttgatttgacccggctgagaagcacatagtgagatgtcaagctccttgtggcagggatggtgtctgtcctgctccctgcggaacacccatagcctgacgcatgacgggtgctcaggaaatggccttgagaagcagctctatcctgttttaagagtctggctcagcctgtcttctcctgggagaccttggagtccccgtcagagcacacctgtgctaatattgcaggtgtaaggtgaagagggtctgacctgggtggggatgaagggcatcacagatggggatgaacacggagagatgtcagggttagaacgagaatacgcaaggtgcagatggagcagcaaggaagggggcacacaggcttccagctgcaggtgctcaggaggagggtggtcctattcagagaaatgggggaaccagaagggtgactgatataggataggaagacattttggattcttctaaaatgtagaagaatcagtccaggtgtggtggctcatgcctgtaatcccaggactttgggaggccgaggtgggcagatcacttgaggccaggagttcgagaccagcctggccaacaaggcaaaaccctgtctctactaaaaagacaaaaaaattagccaggcatggtggcacgtgcctgtaatcccagctactcgggaggctgaagcaggagattcccttgaaccagggaggcggagcttgcaatgagccgagatcacgccattgcactccagcctgggtgacagagcaagactcagtttcaaaaaaaaaaaaaaaaaaaaaaaattagccagatgtggtggtgcataactgtaatcctagctacttgggaggctgagggatgagaatcacttgaacctgggaggcaaaggttagagtgagccaagatcgcaccactgtactctagcctgggtgacagagccaaacgctgtctcaaaaaaaaaaaaaaaaaaaaaagaaagattaaaaaggtcaattttattttaagtgtattttatcacttttcttttctttcttcttattttctttttgggatggagttttggtcttgttgcccaggctggagtacaatggcgtgatctcagtccactgcaacctccgcctcccaggttcaagcaattctcacttattttatcattctcaccatattttatcactttaaaaaaaaagaacaaaagacaaagaggggtctccaccatattctttctcacattcactcaacccacattcttcctctaatcctctggctgcgcccctgttggcttatgattggcttttttctgacccgctctcctaagatccttgcatctcacgcttgcttctctgttctctgctccagctcctgttgaaatcctctgagtctcctgaacgaggctgttttgcacaggtgtggggtcctggtccccaaacagaaggtggctgcctggctctgagtgactaaaagacttcatggctgcttgggttcaggaagctccttatggcttccttctaggacacctgcttctgcctggaggtttggagaatagggggctctgtggatgtggctctggggtcagtagaagcaactgcttgtgatctggcctccccactcccatttgggccccactcccaactattctcccacggcagccagtacgatctctcaatgtggcaaatattgtcactctcccctaaaacctcaccgctcacagactgaggctttagtgacccaacaggacatctcaagtgcccacatgggcttgcctcgacctacctcatttgtaagaaggcaaaccctcgcctcttatgtttcacccatagttgccttctttcagatcctcagatatgccagggtcccaagctaccccctcttcctgggatgcctgcttggaacctcctcacacttctcctaaactcctacccagcatctacatctcagttcacaggctgcctcctcagggaagccatccgggccctcagtccatgtgagattcctttgcaaagtgctcatagatccttcattcctttttttcacaatgcttgcctgactttgtcatatgtgcactcctgtgatctctgtgattaatgtctgtctccttcctctattaataaccatggctatcacatggataaccctcactgtgtgctaagcacttcacatatatggactcacttagccctcaaagcaaccctatggggtggtgccattattatgcccattttacagatgaagtaactgaagcacagggactgctgtgtgcaacttcacacagctagtaaataaagaagctgcgatttggacccaggtggactggctccagcctgtacccttgaccactacgatgagggcagggctggatatgtttttcctcacctttgagttgctgcttagcacagtgtccaacacatagtaggtgctcaataaatatttttttgggtgaatgggtaaagtcagaaggagccctgtctcctgaactcatctgtgggagtagagaagtatcttcactgggctgacctaagcactttcctcctcaaagcaccccaagattgtcatcagaaggggcttggtgttgagagaaggaagaagggaaaaagggaagcttggacctcacactctactcctccacatttccatcttcaacctgaatcttccccggacaatgagaatcactgaagtttctttcccgttcagctgaggtccaggggctagcatgggtagagaagatccggtgtgaatgggaaaggccatcaggccaatatgctcagatctacaaccccccatggccaaacagtcaccagggcttgcttaacaagagtcctccagcaccactgctgggcagagtcccatatgatggagctgcatcttcttaaaccagatgaggtcctcaattcagggcatacagtgcagatacaacatggccaggagacaggggctttgggaagcttcagaatgctgagtatattgactgataattggataaacagattgtggtacaagtatatcaacatgatagaatatcagccataaaaaggaatgaagtgctgccacatgctacgatgcagatgaacctcaacgatattaagctaagtgaaataagcaggtcaccaaatgtcatatactatgtaactgcattcatataaaatgtccagaataggctgggcatagtggcttacacctgtaatctcagcactttgggaggctgaggtgggtagatcacatgaggtcaggagttcgagaccagactgaccaacatggtgaaaccccatctctactaaaaatacaaaattagccaggtgtggtggtgcatgcctgtaattacagctacctgggaggcagagccaggagaatctcttgaacttgggaggcagaggttgcagtgagccaagatcgtgccattgcactccagcctgggcaacaagaggggaggctccatctcaaaataaataaataaaaatgtcaagaataggcaaatcaagtccatagatacagaaaggagattagtggttgccagagactgaggagaggtttctgggaagtgactgcttaatgggtacagggttttcttttgggatgatgaaaatgtttaggattagagagcgtacggttgcctgacactgtgaatgtactgaatgccattcaacaattcaaagtggttaattttatgttatataaatttcacctcagtttctttttattattatactttaagttttcaggtacatgtgcacaacatgcaggtttgttacatatgtatacatgtgccatgttggtgtgctgcatccattaacttgtcaattacattaggtatatctcctaatgctatccctcccccctccccccaccccacaacagtccccggtgtgtgatgttccccaccctgtgtccaagtgttctcattgttcagttcccacctatgagtgagaacatgtggtgttcggttttttgtccttgcgatagtttgccaaggatgatggtttccaccttcatccatgtccctacaaaggacatgaactcatccttttttatggctgcatagtattccatggtgtatatgtgccacattttcttaatccagtctatcattgatggacatttggattggttccaagtctttgctcttgtgaacagtgccacaataaatatacatgtgcatgtgtctttaaagcagcatgatttataatcctttaggtatacacccagtaatgggatggttaattttatgttatataaatttcacctcagtttcaaaaaaaaaggatcatgattctacagtttactggctgtagccttggggtcaagtttcttaacatctctgtgcctcagtttattcatctgaaaaatggggatatcaagagtgcatacttcagagttgttgtcaaaacgatgtaaacaagcttgtccaaccctgccttatttggttgttctgttttgtttttttgttttaggcttttagcagcctgaagccatggtttttagtttctgtctctagtgataagcagaaaagagggatgaggaaggggctttactggcccaaccaagaaaagaaactgaggagccataactgtattctctccctcagacatccctgaattgtaaagcacttagaataatgctaggaatgtacgaagtgctacatatacatttgctgtggttgctgtgcggtcttaactacaggaattctttgacctattcgggttccactttagcagactaaagggatgtgatctgtacgcagatgcagtgactgtacatggatgcttggacttccatactgctcatcttcatttcaaatcccagagtgactgggatctgtgctgaacattatcaagggcttgacttccctgcaaagcttcctctgctctgtgttaatactaatttctctaaacttacttaccaagtagcagttgtgttttgggggatgggattaagaagaaatatgtggtaaagggccctgaagagggcccagcacacagtaggtgtgcagtaagtgtctgctctgttagtctgggggttagtcttgctcaattggtcccatataaactctggtcttcgggagactgtagagaagccctggccacctgttcctgtctttaccagctggtgtttcctactgaggcgccatggagcagctctctcatgttctcagcctgcggctctggtagtatctcaagacagacatttggatctgcagttaatgtaacttacatgtccatgtggtgggccctgatagtttggactttgttgatgtggatacccaagaggcagaagtagcaggaaaatgtcaacatggtttcccctgcctggtttctgtatacatacactgccccacatgtgcaaacgtgtgtacacaccacagactgaatgtgaaccccgggaggggccaaggacacactcaaccctcctctctttacatctgatttgccccaagacaccggacttaggaaaagacacagtgtgaggcgtgaggtctctctctctctcttttttttttttttttttttttttagatggagtttcactcctgctgcccgggctggagtgcaatgtcatgatctcagctctctaccacctctgcctcctgggttcaagtgattctcctgtctcagcctcccaagtagctgggattacaggcgcccgccaccacacccagctactttttgtatttttagtagagatggggttttaccatatcggccaggctggtctcagactcctgacctcaggtgatccacccatcttggcctcccaaagtgctggtggcattacaggcatgagccaccacacccagccgaggtctcttactacaagtccaagccaagaaacagggcaaagtgctattggcttcatctcttcctgcagccaatctaaagtaggccaggtataattccttgcctcggtaaatagaacatacgaataaaaccatcatacctttcgaggattcaagatctagcagggcctcagagtttgaaagtatccattttccactttcatccacgtgctgggtacacaaccagctccagctggagcctacgtggaccaggatgtcatgtcaacagcagagcaggagcacctagagtctctaaacactctcagcttgcgtatgccaagttcaggaatattcttcatgtccacaagtgaattggatctattctgtttttcttgaaacagtctcacgtctatctttgcttttcccaccctttttttttttttttttttttttagacagcgtctcagtctgtcacccaggctggagcgcggtggtacgatctcggctcattgcagcctctgcctcccgagttcaagtgagtctcatgcctcagcctcatgagtagctggggttacaggtatgcacaaccatgcctggctaatttttgtatttttagttgagtcggggtttcatcatgttggccaggctggtctcgaacccctaacctcaagtgatccacctgccttggcctcccaaagtcctgggattacagttgtgtgccaccgtgcttggcccacttttccctcttttgacagagatgtgagttcaagaaatactttgctactcttttaactctatcaaagagaaaagggaaagtaactcaagtcccacagttacttatagccatggagtaatttgggcatttatcaaccactttctgtcattagacgctgtggtaggtccttatcatgcaagatttcattgaaacttcctaagaaccctccgaaataggcactaatattgtgtttattttaaggtagagaatttgagatgcagaaagttgaagcaacttgcccagttggtggtggggcagaatctgaaaccaggatgtctgcgtccagggcctaaacaaggctagtgaccagtaaacaccagtgcatctttaatatctaagagaggaagaatctgcccacacccccccaccccccacagtgagggttgtgcaggggacacagggaggtgacgtcaaatcacagagcagctcacagtggctacgtcgggctggctggacccttaagtatcccccaagttttcagtgcctcttagaagtgcctgacttgggcactaccgcccctttgagaagactcctaagtttgctcattctttctgggatgggagaagtagtggttttggaagctacagatggggcggcagatggaaactgaaaacctatcagcattgcccaggatgaaaccattcatctgcaaaattcatatgtttttgtgtagggcaacttcatgaaaacaacagcaagaggaaccagcagtgcttgatgcataaagtgcctctggctatgaggctggcaaagaagagtgggcaaaggaattcgtgggaggcaccatggaaatgagatcagtgaagtagaggaagatgatgagaaaggccaagagacacagagtgacctggggcactaaagcaaaaaagccacaaataagacaactctcttttctgaaccccaaaataggttgcacgcatggcctgagaaaggatttctgggcctctcagagatacaagatgagaccttggatgtaccttacgtataaatggctgacattcatggagcaccttccaagtgtccggcaggctgctaggttctattattgtatcctgatttcacagaaattggatttacttgcccgcggtcacgctgctagctaagtggcagaactcagattcgagccgtaagcagtttgacgagagtgcaggcactcaccctcccgggtgctgagccgagctggactctttaggggaggtggccacgcaaagcaagccaacaatggcctctagggggcagcaatgcgcatgcctacctggcctcaagtggtcttgggcttaatgcgggcccccaacctaggctggcatgacctctgaggcctccactgggaatccagagaaggaagaatgtgggaactttgagcacagcccctaagactgaggaacagacaatgggggtcctcccaggaccatcctggacatccctgctgcaggcagtccagccactactccaccccgccacaagctcatggggtgggactgtttccttctgtgctttcaaggtggcctggggccatcctgccagtccagttctgctgatttccctaagaggccgactaaaagccagaaggaataccaactttgcaaccagacgaaactggttctaatccccactctgccatgcattcatcacatgacattgggcctcagtttgcccctctgtaaaacaggtttgttgtaagggttgaaacaagtgtctgccacactagctgctatgctcagcattttgggacatttccaaactcggtcccttcatggaagatggagagggaatgttctaacccctccttgccatgtacttgtctaaactcacttctcctcattcttttattatactctatccattgtttaaatttctcaaacgcaacaagtttgtttctgtgctacattgtgcccaggctgttccctctataagaaacggtgattctcaagtggagacaattttagctcccagaggtcacgagtcaatgtctggagacatctgtggttggcaaaagtgggcagggtgtgttcctggcatctagtgggtagaggccagagatgatgctacgcatcctgcaatgcacaggatggcacccacagtaaagaattatccatccccaaacatcagcagtgccactgctaggaatcccagtatagaaggatctctttcttatttccctcccaatggatcccttcttgtcttctaggtctcggttcaaagctgaatattcagaggcctttctgacctcctgcttatggccctcgagtttttctccacacccacatcttcctttttttttgttgttttttgtttgtttgtttgtttttttgagatagagtcttgctgtgtcgccaggctggagtacagtggcgcgatatcggctcactacaacctccacctcctgggttcaagcgattctcctgcctcagcctcccaagtaggggggattacaggcacgcaccaccatgcccggctcatttttgtatttttagtagagatggggtttcaccatcttggccaggctggtcttgaactcctgaccttgtgatccacctgccttggcctctcaaagtgctgggattacaggtgtgagccactgcacccggcccacatcttccttgctttatggcttgttcacaccttgcatgatgtatctttggcatgatcatctaactccatcttctcagctaggatacacattccatgagcagaggagaagtacaggaagctgcatcacttttgttcacaaaatgcactacttcgaatgtagcacggtagttgctcagtaaatgtttgttgaacaaatgaacaaaattgtggtaagtaaaattctaccagcaatgttctataaccattcccgtttatccctctgtcttatggacaaaagaaaacagttgtctttctagtgcctgtcatttttctcaggttcaaggatgtcaggtgtaccccattcaaactgaccagagattgtgcctccccagtaccttctgcagtctagggtctcccagcagatggtgggatgcccccaagcctaggaatgaagaagacccccagtgaccaagctgtgaagaagaaagcagccacttctagctttaaagagaggtaggtcttccttccatgcttgtaccttgtttgggttctgattcaaaactcaaactcttgggaatatgtgacctagatatttgatgccattaaaacatgcctgctaatattttaggtataagcatcattgtgatgctgtcttaaaaaagagatcttatcttttctagatatatactgaaatatttatagatacaattctgtgatatcttatatttctttcaaaataacccactgttgggggaagaggatgaaagtccagatacaagaacaatggccatgaattaacctgggtgacatccacgtgggagttcattacactattctcttggtactcttgtgcatgtttgaaagttgccttaataaaagttttatttttttaggaccccttcatctaggtctcctgggaatgctgaaccctatggcctcatgccatcagagggaggaagatccccctcttcacccccatccactttccttttcacccttgtcagcaaatccagatggaaaacacagtcaaaggaaaaagctgccctctcaagagaaaataacagcctggcacgatggctcacacctataatcccagcactttgggaggccaaggcaggcggatcacctggggccaggagtttgagaccaacatggtgaaacaccatctctatgctacttcagaggttgaggtaggagaatcacttgaacctggtgggtggaggctgcagcgagctaagatcacaccactgcactccagcctgggtgacagagcgagactctgtctccaaaatatatatatatatatagatatatataccgttcagaatatcattcaaagtatcatgccagtggcttccctcttgcttggactaacagccaaattctaggatcaccacgatctggcctcaaattactctctgactttatctctcttgttatgctacccctcacttactctgttacagctccactgaaccctgctgttcctcgcacaggccaggcatggacccacctctgggctcagcccctgcctttgcccctgcctggaccactttctctgtaggcgtgactctctttttcatcttcttctgttcttatccgtgaaaaccttccaggccaccgttggtaaaattacaactgtcccctacttttgccccttactttatttttctaagatatcatttaacttattttgttgtttgtctccctacttgaatggaagcttgtgatggttactattgagtgtcaacttgattggactgaaggatgcaaagtactgtttctggccatgtctgtgagggtgttgccaaaggagattaacatttgagtcagtggactgggaaaggcagacccactctcagtctgggtgggcataatctaatcagctgccagcgtggccagaataaaagcaggcagaacgtggaaggaataagctggctgagtctcccatgctggatgcttcctgcctttgaacatcagactccaagttcttcagctttgggatctttgggccttcgaccacagactgaagactgcactgtgggcttccctacttttgaggttttgagaatcagactggcttccttgctcctcagcttgcagacggcctatcgtgagacctcgccttgtgattgtgtgagtcaatactccttaataaactcctctttatatatacacctatcctgttagttctgtccctctagagaaccctaatataaagctccacgcgggttggagtttccgtctgtttagtgcactggcatatcagctaatagagctgggaaaaccacgtgctcagtctctatctgttgaatgcatgaatgaatgagtgaatgaatcaatgattctcaggtccaatcagaatcctatcctgagcgatcctgtggagactatgcatcagtctccttctgcctcgtgagttcccagccatgaccagccagagcaggacgtcagacaagactggcttggggcccttggctgccttacctgatggggtagtcggccgcactcaggttgatgaagaagtcccagggccagtcggtcatctccaggaggtcccgcatgctctgcaggtaggtggacaggaggctggctcctccccagatggtggccattctccagggggtgacgcggacattgctgtactgcctggagacctggagcacttgccgatgcaggtaattagagcgcttttcccaggagagaaagggtgatgacagtcagtggcctagaaaatacccaggcatgcccctcacccctgtcccctctctgtgtcttccctcctggttgggcacttctgagcacagtggcctttgccaagtaaatgatcctggactggagtgtctttctgtactgcaattcaaacttggattattttttacatttcaaattagctatttgaaatgcagattcactggccgcacttctgagctaatggttcactaggcttgggctggtggtgcctgggacttcacatttttaaaattttatcttattttattttattttgagatggagtcttgctttatttatttacttagacagagtctcgctccgtcacccgggctggaacaaagtggtgccatctcagctcactgcaacctccaccacccaagttcaagcaattctcctgcctcagcttcccaagtagctgggattacaagtatgcgccaccacgcccagctaagtcttgtattttagtagagatggggcttcaccatgttggacaggctggtctggaactcctgacctcaggtgatccgcccaccttggtctcccaaagtgctgggattacaggcatgagccactgcacctggccaactttgcattcatatacatgacagctgcatggggtctgaggaagacaagctgggaaatatggctccatctaaacccatgtatatttcggaggcagaatttttgttttctgtccccactcctactgattgctcctccattatcctctcacaggtctgctagaagccgaccttttggacaagacttccccctttgccttcttgactaaaggcataattgtttcaccaatagaaacctcagggacaaggtagctcgggagtcagcagggctgatgcaggtttttgttaataaagttttattggtacacagccatgctcatttgttgacatgttctccttggctgctttagcacaagggcagtgctgagtagctgtgacagagactatgtgccctgcaacacctaaaatatgtactatcttgccttccatagaaaaagtgtacgcactcctgggatagtgatatggtttggttgtgtccccacccaaatctaatcttgaattgtagctcccataattcccacgtgttatgggagggatccagtgggagataactgaatcacaggggtggtttctcccatactgttctcgtggtagtgaataagtctcatgagatctgatggttttacaccgggaaacttcttttgcttggctctcatttttctctcttgctgccgccatgtaagacttgctttttgccttccaccaggattgtgaggcttccccagctgcttagaactgtgagtccattaaacatctttctttataaattactcagtctcaggtatgtctttattagcagcatgaaaatggactaataaaggtaagctattcccacaaagtatgtgagaggcaggcagagggcattgggtagaggggagaggtaagaaacagcatttaggggccgggcacggtggctcacacctgtaatcccagcactttgggaggctgaggcgggcagatcacgaggtcaagagatcgagaccatcctggccaacatggtgaaaccttgtctctactaaaaatacaaaaattagccgggtgtggtggcatgcacctgtagtcccagctacttgggaggctgaggcaggaaaattgcttgaacccaggaggcagaggttgcagtgagcggagatcatgccacggcactccagcctggtgactgagcgacattccatcaaaaaaaaaagaaaaaaaaccccccaaaaacagcatttatcatttatggacaaaattgtaagtcgcagctggaaactttgaaaccaacacacacatagagacagcactctagggccacacgctctgtggagaggcagctggtcagcttccaagccttttctgaaagcaggcagtctggactagcaatgcagaaggagggtatcagggagggacggacagaccccgaagaaagcccagcaaggggtgatcacagaggcctctcaccttgtccacgtggatgtagtagaagtggtctttgtggtagatggccttgaacatgcgctgcaactgccgagaggcacggccgtggaccaccaggacaaaggcgattctgaccgggttggctggcatgtactccacggagtcctcgtcccactgcacgttcttgttggctttacctggggaaaatccaagagaacagagaggagaaagtgaggctctgccatcctttgcaggggtgggaagtttctctggtgcttcttttggggactattttaggggcacagtcatcaaattgggccttaaaacataattcaatgccacaaagcacatcttagattctcacactgtcaggcacaaaaggggttaggggaccctggggttgttacgacatagtttccattctgaggagcttaaaaatgctggaagagacacatggacacatattaagctactgaacaaggcaggaggaggtgagagctataagagatgtatctctgaatgacagaggaagaagcagttaatttcgagttagtgaacgtaagatacatgtgttgtttttgcctgtccagaattcattctcccttcttctaatagcatccaatatattgtttgttttaacggtggtaagaacagatagcatgaaatctcccctcttaataaatgtttaagtgtacactacagtactgctgcctattaatacaatgttgtacagcaggatctttaaatttacttgtcctgcatgactgaaacttcatcatccaataccttttgtggcatcatcctcctctcctctattcttagtccatatgggtggggaagacctaacttcatcatcaatttcaggggtggacctacagcttaggcctggccaatgggaatgctgattctccatagccacagtattgtttagagatgaacatatgactcaaccaagttaattaaccaataagacagaatgctagacttttgttagaactactacataagagaggttatctttttttttttttttttgagacggagtcttactctgttgcccaggctgcagtgcagtggtgcgatcttggctcattgcaacctccacctctcaggttcaagtgattttcctgcctgagcctcctgagtagctgagattacaggcacgcaacaccatgcctagctaatttttgtgtttttagtagagatggggtttcatcatgttggccaggctggtctcggaactcctgacctcaggtgatctgcctaccttggcctcccaaagtgctgggattacagacgtgagccactgtgcccggtgagaggttctttttctgttacacaggagactagaagattctatgagcctttctgttcccacacggagagaggttgcctgagaagaaaactaatgtggagtacattgccaaggggggatgagggtccaggtgcttgtggcctgccttgagctcctgcatcagtaaggctacagatcacccactgtcatctatcatgttcttttaaatccaaatcctataccacatccacttggataaatagtcccagacatattttattccgaaaatcagcctcaaagactcctctctttctttctcttgcttcagataaaaacacagcttcctagtttagtttattacaatcccaactagaaatctcctagctttcctcagcctgatttcacttgggtccaacccaatttcttaagagttctgggtttatgggacccaggacattgtcagggtagtagctgcaagtgtcccagcatctaaaccgggagaactgagatggagactgtggggctgggggattaggacatcgggagtctaagctgtcatcagaaggctgaatggttgctgaatgaacgaggctctttctacgtagttccaggagacaagacaagattgacgtagataatatccaaatcacactacacagcctctatggctggtgtgatctaactactcagatctctctgccctcgattggtgggtctcacattccatcttgtcctctggccttctttctcttcctcaaacaagctcatttctgccttaggaccttctccctggcttcttgtgatctggaacgccctctccccagatctctgcgtggctgcatcttcttgtcattagttcacagtccaaaaaggggactcaccaccacctcttttactctctttcacctcacccgcacctcttttactctctttcacctcaccggatttcaactttcttcatagcatgtaacactgtctgcaattgtttatctgtttacttgcttattatctgaacacaccactagaacattagctccaagagatgaggggctattttggccttgtttaccacagaatctgcaacacttgaacagtatctgacacacatctggttctcggtgaaacaaaagttacaggaaggcacatttgggatcagtaaaataacaataccttttattgagcattgaccagcccttgacgttcattagataatttaatcctcgtaatgatcctacaaagtaatgctattatccccgctttccaaatgaggaaaccacagcttagaagaggccaagggattggctcaaggtcacactgctttaattagttaagctgagattcaaacacaggtctgattccaaagatcatgccctgaaccactaatacacaccatatgatcatacctagagtttggaaggaaaagtttataacaattgcttttagttgcttgttgctaaccaaatactttgtaagttagttattgcaggcaggtaggcatgcatttaaggactaacataggtattccagtatttctgtattagatgagatgctgattctaggtgattaataaggctgtatcttttcatccatccatctattcctccacccatccacccattaatttattcatcgatcgaaatccaaccactcatccattcatccatccaccattccacccatttatccatttatttgtccatccaaatccaaccactaatctgtccatccatctacccacccattcatccatccctccacccatccacccattcatccatttattcatccatctaaatccaaccacttatctgtccatccatccacccactcatccatccctccacccatccacccattcgttcatgcatttattcatccatccaagtccaaccattcatccattgctccacccattcatccatacatccatttattcatccatccaaatctaactactcatctgtccactcatccatatctaaccattcatccatccaagcatacagcaaaccctccaactatgcatccagcaaagcctccaagagcttatcatcccaaacaccatccatccacttaaggtgtatggggcctttgagattaacccttgcttttccctgtagccatgaacatcttttgccatagtttttgaatgagcaaattaatgaatgtgttctgaagaagagtggctgctctgatccagaggagctggtgtttcttaagtgcctcctatgcatccattgttatttgaccctgggaagaatgcgttatcatcctctgaggctcagagaggtcagcacatttcccaggtcacacagtgagtgaggacagaggtgggaggggaagctgagtgttgccgagtccaaagccagccctgatatttccacttgctctctgcagaagtggagatttgcgatatagaggataggtgtaaggactctatgctggtctttaaaaagggcttggatgttgatgctgaggtcttttacaacttctctttagagttttaaaaggcagaacagatttacagacagacacagacatggatgcttttcttttggagaaagggcagagtcctgtgaaatcaaagacaaatcactccagcaagagagctcccttggcttaaatataaagtcatctttgggtcagacagttagtctggggagctgcaaagagaatggggaacaaaaaacccagagctcttctgagtacagctattctggggaaggggtgggtgggaaggaacaaaaatatctaaagaaaggagacatgcagagaaggagaaatagagatgcggatggggatggggggcagagggggaagacagcgagtcaggagaaagatcaaccatttactgagtgcctactatgtgttaagcaatttctgtgcatgattttattcatttctatcaaaactgctatgaaaacagagctattatctttctattgtaggcacaaggaagctgaggcttggagaggtcccagttataaagtagctgagctgagaatggagtgagtctgtgatcccagagccctgtcatggtcaccatgctcaatcaaactgtcctcatttcaaaaagaggaaaatccgtccctagaggaaatgtgtcagctttcagctgcaggacagatataacaatgacatgtggtcagagctatgtgggtctttatgaacacggaactctttgaaagaccaaaacccaaacagtgcccagctccaaaaaaaaaaaaaaaaaaaaaaaagaatttaacaatgtaatcagattcccatggcacaaaacagaaaataagtggaaaaatcagagtgattagaggcagcaggagaagctgacttcagatgaatgttaacaagccaggtttatcgagagagaatatcaagtatatttttgcagtgcaggtgtgaaggctgaggatgatggggggtcccggagagctcccccagtagatagctgtgctgtgttagttctgttactcaaattccctatttcttagcagcattgtgggtcaaacgaggactatgtaatccttgggctccaaagacatagcagagatgaaggtgctttgcaagggtcaacatgctgttccactgttgtggtgctggcaaagatcatgttagcagtgtcctgcaataatgatttgggaggagaaagcaaggtgcaggggtttagaacatgacctgtggtcaggcagatgtgaatgaccttggaccttttatgcaatctctccaagccttagtattctgatctgtaaaatgggtatgtataatcacagaatccaccccacatggacattcacatccagaagagagagcacagtgcctggcatctagcaaatcctcaataaattatactgtcatagccatcatttctatgtggctgctcatccacgatgatcaggatttaaccaacaggcccagctccagagttctacctcaaagctgcactgactcccagggctgtgtgtactctagagcctgctgcttgtaaataaacatctacaaccggaatttccctctgcagcgtatgcccagaccacaattaataacaaatgtgaaggagctgcttgactggaatagttactctaccaacaaagccctcgattctatttatactctgaaagggctgcttccggctgctgcaaggggcactttctgacttacttccaactaagagggttagttgggtcttgggaacacagagacatggaaacaaggttgtatgcaaatgaggcttgggttaggaagctcccagctggagcccagcttctatgctgcctgggaaggtgtgactgggattcagagctggggtgtagaatgcaaccttgcactgtgtggatttaggaaagacaccgcccctctctgattgtcagttcttcatttacaaagtgggaagagaggtccatctctgaccccgctgggttccagggtgattcatgatcacagatgaggaaaagtttcacagcggcagcaggcgcgttgcagaggagcgggattcgtcttactgggggagaaaacctgcacgctcaaggttctttgttagatctgggtgggagatgcctttatcctagtgggaaattttaaaagaggttttctggtgattaaacttgggagctgtctggtgcccagaaagaatcccctgctctcgatgggtttagaaaaggcggtgctgtgtggcgacaagcatactggataaagagcaacgaggtggattcaaattcctgcttctgctgtgaaccagccacgggggcctgggcaagtcaatttctttccttggtcctgtagaatctcaaagactagtaacgctatcagatgcatgtcaaatacttatcatgcttgcgtcaaatacttctcatggtggcttgcgtctgtaattccagctaccctggaggctgaggcagaaggactgcttgagtccaggagttcgaggctgcagtgagctacgatggtgtcactgcactctggcctgggtgacagagtgagaccctgtctctaaaaataaataaatcagaaataaacaaacactcattatggcctaagcaccagtcaaatgtgatctcattatttaattgtcccaaggtctcaggaggcaggtgccatgttagcagttggtgcgagaatggaaaccaccacttgggtgtgccagactccaaaacccctattttggaaaaacccaaatgagggagatgaaatttctggatatttctggaaatttctgaatcatctggaattctaacccgatccaggagttagcattgccacatagagaactgtactcccttgagagtcaggttggttttcttttctttcttttttttttttttttttttttgagacagagtttcactcttgtcacctaggctggagtgcaatggtgcaatcttggctcactgcaacatctgcctcccaggttcaagcaattcttctgcctcagcctcctgagtagctgggattataggcacctgccaccacgcctggctaaattttttgtatttttgatagagacagggtttcaccgtgttggctgggttggtctcgaactcctgaccttaggtgatctaactgtctcagcctcccatagtgctgggattacaggcgtgagccacagcgcctagcccaggttggttctcttgatacctgtcagttcgttccctatgagccaaggtcatgctcttatctcttgtaggatgccagccttgcccctggacctggtacagagctaagtttgggggagaggcctcaatgaatgatttctgactgacagatttagccagacagcttcatccacatacagggtcccggtggtggggatgagggggcaaagttgaagactcaggcctgagaggttgcccatggctgtctcctctcatccagcaaactggatggaggctaggcacccccacttttccttgaggcttttgggtggtctgtggacccttgctcagcagcaccaagccctgctgggaggaatcagtcaacggcccagactgctctgcaccgcagctgctgctcatgcggggccaccaggtcccctcccacccagcttaatgagaagagaggggtggaggggatgtgaactgggggtcatggggtccacagaggggagctgaaagaacataggtccaaggatgaaggtggccaagccagcacctgtcaggtctcaggagaaatgacccttccttgggaagccctccctgactctcttccccatcccttcatttaaaaaatatttttaatgacttttttttctttttctttttcagagattgagtcttgctttgtaacccaggctggagtgcagtggcatgatcataggtcactgccacctcaaatttctgggctcaagggatcctcacacctcagcctcccaagtagctgggactataggtgaccaccaccatgtgggctaattttgaaatgtttggtagagacagtgccttgctatgctgtccaggctggtctcaaactcctgggctcaagcaatcctcccttagcctcccaaagtgctggtgttataggtgtgagctactgtgcctggcccccatcccttctttgagttccctgtcacagcccctctgaacatcctgcacttctctttaaaaaaaaaaaaaagttgtagtccaagataatacatgctgagtatcccttatgtgaaatgcctggaaccagaagtgtttccaattttgaattttttcagattttgaagtatctgtgtatatgtaatgagatattttggggaagggacccaagcctaaacacaaaatccatttctgtttcatatacactttatacacatagcctgaaagtaattttatacaatattttaaataattgtgtgcattaatcaaagttgcattaagcatttatgtatagaattttccgcttgtagcattatgtgcccaaaatgttctggatttcggagtacttcagattttggatttttgaattaaggatgctctacatggataacatataatttactattttagccttttttggttcgagatggaatctcactgtcacccaggctggagtgctgtggcacaatctcggctcactgcaacctccacctcccgggttcaagcgattctcctgcctcagcctcctgaggagctgagactacaggtgcccaccaccacgcccggctaatttttttgtatttttagtagagatggggttttgccatgtcggccaggctggtctcaaactcttgactgcaggtgatcagcccaccttggcctcccaaagtgctgggattacaggcatgagacacatctggcctattttaagcatttttaagtttacagtttagtataataaatatacttacactgttgtgcaactattatcaccatccatctccagaactcttttcatcttgcaaaactgaaactttctatccattgaacaataacttcccactctcccctccttcagctcctggaaagcttcattctactttctgcctctatgaatttgataaggaacctcatgtaagtgacatcagacattattcttccttttgtgtctggatcctttcacttggcgcagtgccctcctggtttgtccacgtcgtagcctatgtcagaatttcattcctttttcagggcaagtaatactccactgtatgcatatagcacaattgatccactcatctgtcaatggacccttgaatggctttcaccttttggctgttatgaataatgttgctctgaacatgggtgtacaagtacctgtttgagtcactgtttcaattctttggagtatattcccagaaatggaattggtggatcataaagtcactatttgtaatgttttatttttaggagcccatcctgcacttcctaactcagctattccacagaaggggttagcctgggtctgcatcccagccctaccatttattaggaggtcactttgcctctcatgcctcagtttcctcatctgtcaaagagaactcacctctaagtgatgctgtaagcacagctataaatgaggcaaaataaagccatacagcctgattgtggaggagttcatgtggtgtgactccgcggacctcgcccatcacacttgaacttgtaactaatcacatggctggagagtgtttaacagggacctgatcctgaggactatagcgattgtggttttgtttttgtcttttttaaattcgtaagacgggatctcgctctgttgcccaggctggagtgcagtggtgtgatcatggctcactgcagtctcaaactccaggctcaagagatcctcctaccttagcctgctgagtagctgggactagaggcatgaacaccacacctggctaattaaatatatatttgtagagaccaggtctccctatgctgctcaggctggtctcaaactcatgagctcaaatgatcctccctcttcagcctccagagtagctgggaccagaggcatgcatcccatgtccatctaatttttttagaaaaattatctgtaggctggctgtggtggctcacgcctgtaatcccagcactttgggaggctgaggtgggtggatcacaaggtcaagagtttgagaccagcctgaccaacatggtgaaaccccgtttctactaaaaatgcaaaagcaggtggataacaaggtcaagagtttgagaccagcctgaccaatatggtgaaaccctgtctctactaaaaatgcaaaaatgagctgggcatggtggtgcacgcctataatcccagctactcaggaggctgaggcaggagaattgcttgaacccaggaggcggaggttgcagtgagccaagatcacaccattgcactccagcctgggtgacaaaatgagactccatcttaaaaaaaaaattatttgtagagataaggtctccctatgttgcccaggttggtcttgaactcctgggctcaagtgatcttcccccttcagcctcccagtgctgggattacaggtgtgagccaccttgcccagtgtgttcttaaatgcgatgtcagagttacccaagagaggattcacatgctgctcacatcgaatggcattgagtcaggggggactgtgaatcttttttcaattcttacccacctctcctgaataccctaccagcaaactctcaggtcaatgcaaacaaatcttcagcagcactcccctactgaacttccttttccaaaaagcagaatcctgcccccagaactggcatctccagcaggtaacaggagtgcccggctagcactgaatgccattgtttttgtttcactgatttcttcgcattgttgctgtctcctcatggcaagtgacagcaagatttccacttatggccatgatgcaaaattacttttaaaataaaatgtgcttacataaaaataaaggcgagtctattgcagtaaaaatactacaagaataatatggcaggtggaatgtggatatggcagaattgtgaaggctggagggatgcgaaggaagcttggggaatgttaattaggctccatgagctttgcttccaaactaggatgtgctgagtttgttaaacaaatgagaggaggtaaaggcaaagggcagggggatactcaagcagccccatccatcctgcaaggacccaaaggtccagacaatgttttgatctttctggatgagggctcccacttgctttaggggcccaggagggtttgtcaggagtctcctggggtgggcttttgggacagcacctccctgctagagagacagaagtctgtggagaaacactgtccttttgattcttactctaatttgttgagtacttaacattcatgtggttctttcactcatgaggcttttacctcttgtaacaatgctgcaaatgaaaattatccccatttatagataatcatcccaggctcagagagggtgaggaacttgcccaaggtcacagagccaagaggtggagaagaaattaggatacgcactgttctgacgtcaaataccatgctctatgaccaggctttggctagcaagaatctggcatcctcatcttcactcaggctcccatgctaagcttgatgggaaccaaagcctcatgttctcagaatggcttcaaaactatcgtctcccctagagcaagatttctcaaccttggcactattgatatttgaggccagataattccttgttgtggaggggactgtcctgcgcactgtaggatgtttagcagcatcgctggatctacccactaggtgccagtagcactcacctagttgtgacaaaacctaaaatgtctccattcattgatgtgtgtccccctggtgggggatagggcgtggagaggcaaaatttgctcccagttgagaaccactgttctaggacaagctctctagatgtggtctctgatgagcagcatcagcaacacctgggaatttgttagcaatgtaagtttcagccccaaccccaaaccttctgaatcagaaactctgggtgtgggagacaaggactctgtgttgtaagaagctctccaggtgattgtgatacaggctcatgtttgcctaggccagtggttcttaaccctggctgcacatttaaaatcatctgaacatcttttttttagaaaaacatcttcatgcctcggccccaccccaataaattctaacttaattagtttggtgggcgcaagtattgggactcttttgaaactccccctgtgattctgacatgcagtcagggttgagaaccacattttggacaccttttcttttcttttcaaccatcttttaaaaaacgcatctctcgaggtggaaagaattttacccaaacatatctttggctgttgcctcaaatgctcatggccactcactccaccagagactgaaggctacctcattcattatttttctcccactctgagaaaatgtctccctccacccccgaccaagcactcaggacattttcctgctcactgacttcccccgaccccattcaagtctggagttattaaagaacagcccatgactgaaccgtcttattgattttattgttcagagccctgggatattctaatgatatactgctcaataaatggaaactggtgggatagatattgacggtgtatggtacatttcactgcaattcactgggtcccagtcacttggcctgtaacatatcatctgtgaaaacgctgcgctgtggcctgcaagctcttatccatcctgctgatgttaccttttctgtgcatcaaggatgaaagagctattatgataatagcaatgtggccactgtgtgccaggtcctgggctgagcattttctaacagacttgatatggtttggatctgtgtccccaaccaaatctcatgttgaatggtaacccacagtgttggaggtgggacctggtgggaggtgactggatcatgggggtggatccttcatgaatggtttagcaccattcctttgatgctgttctctagagatctgcgtgtttaaaagtgtgtggcacctcccctgtcttgctcttgttccggccctgtaagacatacctacatccccctttaccttccaccacaattgtaagtttcctggggcctcctcagaagcagaagccttgatgtttcctgtacagctcacagaactgagagccaattaaaactcctttctttataaattatccactcaggtatttctttatagcaatgggagaatgaaccaatacaagaccttacctcatttactcctcacagcagacctttgagggaggcattctgactattcccattttacagataaggaaataaagactctgagtagttacctgacctggtcagctaatatgctgcagaactgggattcaaccctccatctgtcagacactaaaatggggacttttaacccctgagcttctattgtattggaacaacctttcttttcttttcttttttttttgagactgagtctcgcactgtcgcccaggctggagtgcagtagtgaggtctctgctcactgcaacctccgcctcctgggttcaagcgattctcctgtctcagcctcccgagtacctgggattacaggtgcccacccccatgcccggctaattttttgtatttttagtagagacagttttcactatgttggccaggctggtcttgaacccctgaccttgtgattcgcccgcctcagcctcccaaagtgctgggattacaggcatgatctgccgcacctagccatttgagcaacctttcagagggtttcagcacagatcaatatttcacagatcctcctcccttctcaagcagtatttctcaacagggactactgtcacttgggaagagacaattctttgagtggtattatcccatgattacagggcatttgaaatccctagtccccataacagcctctcctcacttgcatttcccagtgccccctaggggaccagcatggtttgagaaccactcatctccctgggaggcagaaggcttcctgccaagatggcctcccactttttggcaaacacaggtagccactctggaaaggctacatagcagagtggaaagaagtttcgttttgaaatcggacagatctgcattcaaaccatggctcttcccccattaactctgggaggtcgggcaagctatataacctctcaaagattctagctcatcatcagtaaaatagggatacatattgaccctccttcatagggaggaactgatggatggaattatgctcagagaagtgcctagtacagagcagtagctctgaacctggggcattatgtctttcccctgtctcctatgtgctctttccaaactcctgatccatagaatccaagagcataacaagtgatggtgttttacgccactaagtttgggggggtttgctacccagcagaagtaactggaacgaatgtctatgatatgccaggcaggcaccattctgggagtgaaaaatagactcatgcacacgccacaagagcttttgcttatgagaagcagcctctcctgagaaagaagacagataataaacacataaatatctccaggaccagtatgtggtatgcagaaaatgaaatggtggccatcattattgttgccttaaataatgatttgcaaatgactacattttctcttctcctctttccaacctcatttccctctatgctcctccaatcaccctttctgtgaagccaaaatgttgtttaatctcacgaaacctctgcttctgtttctcgatgctgaggtatcctttccttttccaaagacaggatttgctaggactgaatcgtgtcccccgaaaattaatatgttgaaggcctagcctctcctgtgaccgtattggagatgtggcctttaaggaggtgattaaagttaaatgaagttgggccgagtgtggcggctcatgcctgtaatcccagcactttgggaggccgaagtgggtgggtcacttgaagtcaggagttgaagaccagcctggccaatatggtaaaaacttgtctctattaaaaatacaaaaattagccaggcatggtggtaggcacctgtaatcccagctactcaggaggctgaggcaggagaatcacttgaacccaggaggcagacgttgcaccactgcactccagcacgggtggcaaaacaagactgcctctgaaataaacaaacaaacaaaaaggttaaatgaagtcctaagggtggagccttgaatttaggggatttttgctcttagaagagacactggagagcttgctatttctctgccacatgaggtcacagtgagaagtcggccatctgcaagccaggaagagggccctcactagaacccaaccatgctggcaccctgatctcagattcatagcttccaaaatggagacaaatatttgttttttaagccacctggtctatggtaattttttttaaatgatagcccaggcagactaatatacaactcaaggaggccagggatgtgccccttagactacaattgacaggttgagtgaggagttaactaggtaagagaagagggaaaagtgtccctaagtggagggaacagcatatgcaaagggcctgtcacgaatgatagtatggtaaggagaagacatacaggaaggccagtgtggctggaactgaggccaagaggaagtgcagaagatgaggatgggccgacagcagaggcatcacacagggtcttgggtaccaccttaaggactgcaattgaagagagtaacaagccctttcatcaggcttgttatccatggttgaggagtgggtggcaggcaggacacattttgaaattcccagatggggtggtgtgggatgccttgcttcatggggtggaaagacaggcaggggcccccatatcctgcactctgtgcttcgtgtgtccagaaagcctgctctatctgtactccctgccctcttgacccagaggctgctgtgtgcaagttctcctacgagccttcctgtcgcttgacattttcatctctgccctcgtttctcctctcttgaagggactcgcaggctcaataaatactgccatggaaaaacgcagcgactcatctatttttattacaaatggagcctctcgaggagggaacaactcttatttacttctcagagggagggttttgacaacaggtttattttctccaactctccaaggattaagtgagtaacactctaaagttaacagtacattaattaatgccaaattggttggaattttcctaataaaaatcctcatagtaatcacattatgggccattaacgctgcctcctgatcataaaccataaatatgttctgcaggtgccttcttttaaaaaagggacatttctccaaatcgtttcccatttgtcacattaatgctgtcacgtcacataatgcagacaggaataattataaaagctcatgtgggtaggatttactttgcgctggtcactcggccaagccctgtacacatatcatctcattgagttcttgcagcaaacctatgaggtcctgctatcattctcattttacacatggggaaactgaggcagacagaaagagtgtaatctgcccatgatcaaatgctagcaagtaatggagctaggatgtgagtccaagcaaactgattccaggatactctgtcatcctgcctcttgaaatataaggactacatctctaagcacagtggtcctcttcgtcaagcctactgctaatgaaatctccggttgatcacaacagcaacgagcagcaatagtcaacacaacatttggttttgctcctagagggcagggatggtgtttcatttacttggcctaggagagtgtctggtgacaatgccaggagcacttggaacatacagtaaattcctgttgaataaatggacatagaaacacacatgcaacagggttcacaacagtgggtaacaacgagcacctcaaatgcactgggatctcaatagatccctctccctgcaatgatgtgagctgggctcagcctcaggccggggctctgatacacagacaaggagaccacaccacttggggagctgcagttcctgggagaaaaccaaggaggacctcgtttcgaactctgttctagcttcacttcttaggtgcttctgattgtttcttggatttctctgtctacaaagataatacttactgtagaaaattcaagcatacagaacaatatgaagtaaaaaaaaacccagatattagtgccaaaatatcaccattgttaacaaacgttcagtgaacattttgcaaatagttttatgcactcacgttatatataatcatgtatgttctgctttgtcatatgcattctgttttcagtaatgtactcctgacatcttttcactgtcagtgaatacaggcattctctctttccttcctcccaccctcctccttcccttctcaaatgttcacagagcagctacgctgccaggcactgagaatgcccaaatgaacaaaaccagtgttgaatctgtattcaaggagctgacagtccagtggatgttggatggagaaaacagatcaacgtattttacaaaaggtgttggatgcaatgaatgaaaagtacgggcggccaggggaggagagagatggggccaggtgatctgatgcaaaccaggtctatagacctttccaaagaagccacggtgaagctgagctgtgaaacataaagagtgagccaggtgaaaggatgtcactttggaaggaaggaagaccatgtgtcaaggtctcaaggcagggagggtcttattttgaataataataataataaaaaaaaaaaaagacaaaaaacgttgggggtccaggcgcagcggttcacgcctgtaatcccagcactttgagaggtggatcacaaggtcaggtgttcgagaccagcctggccaacatggtgaaacctcatctctactaaaaatacaaaaattagccaggcatggtggtgcgcgcctgtagtttcagctactcgggaggctgaggcaggagaactgcttgaacccagggggtggaggttgcagtgagccaaaatcacaccactgcgctccagcctagtgacagagtgaggcttcctctcaagaaaaggcaaaacaccaaaaaaacaaacaacaacaacaagaacaacaaaacaaagcgaaaaagcaaactcaggggtggggagaggggagtagtgcggacttttgtttttttttttactttcctttggtgcttttctgtatttttaagacttctgtagggtaatgacaagaacttactgagtaagtaattcagggccactgggtattttttcttagatgcctccaaagatggaaggctcagtgccttacatagcagggcttgtgctcagcagtgattgtgagctatcgcttccaaaatgtgcctgctcgaagctttcatccataggtcctaatttggtcttcaaagatagtgctgctgcttctctggcaaaccaacctctcaaatatgtggaaattgttattttgctattactccggcccccatctccctccaaatctaagccacctgcatattccaagctcattcaatttctctcctacaacatgtaaggtctctttgtcatgtttcttcctgggagtgactagaagatcctccacgggcacagcctgagatcactgtaaaaactttgaaatacctcccaagcatgtgccagcacaaagtcatttgttcatttgatgaataattataaatgcctgtgagtgtgctataccctggggcagtggcagggggcagggtgtgaggtggagggggaagacagcagtggacaggatggacttatcacttatttgagaaataattatcggcagggcatggtggctcatgcctgtaatcccagcacttttggaggccaaggtgggtggatcacctgaggtcaagagttcaagaccatcctggccaacatggtaaaaccctgtatctactaaaaatacaaaaattagctgggcgtggtggcacatgcctataatcccagctactgaggaggctgaggcacaagaattgcttgaaccaggaggtggaggctgcagtgtgctgaggtcgtgccactgtgctccagcctgggcgactaagcaagactttgtctcaaaaaaaaaaaaaaaaaaaaagaaaaagaaaaaaaaagagaaataattatcaaatgcctgctactgggtgacacactgcagggctgcacactggaccagatggacatgataggcgaatctctaaataaatgtgaaatgaatgaacgctacatcttgtcttttaccattacagcatcattgaggggataaccattatgctgtcttggtgcttgtattaatcgagtcaagttccctaacattggtttgagagctccaggcaggtcactcttcgacctacctggaagaccagagagaccctgatttctcaacgatggcttggaaacttcatttaagccagggggctcctgagaatacttttcttttctttctttctctttttgagatggagtctcactctgtcacccaggctggagtgcagtggtgcgatcttggctcactgcaacctctgcctctgggttcaagtgattctcctgtgcagtggctcacgcctgtaattccagcattttgggaggccgaggcgggtggatcatttgaggtcaggagttcgagaccagcctgatcaacatggtgaaactccgtctctactagaaatacaaaaaaattagcagggcgtggtggtgcatgcctgtagtcccagctacttgggaggctgaggcaggagaataaacttttctaaataagaacctctctgaatgaactgacagaggaagctcattttaaacatgagctggcccctagaccagagaactgcaggggaaagtgggtgggtcctaggattttttgacaggatgcagttaagataagcctttaaggagacagaacgtgtgctaccacagcttgggaaggccactgacagtgaaaacaatttaaattaaattaaatttagtcagctccaaaaggaaacacatgtaatgttaatttcatgggtgtaccaatgtgtaaacctaacagatgatacttaaatgagaaaggcagagaaatgacatttggttaaacaatgcatcagtgggtaggatttgttgaaactgccatttaaaaaaaaaatatgagcacaattgaaatctgagcaagctgtcacccaggccaggccacctaggcgttctcatataacacacttgagagaagcagtgggtagccgggattggaggcagtctggataaatttggggaactcaggtcaatgtctgtgttaactttttgtttttgtttttgagacgtagtcccactctgtcccccaggctggagtgcaatgccgcaatctcggctcactgcaacccctgcctcctgggttcaagcgattctcctgcctcagcctcccgagtagctgggattacaggtgtgtgccaccacactcggctactttttatatctttagtagagatgggatttcaccatgttggccaggctggtctcaaactcctgatctcaggtgagtcacccgcctcggcctctcaaagtgttgggataacaggtgtgagccaccacgttcggcctgtgttaacttctgatgctcttcctgggcttgtttgcctgggcagataaaatcatttgcttgtctctccaactatgactgagatctcaccctgggcagaaagtgcgcctttgcttgtttatgtccttttcttaaaagcaacagattgtgtagtattggaggtacatgaaaatgtggaaagattggctttctgttttatctctgtcccttggcacaaaataggcactagggcaataaatgcagaatgagtgagtgatccagacactccttggccatgttttccacccttacggcttcatggtggcaacaacatttccttgcctcttgttaataatcatcacctcctaacatattgtttggggtcctcgtccctctccggcagccatcactccttttcaatattcacagaaccatgtcctatagtcaataaagctacgggaagctgactgattggcaaaaaacaggtctctactaaaaatgctaaccccagaaacaatgcatacacactgaccctgccagaaatatattgacaaaagccagcatttttttaagcacttactatatgccgggcatggtatcaagagtgttttcggttggttggttggttggtggcaatttttccagttcatcgtctcaaaacactgagacagatgccatcattatcccacttttgccaaggaagaacaggttgagactcaagaggttatatagcataaccaagatcacacagctagtggccaagctgggatctgaacccagactaacctgcttccaaagccattactccaacctgccttaaatgtattaagaatatgttttaagcagagtgtggtggggtgcacctgtagtcccagctcttcgggaggctgaggcaggaggatcgcttgagcctgggaggttaaggctgcagtgagctatgatcacgccactgtactctaacctgggcaacagagtgagaccttgtctccaagaaaaaataaaaagaacaggtttcagatgacttataagagaggaagttgacagttcctttgtgctttacatagagcactaaaatccagtatgagccagggcaatgctgggctcaacacatggatcccaaaatcgcagtggcttgaacccaacaaaggcttatttcctgctcctatgcagcttgagcagctctcctacagggccgtcctccaagaggtgacttgaggatccaaattgcttcaactacacaatcccactccttagcacccttctcttgcagtgcacagagaggacagcgattggcatgacaaattcacagcccgtcaactggcttggccaagaagtaaccatcatttccactcacgttcctctgagggagactgaatcctaggacccgacccagatacctgggagttagtaatggagagaagaacatgggtcctagaggaacatttatattttatgtcacagaaacatactaagttatgccctaagccagcacttcttgaccagggacaattttgtctccctgaggacatctagcaatgtctggagacatttttatttgtcacaactggaagaaagaatgctactggcacctaggaggtagaagccagggataccgctaaacgtcccaccatgtacgggacggcccccacagaagggattatctggttcaaaatgtcaaatgccaaggttgagaaactgcttgaaacccgtgatcctgaaaaagattgtctgaggagcttattaaaatgcagaatctagaccgggcgcagtggcttacgcctgtaatcccagcactttgggaggtggaggcgggtggatcacttgacgtcacgagttcaagatcagcctggccaaaatgacgaaaccccatctctactaaaaatataaaaattagatgggcacagtggtgtacacccataatcccagctacttgggaggctgaggcatgagaatcaattgaacccgggaggcagagattgcagcgagccgggatcgtgccacagcactccagcctgggtgacagagcaaaactctgtctcaaaaaaaaaaaaaaaaaaaaaagaatcctgcattcctccctccagatcaccaccctggcagtatttcagtattttcaggggccctctggcaactgtgacggccgctcttcgtgaaccacactcagggaaacctcacaggaaagaggaatcaagaacaccaagcgggggctgggactaggcgctgatgaactcacacagagacacccctcaaatgcttcagggtcagtgtgaggcaactgcgccaggaaaaaaaaaaaaaaaagaaaggctgacatttgttaagtgcctctctctgtctctttcgtgcaagccttgaattgcagggaacatattctaagactaacctgtcagccagtaacaactaaattactaaccttgcctcccgctgtgccccgtatccctgtcagatgcacagtcgcactcacagaggaatgcttcctggagatgtgttcccagcattggggaagctgacccttttgcaggaacagagccacgtggtcacatgtatttcacaggggccagggggctggaaataacccaaaggaaagggaagcaactctgggcagagcagtagggcaatcagagtggttgaggctcttggtcaaaaccacgtctgctttattcatggcactcactacaacctacttcacatcgtttgcagtcaggtcttgccaagaggctgtgctttagccaataaaatagaaatgtgatgcacacaacttctaggcttacccatggacacctgtgcatgcttctctgtgctatttccctcttcactgtctgggtgcagaagagcacggtgaccttggatgctgtgtgttgaagatagtggagatagtggagtcagatggaaagggcctggatccctgaattacaacatggaggggagtcaatcaggaacatctattttggatggcagaggatgaagacatcaaccatcttcatgttagagacattatacactggtggctgtgttccaataaaatttgacttacaaaacaggtggtgggctggattcagcccactggctacagtttacccatctctggttgaagagaagctctatctaccaaataaagtactagtcttccagaaagagttatctgattagacagtttgccctgtgtgacctcaacgcaaacaaacattgctacgtttgattgttatagcagctgatgttccctaactaatatagtgattctatacctggttactgaaggcagaaaggcttgggttcaaattctaggaccagacctcgctagctctgttatctagagaagctaccagaacctttgagcttcaatttcccaaagtggaaaatggaaaggaaatactgaagaaggtaacctgacatattttaattgaaggctgtggtatattggtcatctaggagctgttgtacagatgttctgattgttgaccacattctatcagcgacaagacggacaggaggaaaagcaaggcattgagatgggtgaaggtgaaccatttacaaagcctaaactttccatacatttcttacatgaacaaatgaatgacccaacgaacacttttagcagcatctgccttctatgaagaccaggcacgtgcatgcctaatcaccctttgggggcaagagccatctgtgatttggcttgttttctttcacagtcttatttcgcagtcttatcagtgtatctgtgcaaaagattactcagtgtacgtgcacttgttagcagatgcagggaagctatcacaatttagaaagcacgtgctttatactttcaagtcaggcttccctctgcgtcctggctctgtcacttatttgatctgtggtcttgggcaaatggcttcatgaactcttgaagcctcctcagcttccaaatctgcaaaaggggtatgccagagacagctaaccatccatcaacatccattttcccctctgttatacacaattacaaatgagaatgtgacacttatcaacatttcttcaacacttctcagcctctcttgtagcgaggtgcatgaggctctccctagattttaagacaggaatcttaaatattttattttctataagaggacagacagtaaacactttgggctttgtgggccatatggttctctgttgcaacttctcaactctgccactgtagagagaaggcagccacagacaagaccaaaacaaatgagtgtggctgtgttccaataaaacttaacttacgcaacaggtggtgggccggatttggcttgtgggctatcatttgccagtccctggtttaacagatgctcagcctaccaaatatagtattagtcttccaggaagagtcatctgattagacattttgtcctgtgtgacctcgtaagccaccaattcttattttacacacacacacacacacacacacactctctctctctctatttataattggtctgtgtctctgaaattctcatcatgttctgaaacgtcaactgtttcctgatctttaatcccagtctccatgggccatgtccctctccctttcctcctcctttttaggaccaactccataatttgcagggctcactacagatgaaaatgcaaggccccttgttcaaaaaatattaagagtgtcaagacggtgaaagcaaagcataaaatctaacatggggctttctgagcatgagctcaggttacaaagtccaccaagcagaccctgctggtctggcttgtattaccatcagcaaacccagaaagttttctgcctaatttcttgacaagtccagaaacttgccacctgcgagctgcttgaagcgtttcaggaatggttttgcacatcacaagaagaaggaggaaaaaaaaaaaacccaattttcttttagtatattacttgttagacagcgaaatggaatataattatggtgtgacatttccaacagcaaatatgttccagtgtaagcaattaacaccggttcttttggcaggcttaaaaagattactcagagactgtggtaagttacaatgccccatgaatcataaataatgtagaatcgcagctaagttgcattctacgaccaaagttcaaatttcttgatgaaaataaattgggtgcttttaaccctctgttgacttcatgtggcttaagcagattcggatcataagttctttggatttttgtaaattacatatttaccttacccctaagaacatctgcaaaaaattataaaaaaaaatctgcatgtattcatttcagctgctggaaatttgcatgaggtagtgggtttgaaggggacccctccaggatggacagaatgggggagacggcttacactgagaactattatccttggaggctgttatggttaaatgatgaagtcccaagatttagtagaaggcatatctggacctatgtccctattctctctgccattcttgacacaaccaaagggaaggcagcaccttctgaatgtatttgtgcagcttgtgactctgagcaactgaaaccaatgaaacaccagcagcagttacagagccacataccgtagggacattcaaggccaccgttacattcaaagcctcagggccgtagtacccttgtactatagcactactagcactatgggctggataactctctattggaggtgacagcaagctgtcctgtgcattgtgcagtgcccaggagcatctctggactcgatccactaaatgccaggagcatcctttctttagttgtgaccattaaaaatgtttccagcaggcacagtggctcacacctgtaatcccagcactttgggaggctgaggcgggcagatcacctgaggtcaggtgtttgagacaagcctggccaacgtggcgaaaccctgtctctactaaaatacaaaaattagccaggtgtggtggtggtggtagtgccagctactcaggaggctgaggtgggaggatggcttgagcccaggaggcagagattgcagtgagccgagatcacaccactgtactccagcctggatgacagagtgaaaccctgtctcaaaaaataaaaacgaagtttccagatattgccaaatgtccctggaaaaaaaaatactactttagatagacctgggtccatcactgtgtggccttgagcaaatgacttcattgctttgagcctcagtttccacatgtgcaaaaaaactcccatgcctaccttacagagagattgtgaggctgggatacaatgatgcagatagagcgcttagcctggtgtctggcataaagcaagcattcagtaagacagatgctatttattccatcacccatttgattgtttacaaacagctcctgagcacagtggagccatggcaggtaccaggggtgtgaagacgcataagccttatctctgtctcagacatgctaaccaacaacgtcagtgcaagggggtgctccctaaaatgaacacctggtcatggggcaatgggggcttggagaaaaatacctaaatctcgagacttcatggacaggatggcacctgagtaaagtaaaagttttccaggcagacacacttggggaagggcattccacacagaggcaactgcatgtgcaaaggtatggtggtatgagtcactcagaactcccctgagctcaggacggctgggaggtgaattctacaatgcaggtaagggaggaggagcagcaggaacaaggctggcaggcagagggcagatgaggaaggatcctgagatgtcaaatagttctcatctctcttgtcaacccaatgaactcatagcaaagctgagtccaaatcctgccttgcaggacgcaatgcagtgattgattagcaatgtctgctttggcccaggaaggtagaagaggctcaagctgcaatgtatttccttgtttgatgagggttttcatcaggggagtgatgtgaggagaagcacattttttaaagctcactctggaagccatgtttttttgtttttgtttttgaagagaagacagaggcagaaatggagcaggagaaagagttgggaagtgactgtaatactaccagacagagacaatacatgcctaaagggcagagcaggaggctggggaggaggagacagatacaaggtatttaggacctagaaatgatagcgactttgtggatttaagggagtagaaataacagagactcttggatttttggtttgggcaacttggggaataacagggttattcacctaggaaaaaagttcaggagattttggaggcagaaggatggtaggttatttttcagacccttagctcgtggaaccccaaggtagaaatgtccattgactgttgtaggtttggatcaggaacccagaccagtgatgaggaatagagtcattgcttagatatggcggctgtcttcactggccaataagtgagctacagtgaccctgcttctccagcccctggggaagcccaactgtaaatgagaaagacagctccttccagtgggattctttcctaatctaaaggcattcccgattgacaggattagtgaaggacgacagaagaaagtcattactgaataatcccctgcacatttcatagtcaacacagcattcatatgatccttgtaatccaattaggtgatgcaggaagctatatcttaattcctgacttcattgtgacttgcctggtcacaggcaaaccttgtttaataaggtgtcacctaaacactgagtggtgcatacaaaatgggcacagaacggtgatggggttgggggctgaggggaggaggtgactgctgttgagaatatgtcctgtctcaagcagccaataggggacttagaagctccatgtcctcatcagcgaggcttgtgattggaggaggcttgtgattggaggaggcttctgatcggtggaggcttgtgattggagaaggcttctgattggaggcagcttcatctccccttctctccatccattttgctcctccggacctgtgtgtgacaactgtctgtctggtggctggaactcatctgacaataggaacaacaatcatttttacatgattgctacttactgagggcccacttcatacctggcattttacacacctggcccaaaacacccttgggcagagtagattgtatcctcattctaaggatgagaaaactgtgactcagagagattaaggcatttgtctcaggccacacagctagagttacagctgggattcaaatccagatctgtttgatttccttttatttttattttttgagacacagtctcactcttttgcccaggctggagtgcagtggcacaatctcggctcactgcagcctccacctcccaggctcaagcaattctcctgcctcagcctcccaagtagctgggattaccaatgagtgccaccaagcccggctaatttttgtattttttgtacagatctgtttggtttctcaagttagtgtcattcgcctctggcaccatgcccttctgaggtgagattccagaactgacgtgcaaaaaatgtgcaaaaggcctcctgaactgtagcccgggccagtcctggcccgcatgtccatgtgagggctggtttgcctccatcctccttgtgcatgtgaccccagctgtgggcttatgtggaccggatgaatgtgactgtagttacacctagatcacaaacaacatctgagaggaggtgatgcctctgatctctatcagaccacgaggaaactagagagtatggagtctactccaagtgctgggctaggccccagccttatggcttatgctgggatctcaaattccaggccacactgggctacccatgtaaggtcaatgagagaagtaggccaggtgggggcagaggcaaattagaacaagcccattcaccctaacagaggtgatccattctcagcgccaatcattttaccatggggaatgcattccaagttgctcagtcttctggttttccagaagactccagaaatacttattcttatgggcattatcccaattttaaaatggttacaaattcacatttgtaaaaaaataagctgtatgtgagtgtactgggttaaacggcatccctccaaaatcatgtccactcagaatctcagaatgtgatcttatttagaaatacagtctctgcagatataattagttaaattaagatgagttcatactgggttagaatgggctagaaatccaatgactcatcttctcctaaggccatgtgaagacatgcaggaaggtcacgtgctgatagaggcagggactgcactggtgcatctacaagccaagaaacaccaaggaacgccagcagcaactggaacctaggagagagccatggatgcttctccagatcctctagaaccaaccaaccctgctcatgccttgagtgtggacttctgacctccagaactctcattctccaggacgagagaataaattcatgttgttttaagccacgctggttgaagcgatttgttatggtggccgtagggaactaaaacaaagagccaaacccaccagggctgcgagaggaatgtgcccaactgtccttcccatgatcacaggatcatgctcttgatcctgtccctgtccacctcctcgtctgaagcttgactgattcactttctcccttgcattgctgcctgtccactatgctggcctccatccttcctgggctagttccgatgtccccattttaacagcatttcctgatattggccactctaagccttccgtgagcagtagatggtcctgctctgcaccctgaaatctgcctgctgtctgtcagtcaactggagttgttttccaaaggaagctgatgagaaaatccaaaggcttgtcttcatccattctccgtttttcttccagagcttccaacagctggaggccgcctcctctttttggaataccctgctcttttggcagccctggtcctgcccttccaaggtcatctgagcacctttcatcacttcccttggctccgtgatagccttttctttcatcctccggtcccttcaatgtaggcatttcaggcctattctcttctctatgctttaaataagctaactcagtggccctcaactggaagtgatatagccccctagatacatctatcaatatctggagacatttttcattgccacaactgggtgaccctgtactaccggcacctagtaagtcgaggccaaaggcatccaaggggcacaggatagcacctgacaataaagaatgatccagcccaaagtgtcaacaggaccacagttgaaaaaccctgagctaacagaatcccactttgatgctcttgatcatttatctcatgacttgtgcctctcaaggaactctagtcttgaatgtgttcagaaggaaacagttcacgcattgcttcttggagatttccaatgtgcatttgcccttgaaaggctctgacaaggtctgcagccaaataaaaacttgctttgcatttgtttaatccaccatttcctaatgtatttgaatacagaaatcctttgtttaggcaataatcactatcattcttctgaagtaagctgcagtatctaacaatttattgagcatttaccatgttctagagtgtcctaagcacttcacacatcctacagggcctttctccccacaggcagtggggggcagtggggtgcagtggataacagtgttggctctggagtcaggtagctggcttggaatttgcagccacatcagttgagctgtgtgaccttcataaatgccttcatttctctaagcctcaatttccttacctttaagtgagggtacagccatgcatcacaacgatgggatacattccgaggagtggattgttatgagattttgttgctgtgagactatcacagagcgcagttacacaaacctacatggggtggcttagcacatacctaggttatatgctcctaggctacaaacctggacagcatcatactgtactcaatactgtaggcaactttaacacaattttaagtatttgtgcatctaagcatatctaaacatagaaaaggtacagtaacaatatggtataaaagataaaaatggtacacctatataagatacttatcatgaatggagcttgcagaactggtagttgctctgggtgagtcagtaagtcgtgggtgaatatgaaggtgtaggacattactgtacattactgtagactttataaacactgtacacttaggccacactcaatttataaaaaaataaactatgatgttatgactacaatgtaactagtccataggaatttttcagcccctataatagggctgaatagtcaacgatggactgcacatacaatggtggtcccgtaagatattataatcttattataataatctattattatatataatcgataattatatatattataatatataatagataatagattataatcgattatatataatatattatacaatatatactatatataaaatatataatatatattatatatacaccttcatatttgattatatgtaatatattatatataattattattataatctattataataagattataatatctatatctataatagatattatactcttatgggaccaccattgtatatgcagtccaccgttgactgaaacactgaaacatacagtgcatgactgtgtctgtgtgtctgtgtctgtgtgtgtgtgtgtgtgtgtgtgtatatatatatatatatatacatatatatatatatattgcccatgtcaaaaagttctgaatctcaaattagataaaacttgcaaagggctttatggtatgttctcagtaatgttgattattgattgattgatgatgatgaagatggcggtggtgttggcagtgatggtggtggaggtgatggtgatagctgtgatgactgtgaaggcgatgacagtggtggtgatggggataacaggatggtggtgaaagagataataaggtggtggtgatggtgattctgatgggggcggcagtggtagaggtgatagtggtgttggcaatggtggtagtgatgaagatggtgatgatatgaggtggcggccttcgtcatggtgttggtgataatgttggcagcggtggtgatggtggtattgtactctctatttggactgtccttcttgacctggtgaaattatatactcgcctacttatttatctcaaagactacgacgttttcactgattgccccctttgggcataattcttcctcttttgtgtcatatttttttaatgcctccaccatatcactctctgacatacactatcaggacttgtctcctctgctcttcagggggcaccttcccttcacctgccacatacaaagaggggccgtttaataaatgcatgttgacatcaaatagggtggattatggggcaccagaaccttccaacaagcctctccccaactccacaggaaaaatgacaacagaaagcaactcgatgagaattttgcatcccctgccggcttcaaggagacctcaaggcaaactcatgcccagcctcaaaacactcagaaaatgggaggtggcaccagaagacaagtttcattgcaggccaggcactgcccatcctgcttgaaaacagtgagtgatggatgccagtgctgagcaaagcaaaaggagggcctggaaaggaagcagcctggtttcccgctgcaagctagtgatggagacttctgactgcggaagcgagcaagagtcctcagagcagaaatttaagtaggaaggtgtggtgcagggctctgcgcatactaagcggcctgcagacgcgccctgcttcaaagcagagattgcaggctgccagctcctgggcctgcccagcctgcagacagcttttcttgggctcacactctgttgtgctgctttgttttaaattaaaatagttgtcagttaaatcaagagatttcagattaaaactcagatttcttacaaaaagaataataattggaagagtgagcaagcaagcctgggcctgcagttctcaaggcaagggagcctggggctttacactatcgtggagctaagtgagtggcagcttctacctgcctactccaggcattgacatcctgcctggccccttggggtattttgtgacgcttgctataaataccaccagtgtatgaaatgccaacttcatcctggttaagcgcacgtgcttgggggtgcggcagacttggcttcacatcttggctctgattttgcgtagctgggtgatttcaggcaaggttacttgctctccctaagtcctagtttcctcatgggccaagcaaaggatgctaatgacatggctcctccatactgaaggattcaagaagaccggacctaagacacacttatggagtgattctcataactggtacctgtgtcaacagtgaggcgggtactgctgccacgcccattttgcagaggaaaaaccttagactggagggatgaagtgatttgcccaagaatgcctagcttgtgagtgacagagcctggattcaattgcagaaagcctgccttctgcacccaagtcatcaccacttccaactctagatgtttcactcccaagtggcaaaatcatccctccatttcagctcttgcaaatctctgggcctacctttatccccgcttaactgttcagttacatctttgcctttccgatgaggctctgatcaacgctaagtcttgagatactaagttctgcacagctatcacccgtttgcctaatgaataatgaataaatacctaataaataaataatgggtaaataagcacataagaaatcaatcaaatcagctagtgggtagagagtagataaaaacaacaacaaaaaactaacagctcattgactactctttttttttttttggcatttctaaaatctctctgggatcattatacatttcacagcagcactcgaagaaccctccccatgtgggaatccagcaaactgagccatgtgataaaataaataaataaataaataaataaaccatcttctctgcaaccctaaggttcaagtctaccctgagcaaagtgaacccagcattccttggtgcacatccacagtaaatgattacttagcccacagagaaatgtctgtctgcaagactgtgttagttattatcctatcataataaaacagattatgctatagtaatgaatacgaccataatggtctgcggcagtttaatcaatgcattcttcaactgcaactgagcaaaataggtaatggaggatcatttgatctacatttttattaatttggtgtcatctgtctcctggttattttaatcatctctcattatgagaaaatgggaaaacttcctgaaaaaaaaaaaagtagagtcatcttgctctattttattcctcgctttgttttagtgtgaaaagtagcttgttccagttcagtttgggaatggaggttactgatgcctgattaaatgtagttctagatttcagagggaaaagctcccttatctcacacaagtcagacaaagctgttcaagtcatacacaagttgagacgtgttgaaagtggcctggaaccactaacagccaaatcatcatcattatcatcttttttttttttttttggagacctactatgtgctgaatgtgctgagcatggtgctgggtgagctcttctctccagtcctcccacccatcctgcaaaaggacgtaccagtatccccatttacaaatggggttcagagaggtcagctaacctggccaaaggtcacacagctggaaagaggcagtggcagactccaaactcgaagggccccgtctcaatgcctctcagtatttcttgtatgcacgaaagggactgtttgtttctcagtccccaaagacgcgctgagtcacggtagaaattatgcattcaggatactgagtggggaattatgacaaatgctttctttgcagttcctttaaggactgtgtctctcttgatatagctttctggcttaaaaaacgtttgcctagtgcctgcatctgtttacagaaaatctgacgtgttggtaaatttgcaccttgagtgtcctccaagtaacagctttagtccaaacccaggttctaagggcaaccatccctagccttttaatcacatacatcactctctattacttaatcattgttattattattattattgagacagagtcttgctctgtagctcaggctggggtgcagtggcccaactgctgctcattgcaacttctatctcccgggttcaagcaattctcctgcctcagcctcccgagtagctgggactacaggagtgcgccaccacacccagctaatttttgtatttttagtagagacggggtttcaccatattggtcaggctggtctggagatgcctttttcatcaacagatcagcatggccatgtgtggccctgaaggcttaaggttgctagatctttccatttatcttgagggaagctggagatcttgaaatttaaatacaagcatctgatttttaattattagcaactaattcagaaaattcaagcatctagcctgggcctggcatcttgctggctttagtctccatgctaagagtgaaagtgagcatgtgtagggtcttaccacctcttcttcctttacgagtctaaatggctatcaggaatcaaagacacatggactttttgttagagggactaaggagtgtcagtatcacaactgaaatggagagtacaaaaaaaaaaaaaaggctggacttggttgaggggacagtgtggaaaaactgatgtgggactgtgacctcagtgggacatcggactggtgatgcccattgtagtttcccggggctgccctaacaaagtcacacagctggggggcttaaacagcagaaacttactgtctcatagtgccggaggctggaggtccaagatccaggcgttggcagggttcgtttcttctgagggctgagaaggaagaatctattccatgcctttcttctggctcctagggaattgccggtaattcatgttccttggccttgagatgcatcacctgtctttacgtccatgttcccttggcattcttctagtgtgcatgtctatctgtgggtctgaacgtcctctttttatacggacacagtcatgttggattagggcacgctctaatgacctcactttaacttgataatttgcaaagaccctatttccaaataaggccacattcacaagtcctggggcttaggaattcaacctattttgggggatacaatgtaatccataatatctacttagcaattgagtataggattctgaaattctgaagagaggcttgatttaggtataattggcatttaggtggctgttcaacgcagaaagtaacgtaaagaacaatgttcaggtgagtcttgtttggggatttaaaagatgaaagattctaaggatgtgtaatatacgaagtttggtgcttctcaaactttaatgtccataaagtagaaatactggtattcaacttacaatcccaattattacattattattatttgaagggctccagaaggagatctgtgtttttcagtattttttccccattctcattccaggaagaagttccaaaatacattagagaaactattaatttttttttccaaatggacttttctcaccccacaagttggcctcccttggggtgactcctgccctctcctctgccttcccacactcagcaatgtgtcttggttgaagatactggttggaggtttaagatcaatgcccttcgtcctgacaggcagtgaactggtttttcagaacctttctcatgactccaggaagtgcacatgtaattaaactgagtctgtgttgggtttcagattagtgaagtgtgcctgtggcaaaaggtctcttccttcctgagagacgcagcggtgtaattagaatccggagacggattcatcagcatttcttaccagcgtttctacaggatgctccaatattcatctgggcctagttctgcttcctgggagaccatgggatgttgttgctggatgccatctgctggcaaaatgcaggggttcctctcgggtcacttgggtgacactgggggttcagtccattccaagcaagttagctgagagcccaggtaaaagtcagtagcaggctggtaagtgtctgtccttatttccaagtcagtattaaaatggtccaggcgtaaggctggctccaaatccctctgaaggtcattgttcatgcattagcagttcagcaaacatttgtagagcatctggtacatgtcaggccattccaccttcacttagcatcctttcggtgagggcagtggtacctggcacacaggctgggggatttttatcatgagctgaagtcagagcactttttcccctggcctttccattcatccaccccatccctaaaagtcaactgaaaccctggagaaacaagttgcagttattccttgttaaatctgtaatttattcccattaatcctttttgaagacaatggcaaatctgtaaaatgttcaaatacacacaggaaatagcaggccggaattttcagcttttgtcttagaacaggagtcagcagacttcttctgtaaagagttagactgtaaatattaggttggtgcaaaagtaattacggtttttgctattgaaagtgatggccaaaagtgcaactacttttgcaccaacctaatagtttaggcttttggagctgcacagtttctgttgcaaccactcagctctgcccttgaggttggaaagtagccacagatgatgcataaatgaatgggcgtggtagtgtttttacaaaagcagactggcagctgtctttggacccaggacccctgtcttagagaaatcaggttttgtgatgctgtcggaccccaataagggaaaactctaaattccctttcatggcctacaaggtcctgcatgaccagatccctgccctcctctttgtcttcagcatctatgcttcttattgctaattaaacttcagctatcccttccgccttctggctcttagtcatgccaagtgtgtggcaactttaggacttttgcaaagctgttctttcagtttcaacggcaccagtggagctggactccatccttttcagtttctcccacttctatcaacttttccaaataagtcgaggagtttacgtgatctcacaatggggtgagatatctcatgatatgaggtagggcagtcatctgctcattttctagatgcagtaatttctccatttcagtcagtgatagcaacaccaatcaggtcctctaatgaacaatccaggtgtcttcttcgattcctccccagcctcatctctacagccaacagactgccaaattctgccaaatttgcctcctgaattgttttcaaatccaacttttcctctttcttaattgaacctattgtcatttcttgcctagactaccccaaaggcatgcttactggactcttcacttgcagacttggacccctgtaattcatccatccatccatccattcatccatccatccattcatctcattcatccatccactcacccacccagtccatccatccatgatccatccatccatccactcatccagtccattcatccatccatccatccatcatccatccatccactcacccagtccatctatccatccattcatcccattcatccatccactcacccacccagtccatccatccatgatccatccatccatctactcatccagtccattcatccatccatccatccatcatccatccatccacccacccagtccatctattcatccatccatccatccatccatccatccatcccattcatccatccactcatccacccagtccatccatccatccactcacctagtccgtccatccatccatccatccatccatgcatcccattcatccatccactcatccgcccagcccatccatccatgttcctagtccattcatccattcatccatccacccatccatccatccacccaccgagtctgtctgtccttccatccatccacccacccagcctgtccatccatccatccaccaaccacccactcgctcagccagtccattcatccatcctttcatctgtctgtccaattcacttatctttttatccatccattaattgactcatcccatccatgttttcatccactcaacccatctttccatatatccacccatcttctcattcatccctccatttatccatccagtgtatctacttagtaccaggtggtgtaagtagtgaaaaaaaatatttagaacctgccctcctggatcttttagtttaatttggaaaagggatgctaaacaaactacacaaatacatgcatattaataaactggaataaatgctataaaagaaaagttttgcctgagaaagcataactgggtttaaactcagatccaaggaactgcatgaattgctgggagaggcatgagaacaggggtatggacaggaagactagcatgtggggaagccttcagctacagtctgctttctctaggggatgcaggaacagggagaatgggtgagaataaagggagataaggttgaagaaggaggtaggccagactgcagtgagtcctgaaggtctcactgacttgcaatggggaaagtccttggcaagtcttcagcagacgagccacacagttccaagtacatcttaagaagcacactctagatgcagaatgaagattcacttgggagaggcagggagcgggtatgagacgcagatgtgagcaggtaagttaggaatgtattgccacaatctacatgacagggatgttgcagaagagacagagagagaaatggacccagcagtgatattcaggatgtagaattggaaggtcttgctgctggttgaaatgtgagaatgagaactaacctttttcaagctcttcgggaccaagcctgaaccagcctcagtggcctgagctttccagaaggaaataatgctttctttaatgatgaggatagtaataagataattagcactgaacaagcacctactctacaagcaccaggtactttattatgtattacacatcattccatttaggagaacctgttggatagatactatcattagccccattttagagacggggaaaaatgaggcacacagaggtttaggtgatgtgctcaatgttccatagctgttggtagacccaggattcaactctagaaccccaatgattagaagcccatgtccttgaccatctggacaggaccatttccagtattccacatttcacaggatcctattccatgtttttggagccagagaactccggcgtagacacccctctgccaccccggagagaaacctcataggattccagacgcataagtaaagtctggaggctgagctccgctgatctgctgcagtctttattgctctacaaatgcattattaatcagccactggggtcctccccatagagccttttaaattacagttaaattccttgatagcgtttcatgcacctaatggtgcagttcctgtgttcacggcaataaacaaggggagagagggaggcctggataaccaggttaattgctctttgaggtttaggctgagaaagcaatggcaacagcacctctaaattctccaggtccctcactgcaatgctaataaagtcttgaaacaaacagcgctgtcaagccagcatcaggagtagagactacagtttcttcatgcctggcccactgccgtggcttcgctgggcctccaggtcaccttgccagggccctccttcttgggagctttcagtgtgagtgcgtgagtgcatggagatttggtttttaatggccataaaatttcagttttgcaaaacgaaaaagttctggagatgggttgcacaatcaatgcaacaatgaggagagggaggacaagaggcagcattgacgttggaactgatggggcacccctgggaacttgctgcttccttacgagtctcttactcccaggttatgaaacggttgacttttaggggatacagtgtggggaagaggcagttaactagcctatcttctggaactgtcttctccacatgctggagttggaaggtgatagcagccagggagctctccaaagcaggagtattagtctttcacactgttgatagagtcatacccgagactgggtaatttacaaagaaaaagaggtttaatggactcacagttccatgtggcggggaagacctcacaagtatggtagaaggtgaaaggcacgtcctacatggccgcaggcaagagataacttcagctggggaactcctctttataaaaccatcagatctcctgggacttattcaccatcataagaacagcaaaagaaagacccacccccgtgattcaattacctcccactaggtccctcccatgacacatgggaattgtgggagtacaattcaagatgagatttgggtggggacacagccaaaccatatgagcaggggttggcgaattatggtcttgggccaaacccagccatccattttgtaaacaacattttatcagagcacagacatgcctattcatttatgcactatctacacattgagttgagtagttaggacagagaccttctactctgcaaaacctgaactatttattatctagccttttacagaaagtttgtcaatccctatgttaaagtgtaaatcagattgtgctaccgtcttgctcaagacccatccagggctccctacgaccctagagtaaaggtcaaatgacttatctggaacaaatcatctagcctcactctgcaggagaattgtcatctgtgaaatgggagaatgaagaagcctacttcaccaatttagagcaagatttaaatgaggcaatgcatgtttcagaagagctatttttaaaaaatggtaaaacacacaacataaaatttaccgtcttaatcattttaagtgcacaatagtgttaagtatattcatattgttgtgcaaccaatctccacaactttttcattttgcagaattgaaattctacggccattaaaaaacaaatccctgtttctctctccctcaagcccctaggtctcaccatcctactcctgtctctaggaatttaattactctagataccttgtgtaagggggaatcacacagtatctgatctatggtgactggcttatttcacttagcgtgaagtcccccaggtgcatccatgttgcagcatgcgatagggtcttctccctttttaaggctggctagtattccactgtatgtgtagaccacattttgtttatcctttcatctgttcatggacacctgtgttgcctccaccttttgactactctgaataatgctcctataaacaaaggtgtacaaatgtctctttaagactctgccttcaattcttctaggtacacacccagaagagctaacttttattgagcactttctagagacagcctctgctttaataattcacacagatcctctcattctatcctcacaacagccctacaaggtgagaactattaagactatcatcattagggtgaccagataacttattatggtcagtttatgaaaagcctgccaatccctttgttaaagtctaaatgagatcacagcactgtcttgctcaaaacccatgcatggctccctaaaggtcaaacgaattatctgaaacaaatcatccagtctcactctataggagaatcctcatcaggttagagtgagactggagaactcttgagaggaaaaaggggctccattactaactataccaggatgacaggcacagatcgggattgtcctgggcaaaccagataccaatcatcatccccattctatagattaaagatcaagcaacagagcagtgaagtcccttgcacaaggtcccgagtgagggaggggcacagctaaaattcaaacccaagccgaccgactcaagctttcactgctaagcacagttctatgtgcttagcacaaggagcggcaacggtcagcaatcaatgtgaggtgtctcattatggactcttcaggctggggagaggggtcttcaggacgcaaagggtcatcaagggctgagaaagtcagaggggtgagggggaggcttttcacacccaggagtgagactgtggatgccaatgtgtccataccaaatgtgaacttgccccatggagagaagcagatgcccaggtctcccaccatgcttggccacggcaccatggacattttggactggaaaatcattgtggggatgtcctgtgcattgcaggatgctgagcagtatccttcgtgtctacgctttagatgccagtagtaccccctttcccagtcgagacaaccaaatgtctctaggcatgtccagacgtcccgaggggctcagtagcattggttgcaaaccactgaatcagggaaagggcagaactagggggaacaggatgttctcccaggtccgggcttctcaaagtgtagttctggagggcagcagcctctggcagaagtgtgatttctcaggttctgtcctcgacctgggtcagaatccctgggggtggggccttggggggtctgttgccaacacaagcccaagtgtggccggcaagcactgtccttgaccacgcaagaaaattgctgggatctcggaggactaggcacgagagatgttactaacgtgaaacctgaagagggatcccaggcagaatgcaggatggaagatgaggatgttttagaggctgtcaaggtcctgttggtgaccaatacaggatatactgttataaccaatacaggcttttcacagggcagtttgatgctgtctatcacaatttaaaatgggcaagctgtttgacctgccaattctattcttcagatgctctgtagcagccagtctcaactcaggatccccaagagaattaagctcgaatgtcctggggcatccgttgtaggtagcaaattagcttttctctgatgtatccagaatggtactagttatgtacatctttgagagatctgagaaaacagtcacttagtatagtaaaaaactggcaacaacctaaatgtccctcaataggggaatgaccaattacactgtggtgtatccatacccagagttatatggtcagctactataaagaaataacttaggtctctagctccaggcaaggaaacagacctcagacctggacatgtgcaacaacaacaaaaaaatcatctaacttgtgaattctttcatcccacagccagatactattaatatattttttacaagtttcagatttatacatcagtttcatatgatttatgaatctcttgtcacaaaaccacactcttttttttgacatgtgttgagtttagatatctaaagaaaaacaaaaatgtacacacaagtgccactgctcagatgggactgacggatcagggtggattttccccttatctgcaatgtttcagtattttaaaataatgagaatgtatacagccttgacttgaggaattagattttaacaagcatcctttctgcattatttgggcaagttcttaaaaatcgtgaggagaattctcctttccctgccttctcaccatcttttcactttggtcgctgcaaatatcaccggggactggctcttggcagcctcccagttcctctgaaaggtttctcactctatccatgccacacttggaggtgagctattaatttgcgctttgtggctcagctcgattctgatttagggcaacataaaccctcctcaaaattgcgaagaataaattagtttactaatttcgccattaagagtttatcaaagcaagcactatttcaatcgtctcttaatcaatcaccattttccgtgtttatctcctgttcaatttttaccagagggttctatacacatcaatttgtctgatgttcttcctacatatgttttaaattactttatcattgtataaatttcacagccattaaaaggctctaacaccagaatgactgacatggtgttaaaaattgaattcaattccacggggtaataaattgtgacctaaatccaatctctcatgggtgactgaaggatacaatgaaaaattattgctttgtcatttttacactaacacaaatataccacagcaactagaaactggcagagaaatgggaggtaaccgcggctggctatttctcaccccaggcaatgaactgacttcaaacacaagtccttagcgtcttggatgggattggcgcccccgcctccaaaagcaggtgaattatctgactgtgtgggtgggtctcattgcaacagacagattgagcacaaggagcaaatgtaagctgcaaagggcttgcttcagcctgaatgcagctgctcctatagacaccaaagtgcagtggttaagccccttgccacgccactggaaccaaagtctctgagctcagagcctggctctgctactggtgaaatgtgtaattctgggtaagttttctgtgtctcaacttctttgaatacaaagttgttatgaggaataaatgagttaatgtggctaaaccttcttaggatagcccttggcatttaacaatccctacgtagaggttaagtgttattatttaagagcagtttcttgtatagagaccttagctccctgttctttctggctgcagagatggagagtaacaagtatcaatagctagagaaaggtgttgattaacatgcagtgcattttcctttatctctggagaagctagatcagtcatttaacacatctggttccacatttactaagggtaccacagagcagacaagttaaggtgtgggttttgaagttaggcagaagtgggtttgagtctaaggtctgtcacttgcaaatgtgaccctgggcaagctacttaacctctctgaggatcagtttcttcgtctgttcaatggaactagagaacatcccttctccagggctgtgcaggagtcgcgatgagatcacacatgcaaagtgctcgcctccacacctggcattcaggaagtgcctaagaaatgtgggttctcgtgtcctagccccgtgcaggcaggggctggagatccagtggtggagactcaggatatgctatagcagccagtctcacctaagggtccccaacagaattaagggtactcagcccttgtggctcagtgtgggctacagagcactccagcaaccacgctatcctgtgacatgtaccccagcagggaacaggcaaggtggtttgggggcacacagcttgagcacctcacacagacttggagaggtgcagtgtggggagacagcatcacagaaggcttccaggaggaagtggcattgatatgaattcctagccctggactgccaagtaatttgagagaggagaaaaggccagctagttttgttgacttatgcagaaaggagagatagctagtcttttcactctagggcttatttcattcattcattcatttattcattcactcattcactcattcattcattcaagggccatgtctgggctccttccttcttgcactaagtctctgtcttggggaccctgggtggcagacacacaatcagttgtgcccaagggagcaagcctctcatggagcaagaattctatgtgctcttcgaatctccattctctgccttgttctggggcagctactgggcaagaactcatggaacgccaagaaaatcatcacaaaccaccctgccatggaagcgagtctcccatgcccacctgcaggcttccagaaccacaagagctgccaatcgagaggtggcctatggctgacttgtaacaggtgcttggtaaatatttgctggctagaccgatggattaatgaaagtacactcaaatacggtattttattcagcaacctgaggaggcaggggaggcccttgtgcaatctgttttataggaaagacgtgaggctcagagaacacaagtgccttgttcaaggctttcgcagccgataaagtggcagaggggccgcaagtcttttgagtttggttcaaaggcttctcctaatccagggtcaggtcaatgatagtgaaacagcccaggacactgagtctatgacattgctggaggcactgaggatttccttccatggcttggatgtcatgagaaacagcactgtaagaggaggaaagacctcccaaagatgtgtaccctaaatccagggctaagaacttgggggcaggggttgctttcctgatccaagatgacctcttgttcagggctcaaaagtggaagaagcatgattctgtagagagaggatgtgagacctgccccccagtcccagcctgccagacccttacctttggggctgatatagtttggctgtgtccccacccaaatcttaaattgtagctcccataattcccatgtgtcatgggaggaacctggtgggaggtaactgaatcatgggggtgagtttttcccttgctgttctcgtgatagtgaataagtctcatgagatcagatggttttataaagaggaatctccctgcacaagctctttctcttgcctgccacactataagatgtcttttgccttccgccatgattttgaggcctcctcggccacatggaactgtgagtccattaaacctatttttctttataaattacccagtctcaagtaagtctttatcagcagcatgagaacagactaatacaggggggcctaccttcccctcaggtctctggcaatttcagttcagtactgagagatgcctctacctccattctccttgctcaaagcaaagacacagatcctctaaacctagcacttttaggaattacaacttggcctacgagcagattaacctttttgcttataggaagagctcccctgttggtcttgtgagtgttttaaactatcaacacctctgcctacccgagggcctttgcacacgatactcccttgacctggaatgtccccctccagcttttcctctagttaactttcaccacccttcatctcttagctcaactataaaacacaactatgcaactccccagaattgctgttgcaattttacatgtgaattttttttttttttttttttgagatggagtctcgctctgtcatccaggctggagtgcaatggtgcaatctcagctcactgcaacctcctcctcccgggctaaagcaattctcatgccttagcctcctgagtagctggcacccaggtaatttttgtatttttaggagagatggggtttcactatgttggctaggctggtatcaaactcctgacctcaagcgatccacctgcctcccaaagtgctgttattacaggcatgagccaccgcacctggcctacgtgcacattttaatgatcgtttacccctgtgtttccctacccaactttaacaggccacaagctccctgaggacggggattctatctgctttcctcccaaatgaatccatccaaactagttcctggcatagacaggggatgctcgatgactaattgttgaatgagggtatattgaagggagctggtgacaaacagtttcaggtcccaggtggtggatgccatgctcagaataccacctccacagagattctagatgcccatttccattgctttgcttggtgcacacaggcctctgtagagaccccagtgtgaagggaggttgagccactgaggctaaaagcaaccacgttatcttctttcccagtgagggcaagactgaggattatgatgtgccaagcacgagatattcaaagatgagtacgatcaggcccctggcaagtctttccccaccatctaaaccaatgtcaggcacaaagcagcctctcaataaatattaaatgaataaaggaattcagcatatccaaagactaggaactgttccatttgcaagcagcttaattcttagcaagttcttccacaatgagaccaaatctatttctgttccttctctaggcacctatgtagtttttttgtttgtttgtttgtttgtttgtttgtttgttttgagataaagtcttgctgtgccacccaggttggagtgcagtggtgtgatctcagctcactgcaaccttgacctcccgggttgaagcaattctcatgcctcagcctcttgagtagccgggattacagacatgtgccaccacacctggctaacttttgttttgttttgttttagtagagatggtgtttctccatggtggccaggctggtctcaaactcctggcatcaagcaatgcacccaccttggcctcccaaagtgctgagatcacaggcgtgagccaccacacacagcctgtaggcacctatctaaatggttccccacctcacctgtcctctcatcctgctcaacgtcttcaaataaatcatagagtcatatccagacattagattgcagatgtggctattcacttgtcacctctggtctctcctattcaggtagaagctccatgagggtacagccatctagacgcccaattgatttccagaaccaatggacatggtactcaagtggcacaaggtgttctctgctcttgttcacagctctaactccaggtcctagaacaaggattggcaaaccacagcctgtaactatctattttggcatggcccttgagctaagaatgggttgacatcttaagtgggtagaaaacaaatcagaagtagaacagcatttcacaacaagtgaaaattatgtgaaactcacatttcggtgaccataaatgacttgaactgaagcatgcccacaatggtcatttgttgatgtgttgtttatggcagctttcacgctacaatggtaaagttgaatagctgagacagagaccatgcattttacaaagtcccaaatatttatgatctggccctttatagaaactgtgtgtgtgaggccctgtcctggagcacagccttgaatgtggtggctgaccaatgaatgggtcttctgatgttctctggatttgccagtctcttgcctttccccagcaagcccaaggaagacctttgggactagttttgtccaactccaatgaactgttactggatacctcttccttcctgggctcctcagaaggagatgccaaagggcccagttggaactgcaagggccgccttgggaaagcccgtcaaccccacccacttagccaagctgttcctggtcaatgtggcttcatcacatcaccctcattagcgtggtaccttttaacttttcacagctattccctcattttctcatcattggtgatacagcaaaggatctgggagaaagtagtatctctggctgacaaatggggaaactgaggtatttacctgggaccacttgtgacatccccagttctattttccctccactgcggctgtcagctacgctttctagaagccggctactcacgctgtgtagttaccccactgcccccagggcaggagggatgtagaagagactgcccttaagcagctggcagtatcatctgccagtctctctctgcagcgagcggccagccttccccccagaatccccatatccaaaaatccattcctgcaaaggctgatgggtaaagacggtttgttgctgccacaaagaacccccttctgttcatcctcacccctaacacctgtgccagcttccccagtcatgcgcaatttcctttgcccatcacccattggagaactgccgacttcactcagatgcccagaccggggttccccactcaagtccaacccacccagctcccagccaatcatcttccctggaacttctcacatttttcatttctaattcttcacctggatgtctagactgcagacccacaggtcacttacagcatctatgtggtggcttaaccagacccagcaaaggggaagaaatgcaggagcaacgcaaggagccagcagggcctttcttgggacattttaactcaagacacagagaggctggtggccgtgagggccactgcacggagggcgcttcctgacatgcaggtgttcaaaatgtaatgaggcagaaaaagctgtgtcacctggcagctggcacagattgcctcctatgggtcgcaggtgaaacagcctttattggaaaagatgctttgacaatgaaaggggcagagatgcacccttcacccaggatccatgtgttccctgcaaccagggcttctggggaagaggtggtcctggaaggcttcccagaggaagcgcattcagggtgggatctccagaggcaagaggtaacagccaaagtggggtgagtgggagttgtggggacagggagggggctggggaggactggaagctactggggctgtgtctgaagagcagacccagcaagacgtggctgcacaatggctgacaccatcaaagaaacccttttcctctcctctcctttcctcttcttgtcgccccttcatttagacaactcctccattgcgacgattaggttggtgcaaaagtaattgcagaaaaaaaaaagtcattgtggtaatactaacaagccaagcacatccacttaacttccccagtgcactcagcattttatatgcattgtctcatttcagccaaccacgctataaagacagaagatgagtttttgtgtccattttactgtgcagactgagtcactgagcggttagggttatgtcatgagtaacggcagagccaggaattaaaccccattgcccaagctgtccttgactttcaatctgacctggttcattgccctgaaacactaggggttccagttgaatgaccagagaccctagggtgtgtggctcaaaacaaatttctcggaggccatcactgggggtgatgcagcagagtcccttccccacacctcactgcatctccctctgcacggttgccagtggacagccagaggaatccctcttcccctcgtgaaaacagctgtcaccgaaaagggatggagctggggcttccttctaaatcccttttctctggaaagtaaaggagaaaagtcccgagagcaaggaatgtctcacagaaagcaaaccatctcctgggcttctggactcgacattttccctgagtggtggtggggtgaggggacagagagcgtgagggacaggaggagtgggggcgctgtaccaaagtcaacatttaaaatctatttctcttcccctgaatttttcagacttgcagccatgaggaattgtttccttaattatattcaacttccagcacactcttggctgaagtttaggtgatgttgcgtaaagcaaaatgagaaacacagggcatccatctgtgtgtatgcttatatgtatatgaatatttactcatatattaaatttccctccacccctgtctccatctcctcatttagcaaagaaataaaaggaccactgggctgaagctcaaatccctcctaagcagagggaaatctgggtgtcatggtttccagaaagggaacacaatccccgtatggggtgtaattacatcttagctttctgcagaagaatagtttatggcttaaatgctattaattgtaagccgttttgttccatgggaagttgttcattgataactacccaattagggttattttgcaattagtctattcacagtaaatttattgcaaatgggggagtctgtggtgtagcaaattaaagcgtcgctgaggctgggtgtgcaatggcttttaaatgccaatcttattaaccagctcacaggtcctgggagggtgcgctatcctggccagtgcactaaaggcctcaggacaaactccggcaaactcacactgcaaagccatccggagataacctcagcatgaccaggagaagtgcaggaacccctggcctaagatgctgaggttctgatttttttgaacaactgtggagcagtcataaagcaaatagggatgcaatgtacattagcactaccaggtacagttcttagctgtgtactaggcccttggaaaccctctaagctaagtgtgatgatgctcatctcccctttacagatggagaaactgaggcacagagaggtcaagcaacttgcccaaagtcctacagcttgtgcacgggacacctgggattcagatccacgtggtctgcctccaccaccccaggctcttaagcactgacagcatcagcacccctggcttcccaataatgccctgccttcttctcccttgcaacttgagagagagagagagagagagagagagagagagagagagcgagcctgcaggtggaagaacacctctggggcttgacaatgtgagataaagtgacccttctgcctccccaagagggacaggcttatggaaagggatacaggctctgtaacatgagttccagtaccagctctgtcatctgctggccatgtgtttctggccaaggactccccttccttgagcctcgatttcctcactgacaaaaagggttcacaatagactcagcctgtagggctggtgtggggacacagtgtgacaaggcagtgttgcacatattagcacaggtgacccttgaacagcacaggtttgaaccacacgggtccatttataaacagattttcttccctcctgccatccctgagacagcagtaataccaacctctcctccttcttctcctccttttcctcaactcaacataaagacaaggatgaaggcctttatgatgatccacttccacttaatgaacagtaaatatactttctcctccttatgattttcttaacttcttttctctagcttacttacatttatttatttatttacaattttttgttgacagagtcccgccctgttgcctaggctggagtgcaatggcacaatctcagctcactgcagcctccacctcccaagcttaagcgattctcctgcctcagcctcccgagtagctgggattacaggcatgcgccaccacacccagctaagttttgtattttcagtagagacagggttttaccatgtggcccaggctggtcttgaactgatgacctcgggtgatccacctgcctcggcctcccaaagtgctgggattacaggcatgagccaccgtgcctggcctagcttactttattataagaatacagtaaataatggaagtaacatataaaatatgtgtttatcaactgtttatgttaccagtaagctttcagtcaacacaggctattatcagttaaggttttcagggagtcaaaagttgtgctctattttttgactgcaaggaggttggcacccctaaccccagaattcttcaagggtcaactatagacagtgatagcattttgcagggttaagaaaactaaaagcccaagggccaaatccggcccatggcctattctttctttttcctttttttctttttcttttttttttttttttttgagatggagtcttgctctgttgcccaggctggagggcagtggcatgatctcagctcactgcaacctctgccccttgggttcaagcaattctcctgcctcagcctctagagtagctgggattacaggtgcacaccaccatgcccagctaatttttttgtatttttagtagagatgaggtttcgccatgttggccaggctggtctcgaactcctgatctcaaatgatctgcctacctcagtctcccaaagtgctgggattacaggcatgaaccaccacacccagccagcctatttttataagttaggtttaatgggaacatagcgcatttgtgtatgtgtggtctctggctgcttctgccctatgacggatggcagacttgaatagctgtgacaaagactggcccccaaatcctcaaatgcctaagatctggcccttcacagaacaaatgtgctgtctctgatatacagaaggagctcaatatttcgttcatggaatggcattcaactcaggcctccaaaacttctccaccaggcacaggttaacaaaagatgctggaaacgttgcactccacttaattattgctacactctgtgtgccaaatctaatcaagaatatagacaggaaccacctcgaccacttagacaagggtgaaacagcaaggcagaaaggaagcttttctttctaaatctttctatttaaaagtatcgtgtaggccaggcactgtggctcatgcctgtaatcccagcactttgggaggccgaggtgtgtggatcatttgaggtcaggagtttgagaccaacggggccaacatggtgaaaccccacctctactaaaaatacaaaaattatccaggagaggtggcaggcacctgtaatctcagctactcgggaggctaaggcaggagaatcacttgaacctaagagttgaaggttgcagtgatctaagatggcaccactgcactccagcctgggcgacagagcgagactgtctcaaaaaaacaaaacaaaacaaaacagatagaaaacaaaagtattgcacagacacatgcttgctactagaaactaaaataatatagatgcacttgttaaagttgtccctgctgccaccctgtccctgcagatgggggggccataaggaaggtttgctgtctatccatccagccctctttctgtgcaatgagtgtaggtggccacctcctatttgatctaaatcctctattctgtgaccagtggtaaacacagaggcacatatttaaaatgaaaaacacctctaattaactgggggacctggcataagtctcctcccctctatgagcctcatgttcttatctgtccagggaatcgaatgaagagttctcaccaggcgcggtggctcacccctgtaatcccagcactttggggggccgaggcgggtggatcactaggtcaggagttcaagaccagcctggccaagatggtgaaaccctgtctctactaaaaatacaaaaattagctgggtgtgatggcgggcgcctgtaatcccagttactcgggaggctgaggcagggaactgcttgaacctgggaggtggaggttgcagtgagccgagatcatgccactgcactccagcatgatgacagagtgagactccgtctcgaaaaaaaaaacaaaaaaaagagtagcgaatgaagagttctcttaagaggtctttttagtctacttttctggggagccattctcttgctgcacttcctttcttcatcaagagagttgggtgaattgaccatttgccttctcaggaggacaccaggcaaagccttgcatggctcccggatgcaccgatgccggtggaacggaaagcccttcctccccaattctgcagctggcttgattctctgactttatgccttgacattgagcagcacctcagtggatcccttccagctgcatctgttgaccctgacacctccccaatctccatctagctcgactctgacatgcccccaaccccatcggagcccccagagctctctgttgcctccttgctggcctccgtgctcatttaagggtcttttcccttcggagataacaaaagcaggggttggtatttggatttagaagcgacaagggggtactgtgaacctttggccactttgtgagggacagctgggctggccttgcagtgtggcccaatgagaaggagggatggccaggagtaaagagtgaagtaggctcccagggaaggtggagcaaaaagacccctagaatgcaagctgctccctggacagataagaaatctaggccctgagagcagaaaggactctccctgttagctggtagctgagcttgaatgaaatccacacccgtttatttcaaatgcattcctctctgtttgttgctagtggcaccaactcttcgtgggaaggtgccttttggatgctatccgccctctccacagagaaaaccactgagcaaacgaattcacaaacattttgagaatatcttctccaaggaaaaaagtaaaatttaagagtgctcccagaggctggattatcgtaagctatggtggcaggggctagcgggagggaagggggcgtgccctaaacaacagtgaccacgagtcaataaacagcgaccacgtggctgggtgatggtacattggggttctctctactctgagtgggtccgaaatttcctgccataacagtaagcttgtaagatcacttaaaggccatgtgaccttgggagagggattttacatctctcatctgaaaaaaattgggctcatgacatcagcatcagcctcagagagtgttggatgtgataaacaaattgactgcacagagcctggtgcggtgtctagcacacagcgaagcctcagcagccccctgtggctgctgtcattccccttccaagggcactagagaaggtgaaaatcactaccaagaaatacacatcaatggcacgattgcacatgcgctagtgaaactggactccccatcttcagatggcccctccactctgcctgtgaatttctggatcagagcttggatccctccgtgtctcagcaagagagctggtttatcatcaggtcatccgcacataaaagagtgccagtgaagggaaagagggaggggaaaagcaaagagcaaggaaaggtggaaagaaggaaggaaggaaggaagtaaagaatgaaggaaggaaaagaagaaaggagggagggaggagagaaaaattaggaaagaagaggacagaaagcaggaaggaatgtagaagggaagaaagaaaataggaagaaaagaggaaaggagagagaaagaaaattaaaataaggaagaaaggaaataggaaagaaggaagggggaagagaggaaaataaggaagggaatgagaagagggaagaaaaggaaagggagaaacaaaccaggaagaaaatgaggaaggaagggaggaaaaagggagaaagaaaataaaggaatgagaaggaaagaaggagggaaacaggaaacatatgaggaagaaagagaagagaagagggaaagaaacttttgatgaaggaaaacggaaagttacagagcctctgaagttaatgcaaccaattagaaacctctcaaatcataatcaattacaataatattcatatcaattctaatcccaatattctactgaaagagaaacgaaaccatatcaatacagctcccttggctcctgccagcatcacatcagctcccgatttcactataatttcatcctttgccataaaggcaatgggttaaagcacctacaaaaggtaatctgattttgcaaaatttttctgatacaagacttcaacactcagggagtactagaacacatcagatctcgtgtgctcatctggggtttggaaaacagggtggcctttctcagaaggtctgagaaggtgagcagaatggggctgggcaggaggaggaagtggccaggagatccctctctgagccagcggggttggaacttaccctcgagggggcagaaccgagtcaccttctcaggcatcagcagccctaacttgtggcggcagtaagtctccccaatctcctggcggcagtgcttggacttagcacgggacagggcagagatggcctccttgcctgagatgtcacacttagggggctggtcatacttggtctcgggggagctgcccccagttttcctggcatgaggcggtctggacacatccttcccgtggctgctgttggctgcggctctgtccccgggaggcagcacctcaccggggcctttcccagggaatgtatgtccttttcctttctcctgctgttccagcttccttttcaaaagctccttctgtctactcggtggcttcttcgccaactcaggctggtgcttctgcttttgagtcctgggtgcgaagttgctgttgtcgacattctcaaagtctttggggacagagttctcgttgttgctgtctgttcgcactttctctttcggccgatgagaaaagtagccatcctggagaagaggggagagaaacagaagagaaacttgactgagagatcatgctaagcagactggcctttgaagagtgagtcatacggacttggaagccggggccatagtttcacatcctacttttgctactggtttaacctctggtaagatggctctctctggacctcagtttccccatctggaaataggagatgttccaaccagaaaccaaggctttttcaagctctaaagtgccatgactacgattctcaatgcttcttattaaccacaccttttcaagtcagtttctttccttgactgtctttgccactgggtaacaaacattttgttccagcgtcccgtttaaattccagctgaaagtgctgtgatggtttacttaagggctggaaatgatataataaagttataaagggaaaaatattggtaggatattacatacattccattgcctttaggacatgctcatatatctatgcccataagagaaatcagactgagccgttgtaaattctgtgggaaagaaaccagccgcaattttttttttttttttttaagaggaatgcagcccttgtagaataaactttacactaagtcctggagcaaagcaaacttgcgacactcttgtgcttgagtttggctcttcatgtgtgtacatggaacagaagtgatgaagtcatttggggtcaagacaaagatcaggagtcattctggagaccacgcatggcatggatgtttccagaagggctggaccccaaactcagctcctccatgggtaaatgggtcctggttactttgatcagtcgaatgatcaaatgcatcattcaaccaatgccccaaattgtttctgcaacatgttgcttctgcttaaagctcattcccaaggccttaatctgaaagcatatccaatgtcctacaacacggcccctgacctctgaagccacagagaagagtaatggctccatatagctgcccttgttgctatggaaacacaggggcaatgggcggcatccctgctagtcctccttttaaggagggctgaaatatgcctcttaccagttcccaaggaaaaaggtgtcggggcctgaacagcggatctgcaggggtacccaagagcagctgaccctcagcaaggctcccaccccagcaggtcagcaaacaactgcctgtgttttttataaataaagttttattgaaacacagccatacctgtccatttgtgtattgtccatggctgctttcctgatacaatagcagagtgaatagttgcaatagaaactttctggtctgaaaagcttaaaatatttctatccagccctttaagaaaatgtatgcagacccctgctctgctggagtgtgagttaaaaggcctcctcctctgggactgggttagttgcttctgtcctcaccatccatatacgacttagtgatggcctggagaagaaggtgcccctaggactgggcgtggtggctcacacctgtaatcccagtactttgggaggccgaggcaggtgaatcacttgaggtgaggagtttgagaccagcctggtcaacatggcaaaaccccatctctaccaataacacacacacacaaaaaatagctaggggtggtggtgcacacctgtagtctcagctaactcagaaatctgaggcaggagaattgcttgaacctgggaggcggaggttgcagtgagctgagattgcaccaatgtattccagcctggggggagagtgaaactggctctcaaaaaaaaaaaaaaaaaaaaaagatgctcctctagcctctgctccattgctcctagcagtaagcacgaatttctcctatttgttggaggctctgacactaagacaccttgtggccattctgtaagctgagtactgctatgactttcattttgcagatgggaaactaagcacccatgaacaagtgacttgcccagggtcacccagctagttggcggtgaagctggaattcaaaccaggcagatcacagaccccacactctgggctaccagggacatgatccacttccaagaaattgtatgatccttattacacccatcacccaaaacccttaagtactgcaagctgacactgaaccacaagatctggcccctcccacccagctaaatgaatctgctagaggtgtgtgacctccaaattgcaatcttcaggctggctagtggcctattgtgttgcaggaagtcatatagagacagtaagcagcagccacgaagcacgtggagtctgaggctgcaggagctgggaggtaacaaggtaggaagaaggaaaaagaaccaagaaaaaaacagctgaccagtccatattgggtcacagggcggctactggttgtacacaggaactgcttttatatcctgacctataaatgagggccttctgcttctggtctttcttattctccacagatacctacaaaaaaaatccccttcagttggtacctagagtacatctttattcttgtaacctaaacaaaacctgctgatgttcctcttttccctttttttctatccagaggcccttgaagagtcccaagcagcctctcaggcgcattttctgagctcttaccatgagccaggcaccacagtaagttattcacaggtattacttatagggtactgacaattggatgtatttatcttgccattttatagaacgaggagccaacgcttgttgtgatacattcttcactatggatcacgtgctaggtgccatgctaagcccttggatgcagtacctcacttaactcctggaaataatttccaacgtaggcactactgttcgcccaccttacagaaaagggtggaaaataaggttggggatgtcgagtaatttgcacaaattcatgttggggaggcagcgaacttgcatctgcctgattctaaaatctgctattgtatcacgcctcttgtgttttgctgagaagtaaatcaagaagcattcagttcccctgcagtggaataatgggtatcaccatctttgctcatattagcgtctgtcgggatggagctgatggggcaggggtggcattcaataaagctatgaaaaatcatttctgttccattccttctagggatgtgttaggattgtatgtccctatcccttgtatattaggcacagacaggaaacatgctatggccaagagcagtgactggaacccataaggtgtcattccctggataccacaatatccagccacactcctgctggtggaggtcatgcatccctgagtgaggcccatgtggagtagagactctaccaaccctcagtgtgcagaaattgacccctgctgctttgagtcactgagatttgggggatctgtgttactgtagcatggtctaactcatcccgattaatccaggagctaacctgatctcctttcttcctttgagctgagtcaggtacaggagccaatttttttctccctccaacagacagaaacatctattgacgactcccatgctccaagaacataaatttaaattctgtccctaagcccattttctagaagtttctagaaatgtctaaagggcagggagtaagccagaagagctactgccctgatggacatcttcgttttctctcttcagacatatcctaagtgtcattctggggcccttctctttccttgttatcagcaagtttccccgccacacaacagaaaacctccacaaacccccatttcaaaagctcctgttctccatcactttctggctgaactttgccaagcaaaaccagacagaaaacactgcgatcatctccctccaccccccacggccaatgaagctaatctgacaatcagagaatggccaattcctctggctaatgtgtaatatcaggaagaggcaccaccattgattctgatgggactcatgattaatacccgctctctactcaagacaggccaccacaatggcgatgattagcttgtggtggccctgtgaacttctgcctggccccagatgctactcagctgccatgggaacccaaaagatttgagtataagagggaaggaaaatattttgtcttctggaacaaaagggctcacagatactagatcgcttccagaaaagtcagagagaggcgcagtcagcgagaattggaggcctgagaatttctgtccctcagagtcactgtcattttctatagtgactgcggcgttctctctggcttccccccttcaattcatttttttcttttcttttcttttttgagatggagtttcactcttgtcacctaggctggagtgcaacggcgccatcttggctcactgtaacctccgcctcccaggttcaagtgattctcctgcctcagcctcctgagtagctgggattacaggtgtgtgctaccacgcccggctaatttttgtatttttagtagagacgggttttcaccatgttggccaggctggtctcgaactcctgacctcaggtgatccacccacatcaacctccaaaagtgctgggactactatgataataacacttaacatgagatctaccctctgaaccaatttttaagtgtgtattattgttgactatgcagctatagtcaacactatagtactatatgcaacatacagcaaattgttgtatattgttgcatgtactactatattgttggctatagtactgcacagcaggtctctatggcttcttcattgtgcatgcatgattgagatgttatgcctgtccatcagcaactccccatgctcctccccaatcccccaactcctggcaactactacttcactctctggttctaggattcggactattttcgatagctgatagaagcagaataaacacgtgtactatctgtccttctgtgactggtttctttcagttagcataatgtcctcagagttcatccatgttgctgtatgttgcaggattttcttctttttgaagctaacatccattgtgtgtatatgccacattttctttatccagccatccaaggatggacatgacatatcacttcatgttccccctaactcttcatctgactgccaaggggcaaacagattttggcttttctgtcctttctgtggagactcaagatccagaaagccaaacccaggatcccttcccttcacaaaaccaatcttgggaggtctccaggcagacccataaaaaataaccatcatatgcccagcacccaagtggcccatgctctgtgtcctttgaatcttcttgaaaactcaccaaaacagacagtattagtactccttaagaggaggaaactaacatagagagaggttaaataacttgaccgaggctacactgctagtaatgaagtgattcaaactctctgtgtctcagtttcctcatttaaaacattgggatgataacaccttggtatccatggggatgataataatatccatctcaggccgggcacagtggctcacacctgtaatcccagcactttgggaggctgaggcggtcggatcatgaagtccggagatcgagaccatcctggctaacactgtgaaaccccgtctctactaaaaatacaaaaaattagctgggcgtggtggcacgcacctgtagtcccagctactcaggaggctgaggcaggagaatcgcttgaacccaggagatggaggttgcagtgagccaagatcgtgccctgcactgcagcctgggtgacagagtgagactctgtctcaaaacaaacaaacaacacctcacctcttgggtaattcagtgaggaagagtgtatgtaaaactactagaatatgcccaccacacaaagctggaagaagaatgagcagtaaaccagactggggaactctaccaattaacactctctctcccctgacagtctctgcctagaggacagatgggttattatttcgcaattgtgatcaactggcatcatcttctctactcttcatcaatccaactctctcaccttgagttatttatgctaatgcaaccctttgacttactttattttaatgtacttattacaatgattgcacattcaaatgtttgtgtgcaagctccaaaactctaattgctctgctgttgccttacctctaagctgctgctagaatccatttttattctggagaaataattaaatgcaataatgtcctccattcccattcaaccttgggcatgtttagagtcaatttcaatcaggtagaaatatgctaaacataatatggctccgagaagcaggttacctgacccacgctgctgctgcaaagacacgtgggtctgtttccatttttcccaggttctcttggttcaggatgaatcaatacttagtctactgaatcctggccccttgctcccatttctgaggggtgggggtgggttgccgtgatttttaaactatccacctttgctcttattgtttatgtaggagaagacctgggtactagtattgcattagctgatgtccaattttcttatctgtaaaatgatgtgtcccgaatgtgtgttactaaccattctgagttagttattaatcaatatattcaatgaacaaaattctgccacttcagctcattaaaacaattcgatggaccttaagagaccaggaactgaggacaaaatggaagcttcaaagcgcatcccgtctgcagccctatccctctattatcgtctatagcagcacactgagattcagaggtctggactcaggaagaagtgagtttgattcctcccttctccatttgctggggttcttcaagctgggacagaacatttcgcctctctttgcctcagtttcctcatccatcccagagagccgaagatggcacctacttcccagggactgaatcgatcaagcatagaagatagtgcctgacacgtccaaagtgcttaagaaacacgtatgtcttaggttccgttccaagcctgttgcatgtactaactcatttaatctccatgatgagctgataaagaagacgctatattttctacccatttttcagattggaacattaaggttcagggaggttaaatgactaagtccacacacctaggaaacagaggagccaggatttgaacccaggctgtctaggtctggaggtcatgcctttcaataccccactgcctctccgcagctattaggaatagggacagggccaaagggaaaccccagccaggtgcactgctcacacatgagggcgcctggcccacccgctcatcgtgatcagtttacggcttccttttgtgccatgtgcacgcacagccggctgggtagttatttggtgttgaactcagtgtccgaggcttcgttccaatcaccaaggctaccaaggccactgggagggacaaacagggagaggcctgcacctgcttccaaaaggacctccgtgccagggtaggcgaacggtggaagcacagtgtgtgtggctgtaccaattagaacatgcaattacccaggctgccaatgcaaatagacctaacagaggcccctcgtccagctcatctgcatgcacaaaaggtggctggccagcacttagaaacccgtggaccacgctggacgcaggcaggccctgctttaacagaaccctaagtaaaaagccctttgcaatgtagcatcatgttaatgggatgcaaaacagcacagggtgaggcaggaaggagtgagactgatagggctgggttggaatccagtctctgctccttaactctgagacggagggcaagaggtttaacctctcagagcctcatttttctcatctacaaaagaagggggtaagaagacctactttgcaaatgtaaggtggggattaactaatatgtcatgcacatataattctatttaacaaaacaacattgggtgagaggcttgatacatgttaagcactcaagtggcagcaggatgatattttaagctagcgccttgtcacttgatgagcaagtctgagtcttttgtttgtttgtttgagacggagtctcgctctgtcgcccaggctggagtgcagtggtgcgatcacgctcatcgcaagctccgcctcccgggttcacgccattctcctgcctcagcctcccgagtagctgggactacaggcgcccgccaccaagcccggctaatattttttgtattttttagtagagacggggtttcaccatgttagccaggatggtctcaatctcctgacctcatgatccgcccgcctcagcctcccaaagtgctgggattacaggcgtgagccaccacgcccggccaagactgagactttttggaaaggcagagtgttgaggcacagtgggttgaaatctggaccctggcctttgctcactgtgtggcccagggcacagtgcctaactttgtctgcctcagtttccttctctgtaaaatggggacaataatgagtacccaatctaatgaggctgttatgagaattaagagtcaatgaatttaaaacacttaatacctagaacttaataaatattaggtataatttattaaaatagaattaatgattgcaatggtgacttaaagtggttcttaaagtgtggtctgggaactgttgggggtccctgaggccttctcaggggatctttaatgacaaactattttcacgataatataaagacattattttcctttctcgcttactctctcatgagtgtacagtggagttttccagaaactccactgcacgtcatactgcatcagaaatcagaagcaaatgtgagaatctagctatcttctattaagccaggtgttacagagatttgcaaaaaatgtaaaacagtgcctcccttcttcctaaatttgttttcgttggggaaaaatatgcatacttttcataaatatattttatatacacaagtaataggttattatgactgtttttaagtgaattaataaacattttaagaatgccttagtttaaatattactatataggaagtaattgatagcacctacctaagccaaagctctttggtgttcctcaataatgtttgagactatacagcaatcctgagaccaagtttgagaactactgacataatacataagtacaatcagaaatatttactgattattaaaattaaaagtttaggattcttttatgtaggctgttttgctacatgccaagccttttgatttgtattttacttccatacacaatacacacacacagaacagatagaaatcgaagttgagtgataaatactttttttttttttttttttctgagacggagtttcgctctttgttgcccaggctggagtacagtggtgcaatctcggctcaccgcaacctccgcttcccgggttcaagcgattctcttgtctcagcttcccaagtagcacggattacaggtgcccgccaccatgcccgactaatttttgtatttttagtatagacagggtttcaccatgttggccaggctggtctcaaactcctgacttcaggtgatctgcctgccttggcctcccaaagtgctggaattacaggcgtgagccactgcgcccagccgataaatactttcctatagagagaggaacccaggcccctcaagtcctgaatcatcctcagggaggaagaatgacctgctgtcaagagttagtccttgatcaaactctagtcagcctcctctgccccctttttctactgggcctctcagctttacctataaagacttgaatgaaatgctaacgttgtttttctttttctttctttctttcttttttatttatttattttttgagacagggtctcattttgttccccaggctggagtacagtggtatgatcacgactcactgcagcctcaacctcctgacctcaagcgatcctcctgcctcagcctcctgagtagctgggactacacaggctttcaccactatacccagctttttaaattttttgtagagacaggaccttgctatgttgcctaggctggtctcaaactcctaggctcaggcaatccttggcttcctaaagtgctgagattacaagcgtgagctaccacgcctggcctgaaacactaacatagtttctcacagctcaaggcaacatccctgggatgaccccagctcctgcttaaagtgactgctttagaaaactcaaggctgccaaaataatttactgtttgttccagctaacacctctagacagggcatcatctcccagcctctgtaagagagcaggagccacacttcataaacagcagttagcaaacccatttgagtcacacatagaccaaccctcccttcctgcttttggtaattcttcacttccctgagtccactgagctcatctcccttccctccctcccacctctctccttctccctttattattattattattattattattatcattattttgagatggagtctccctctgttgcctaggctggagtgcaatggcatgatctctgctcagtgcaacctccgcctcccgggttcaagcaattctcctgcctcagcctcctgagtagctggaattacaggcgtgtgccacaatgcccagctaattttttttgtatttttagtagagatgggatttcaccatgttggtcaggctggtctcgaactcctgacctcgtgatccacctgccttggcctcccaaagtgctgggattacaggcgtgggccaccgcactctgcttccttctctctttaaaacacccagtcacctctgaacaaatccaagttgagttcagttccatgctggatgcttttcctattgcaacaggcattactgattaaatgtgcccttacccctttcatagggtctggctttgtttatgtttgacgcagcccaaggccacctagcctggacctcaagcctacaaggctaagtccttggggtaaaaaccaaagagcccagcaaagcgtgctcagagcccagcccctgacttaacccactcccctcttcccaaccccaccagggggacatgacagtgacagtcacagcgctcagagcacccaagggactgcaggcaggtggcagggaaagatctgaactggcatctcctggctctttccctatcagcataagagacagctgtgtggtacagagatacacagcagagggcgaaataatggcagaggagaaaaagacgaaaaggaaggaaatgcaagagaaaatggaacgagaagaagaaacaaacatcagctattgtttactatgtgctgattacctaccaggcacggagctaagcccgtggcttggcatcgctattcattcctcaaaattatctcaaaaagtaggtcaggggtcagcaaaacaccctaccacctgcttttgtcaataaagttcttccaggacacagccatgcccattcgtgcacacactgaaggtggtgcttttgtgctaggacggcagagttgtgtagctatgacagagactacatgcccagaaaagccaacatctggctctccgcagaaaaaatgaatgccccttcaaatggggccagtgaggctgagccaggcttgcccaaggtcactcggtgggtaagaggcagggtcagaagtgacgcacaggagtcagactccagagacaacatgaggttgcaaagtcagacccaaggacagagggagagagagcagagccttccagaaatgacaacaaccatgtctgttttggaacaaaatgcctcacacacagaagagcttttctatggagagaggcctcctaactgttttttgtttgtttgtttgtttgtttgtttttaagtgtcccgaaggctggcctcttcttcgttactatttgaacacagtttgcctctaattaattgcagcattccattgcgttattccacagttatggccacaatacccaaagatccagagagaaagggggtgtggtagagacacagagagagagacacacagagaaagacacagagagagagagacacagagagacaaagagagagacacagagagaaagatacagagagaaagatacagagagagacacagagcaagagacacagagagagagacagagagggagacacacacacagataggcacagagagaatgtgaacaacccagtcttgctttaataataaagccttctgcgtacctctcaggcagggtttctcaaggacagcgctgttgacatttggggctggataactctttgttttaggggctatcttgtacattgcagggtatctagcagcatctgtgagctttacccactagaccccagtcatgtgcccttgttacaaccaaaaatgtctccagaccattgtcaaatgtctcctggagtaggagtggggcaaaatcaccttcccacccccgacccctgctgggaaccagggctcaagggcccatactggccgatctcagctgctcaaatcctgttcccattcagaaacagcctttctttccctcattttccaacagaaacagaccctggcatccagccagagcagtcagaataggagagaggctggtatgaagagagctggctggagaaagggccagagttaaccaaggaagggtattccagaggggacagagggaggaggctggctggggtgaccagggagaaatggcagctgcatgaggaaagcgggagaagttagggttcccgctagggaaggatgacacagaagaggagggacacattcatttgggcagtggatagtctttgagttgatggcatgtcttttaatttattttttgttgttggttttttttttttttttttttttttttgagacagagtctcgctttgtcacccaggctggagtgcagtggcacgatcttggctcactgcaacctcggcctccaaggttcaacaaaatcctcccacctcagcctcccaagtagctgggattacagatgcgcatcaccatgcccggctaattttttgtacttttagtagagacgcggtttcaccatgttggccaggctggtctcgaactcctgacctcaagtgatctgcctcccttggcctcccaaagtgctaagattacaggctttgagccactgcgcccggccatgtctcttaatttaagccagaagccacaaccgggaccaatggctccttcaggcacacaggtgtctggttcactctgtagactgttttcatttgtttaacttaatctcggcccacatttcaaaatctagagatttcatctaaaactttggatttctgccccttctggaaacatcagggacctgacaacactgagcttagatttctacgcatgacagttgtcttgaggctaagtagcggtcccatggtctccagaaggggcatctgctctgtccggcccggccagtgtccccttagccctctggcatgtctgcacgcggtgacactgcttcccaccaatgacacaggctcttccgggaggccttctacctcctgagctttgcctcggagatctcagaaccccaaaagatccttgtattccagagtgtttgatggaggtggcattgtccctaatgaggtgttctggaagcgtgtggtggcatttccagttatcacaatgattgggggatgctgttggcaatgagtgggtgggagaacatcagaaacccagcaggacaggggaacactcgtggctggacaatgaagagctgtcctgcatcctgcacatcttctgaacgtccccagatgtcctgtgcgtaaacaactcatttataattatccaggccaggagcctaacttagatttacatatgatacaacattattatgaatggttttaacatagctgaattttctaggaaagtaactactgtttcactcaagaagagattttatatcacttagtttgaccacagtttcagaaaattacatcatcaaaggccacacaagctgtggctgtgagtcaccaacacacacatccattccccgcctgcatttgtaactactgaattctcactgactcaatacgcagtagctgacctcttcatgtatcctccagccccttgcaaccaagtgtggaccactggccagcaacatctgcatcacctgggaacgtgttagatgtgcagaatctcaggccccagcctggaccacaggaatcagggtctgcacattaacagcatccccaagcaattcgtctgcacatcaaaaattgagaagtacgccaggcatggtggctcatgcctgtaatcccagcactttggaagtccgaggtgggcagatcactggagttcaggagttcgaggccagcctggctaacatgatgaaaccctgtctctactgaaaatatcaaaattagccagttgtagtggtgggtgcctgtaatcccacctactcgggaggctgaggcagaaggatcgcttgaacccgggaggcagaggttgcagtgagccaagatcatgccactgcactccagcctaggcgtcacagtgagaatctgtctcaaaaaaaaaaaaaaaaaattgagaagtgctaatgttgttgcacccatcattcattcggtcagtcagtcagtcattcgtttattttggagacagggtctcgatctgtcgtccaggctggagcgcagtagcatgatctcggctcactgcaacctctgcctcccgggttcaagtgattctcctgcctcagcctcccaagtagctggaattacaggtgcacgtcaccatgcctggctaatttttgtatttttagtagagacagcgtttcaccatgttggccaggctggtctggaactcctgacctcaagtgatccacctgcctcagcctcccaaagtgctgggattacaggcatcatcatttaaataataaaacatattatctgtttataaattgctgtcatatatttcttcttcatactattttagcagtctattgatcttttttagagttgtgggtgtttaagtaggatagaataaggctggatttcatttctggttgggtgaaaggaatgttttaaaagatttgtgacattgagcagggctgggtctgctggggttaaaatcacaggtttattcattccacatatgttatttgggtgtccactccctgacagatggggcaggggaaaaggatataggaaggggaactaaagtatgcttcctgctgttggtggaattctgagaaaagagaggaaagtaagtatgaatataagttattttaatataggaccaaaagggagtgtagggatgggtgtgctcaggatttgaatttcatcaagggtgtggagcctcacatggtctggggtccaaggagaatggaggagacttcacagagaaagcagttttccagcctcatcttgagaagaaaggagcaagacagacaaaggaaaaaagggctttccaggcaagggcaaagcatgtgcaaaggtgtggtgagaggaccagcccaactccttttataataacaacgatcccagctaacacttagtgaacatttactctaatgactgagctacacactttatatagattatctttaaaactctcagagcagggccgggcacggtggctcacatctgaaatcccagcactttgggaggctgaggcgtgggaattacttaagcccaagagttcaagagtagcctggccaacatggtgaaaccctgtctctactgaaaatacaaaaattagctgggcgtggtggtgtgcgcctgtaataccagctactcgggaggctgagggaggaaaaacgcttggacctgggaggtgggggttgtagtgagccaatattgcgccactgcactccagcctgagcaacagagggagactccatctcaaaaataaacaaacacatcaacaaacaaaaaaccccagaacaactctattgggtaggtgcaattagtatccacatttcacaggtgaaagtatggaggcatagagaggttaagtaacttgcctcaaatcacacagcatggttataaacttacattgttactcctgtgggctgttaacaactacgcttggctcagtgccccacaggtttctaaagtcccccccaggaggaaacaccacttccaccaaaggccctggaagaaagcaatcactaagtgagctgatctttggcctggggtggggaagggaggagtccagaagtaagagagttatctgaaaagcctgggttcctggtgtaaagtcctcttgcctggctgcctgtgattcattctctacctctgttatttgagattcatttctaggttggtgccacgcccctgactcctgaaagccacaaaccacaatattctatttgtcccctggttttatttccctatacaccttctctgtctctcttgattcaactcccaggaagccctcttgtcctaaccatcatccttcctccccaacattctccgatccaggtcctctgggacggggcacttaaggagacaaatgggtctcctgctgttgaaaaacacccagttttcaaactcatcctttgcctgtgtgggccctatcccccacacacaccctgccacagtgggtaatgaatggttcacttgtaagctcattaccgcagggcctctaaagaaatggaaatgctcacggagccagagacataaataaggagaggcgcctgtaaataaataaatatagatgcacatacacacacacaaacccagttaatttctatcatctgaaagccggaaccatttggggtggggagagagagaaagaaataggctcctaatattgccatccatgtgatttcagaactgagcttccccagaagctgctaataaattatttttactatgcagaggtacaaatgaatatgctgctgtcaccccctaaatctcctttatgagcatgtgtttgccttggcccaacctactggggacaggggcttccgagcaagttttcattggccaagttcctgaaggaggctgccatcttgaaggtctgctctctgtaagctgcgggtgccccactggcacttcctgtttatgcctgaggttggcatggcctgcaggacatccaatgtcgattggaaggccacaggaatcaaagtgacagcagtgcctacactcaagcttttggaaaatgatttctgcagcctggactgagagctgctgttcacaagatggaatgtacccctcttggccatatacttcaataggccctgacattttctaccaagtttcagggtggatatgcaaaaacctcatcactaccaactttcgcgtgcactgtcatcatccagaaggaaactctggtcactccctttggaggcagtgtatccaatgtccagttctccaactgttcagagcaagaagtaggccatggaaatcatggtgatcatgatatgctaccaggacacgatgggcaccgtccgatgaagttgttataaatgtatgccctggagtcactcttgaggatctgaaatccagctctaccacttcccagctgtgtgacctagggaaagtcgtttaccctctctgagccttgctttcctcctacgtaaactatctataatatcaaaacctcgcagggctaaaaagatacgctgacttaaccagtgcaaagacacagttcagaatagttagcagttaataaaaggtagcggttacccacatcatttcatgcgaactcctacaacgacttttcatacattcattcacagatatttactgagtgccaagtacatcttaggtgctggggacatgtctgtgaataagacagacagatgcctgctcctatcgagcttatattttaatagcatgagacagacaaccatcctaccaacaactcaataaacagattctatcacaatgttgggcatctgttatctatttttatctattttatttttataatttcaacttttattttagattctggggatccctgtgcaggttagttgcatgtgtgtattgtgtgatgctgaagtatggagtatgattgaccacttcacccaggtagtgagcgtagtacccaatggttagttttctaacccttgtccccctctagaagttctcggtgtctactgtcaccacctttttgctttttgtttttccagacaaagtctctgtcatccaggctggagtgcagtggcgcgatctccaatcactgcaacctctgcctccggggttcaagagattctcctgcctcagcctcctgagtaggtgggattacagggatgcaccaccacacccagctaatttttgtatatttagtagagacggggtttcaccatgtaggccaggctgttctcgaactcctgacctcctgtgatccacctgcctcggcctcccaaagtgctgggattacaggggtgagcccccgggttcaacctactgttttcatctttatgttcacgtgtactcaatgtttagatcctaattccaagtgagaacatgtggtatgtagtcttctgttcctgcgtcattaatttgcttaggataatggcctccagctgcatccatgttgctgcaaaggacctgattttgttcttttgtattacccactgttcccagatgtgggaactgaggctcacagcggttatctcagcaggtttatgagccagagttgtcccacccaggagagttttggaagtgagaggagcaaccagcaagagaggccggctgcctggctgacaggtaaaagctttgtttcctcctcctcctgcccctcctgccatgattgacagagtgagacgcctccctgcgaacatgaggcatctagttcgggtagacagtttgctactggagaagttccttattcaaggggctgagcagtagtggcaccttttcgtgtatgaccagccagccgtgcccagacttctgaagtctggctggattcagacaccgaactccctttagtcctcaaaggacccatgaaacacccaacacaaggtggttccaagagacccggtggaccgcagttgttcaggccactagatggctctttctgtgaaatttgcagagagcaagccggcagctgcaccttgatactgaagccgggctgcttccctttggacagtcaggacgcatctccgagaagttcttcttcattgccgcaggtgggtgggtcactacctcttcctttaaggggtattcccattaaggcttttcacttcagaggagtttgacaaggcgagactgggatttccacactgtctactaaatcaaagtcattgccatcatgcaactttctgctaactttcccagcttcaagggaaaagtggagcttcatggagctccacttcatcatctgttggcttcacatcatcccatcagagacaagctccatataacagcatctactgtttacccaagattttgcacgattctcttgtttcatcctcccatttatctttggtggagatattatccgatgagatagaaaagtaaactgtggcacagaaagggggttacatgactcaggcaaagtcgcccaggaagcaaggggcaaggctgggatccatcctaggtctgattctgaagcttgtactcttcactttacagcctcatctatgcacagggaagatcctcctgagctctgcaagtgtccaaacttagaatgggcaaccaaggctgactgtgaacatttccttcctggttgggctttaggaagagaagcgaaatttgcctattacctctacacacctcctgagaccaggagaatcctgggtgacaccaggcattcaaggatttcatgatacagtctctccctccctaatgcacctttcagcgttgctactgggacagcatttcctgtgcctttttaaatttaatcctcttcacagccctctcaagaggcagcgcggctctgtgatcaggagcatgaatgctaaagccagactacctgggttctcaacttagccgtgccgttttgaagctgtgtgaccttgggcaggtttcccagctgtagccagctcatggagttgaaatgagaattaagtcaatgttgggaaaacacttaggacaaggcctggaacacaaattgtagctgttactagtatgatcattaatagtagtatgtcctttttcaacatttgagtaaacagaggctcagagaggtgaagacacttccttaaggccacacagatcagggatttaagccatagcaccagacctgggagccaagctaatattccctctccaacacagccccttcaagtcccaggctggaagtgagctgcccttcttagcagtgaaacacctagaaaattggctgacaatttatcgagggcgtcttcaacaagtgtgtcattttggatacactgtgggctaactattggtgcagagagtgggctgaggggtcagcttcttcagcatctggcttcatccatctctgggtcattgatggcttctgtcaagatggccaaagaagaccacgagagtcaggctaggcctcctcctctgcatattaattacagccaaggcaaaatgtggccacagcagcagttaggggacaacaggaccctgcaagtcctcaagcagtcaggcagaggacaccttgggcaccccgccctctgcccagcacaatcttccgtggcactgccgaggacctcagcaagatgcagacctccagggatgtcagcctgtctcctcctctaggtctgtcctctttctgtccctctgtttgtccctctcccctctctcaaccacctctccatcattctgcaatcaacatcctgcccatggtcagggatatctaaaaagctatccaggctgggcgtggtggctcatgcctataatcccagcattttgggaggccaaggcaggcagatgacttgaggtcaggagtttgagaccagcctggacaacatggcgaaacctcgtctctaataaagctacaaaaattatccaggcatggcggcagcacctgtaatcccagatactcgggaggctgaggtgggtgaatcgcttgaacccaggaggaagaggttgcagtgagccaagatcgtgccactgcactccagcctgggtgacagagcaacactctgtgtcaaaataaataaataaataaaaagctattcatcttctgaagaatggaggtggtcagattttgtcttattttctgaaacatacttcaatattttcctaatacaaatatgtgtcagatataaaaaattccaatacaatctagatttatgaaataattcaaaatgtattaaaatgtacagaaaaataatacagtgcccttccatgtaccaattttgttatgttttattcaattatttaaagaaattagactttgcagagacaactgggaagttcctcccagctttcaaccaccatctcccaacccagaggacacttctatccttcacattcatgtatttatatttttagttaatacgtatgtgttcacatacaatgtatagtgttattttgtgtatctgtaagtttgacaaaagggcaccgtgctgtaaatatctcctttgcgtttgcttgtgtcattcaatattagcatttctacccccatctcctctctccttttattttctctcttctcaattcttcttccctcaggtaacatgatgcagaaggaatgacagcatttagttcaccaattctcagccttgccttcccattggactaatctgggagccttcacaaaatgcagatgcccaggtgcccacacgggagatactggtttagtgggttggggctgggcctgggaatcacgatttctaaaagcccccagacagcgaggggtaagcaactggatttggcccctctttcagctttgggtacctgctgtgaatcaaggtcactcctgctcagaggccaggtgaaggaagcatctgataggctggcctgcagcatccaggggagcggctgaaggacaggtactagagctggaggcaggcatcagagccccagtgcccggtcacgcccggggttgtgactctgcttggctccatgcagcatccaggggagtggtggaaggacaggtaccagagctggaggcaggcatcagagctccgttgcctggccacacccggggttgtgacactgcttggctccatggtactctgtggaccctgctcccaccatctgtaaactgagtgtgctgggtgagggcagtacttcctaacacttcctcccttcactggataattttacttggctcacatttaaacataaacatttatgttgttaaaaaaaatgatggtcatgattcctaaaattcaaacaaaaggaaaaaggaacaatgctatggaaccctggctagaccaagttgcctggctaaggctctgaacccagagagtcctttgtctgttgcacagggaaatgtgtaagtgttggcaaggtgttaaggacatcagcaccgtgctgagactttctcattggtttaatccaagagattgcaggagcactggaaaggcaatcatttcctccctggatgattcaaagttatttaatatccacagaatccccgcaaatcatcttgggtgccaccgtgggccacaaacacttcttggaaacacatggacctgggtcagtccctctggtcccttatcacatggatgctgtagggttctatggttctatgggccatacctgagattccattacaggggaatgtcactcccctcccttctctctcagtctcccagaatggggatggatgaagagatccagggtgagctataattcccctcacccagccttaatctggctgtcttcccggccagagctctccaggcaactccactttctacctccaaataatgatggtagtactaagtgcagcactgactgtatgctaggaactgttctaagcaccctgcatggtctagtccttttaaacttcatggcagccctagggggcaaacacagtcagcactcctatttctaaaatggagaaactgaggcacagggaataaaataccttactgaagaccctcaccccagcccccgacttccctaccccctggccagtaagtagccacgaacaactgtactacaatgcccttttgaatggcgggggtgctgacagctgtctatttgctctaaagatgtggctgcttcagggagcaagtgagcagggggagaaagaggaaaagcatttttagaaattatttccgacaggtgaccacatactaaaataacaacatttggtttgccttgctagctggaggcaaaaatcggctcaggtgggagggtgaggctgcaggctaaatgcagacaaggctggcttgccctgagttggcccagttctaggaagggcaccggcatttctgccattaattgatgcactgggaacccccagcttggttttctttaaggagagaaggagctgggtctttcatggtgtaactgtgaaaatgagaacctcccaggggctgcaagacctggttgtatatggagtccagtgagctattttagggacgaagtgtaaaattgtggaaaacagttgtaacacaggatggggtgtgtgtatgaatatttttattgaaagcaagaatatttactgcatacttactatatgccactgttgtaagggattaacctgcattacactatttcatccttgcaaggatccttagatatagctactattgctaaccccatttcacagacaatgaaactgacacacagcaataagtcaccccccccaagtcacacagctagtaagcagctcgttcagagcataaaatccagggctcatcacctccaaacttcacatattgcatgcatagacccacatttccagaacgcctaagaaattcccagtcatccagcacgagtggatggaaatgaaggggcacatcccgtcctcgcttggaaggaagaaggagctagccctggaaaactgacagactggcacgtctggaggcaaagccaagccaacgggagcagatggagcccaggcagcagatgttaatacagtttgctttttccatatgctcttctgtttagctgtaataagtgaattgttctttaatatctgtcaggagctcaaactctgaaggccgggggcagtcacagtcactcaaaaagacacaaagggaagctggccagccgtctcttcacatcccagaggaagggtgcagaatgtgaagaaagatgccaaacacagcaaagtccaggtctttgtgtacacacacacgcatgtgcacacataggcacacacgcacacactcctcgcctgccatgacagtgagattctcacttgacattctagagtctttgaaatcctgcctcagcgtccttcccactcagtaataacaactaagtagaattttcagattttgcctttgaaatgacaacaatgaaagacccaatttgaaatgtataaagggctccaacggctttgctccttgggacttccaacgcaaccacaactcatttccttaatcaagggcagcagggccactgcagaaccctgtcttctgtcttaggatacttcacgtgtcttgggacatccagccccatcactattatcacataggggcggggtgtgatggtgacgtctgtgaacagtatttcttcaacgatatttccatttgacaaccatgaattaggactctcatatagtctcaccaacttcatcttctttctaagtatccagctgtgatactgttatccgcactaccactatacacccgcccagtcagagaataaacacagagggaaggtcccctggtcctcacagttccagctcaacatagagcagaggttgagttctgagctaaacctcagcattatcccttaaaatccacgtgaccttgggcaagttacttctgacatttctaagcctcagtttcttcatctattaaatggaaagaaatagcaccttcctccctcaacagtcctgttgcgaagatcaaatgttaagaaatgcaggttaagtgttcagcacagcaaccggtacttagcaaacacttactgaggagcagctactatttttttattattacttctatttctcattcattcattcatcccactaacactggagcaccttctaggcaacatacattgtgctaggtgctcagtagtgaacaaaacagattcagctcctgccctaatggaacttacattctacagggggagagataatagagaaataatagttgtccaatatgatatgacctggggatgagtactttaaagaaagataagacaggagagaggcagcggatggcatttcagatggggtcaggtaggaactctctgaggaggtagcatttgggtggcccaatggtaagatggagcttctccaaacacataccgggcaaaaggtaccaggcagcaggaatggtaaaagcaaaactctcacagctggggatggtgctgtgcacctgtagtcccagctacttgagaggctgaggcagggggatcacttgagcccaggagttcgaggctgcagtgagctacgactacaccactacactacagcctgagtgacggagtgagactctgtctctaaaaattaaaaatttaaaaagcaaagctctcaaggcagaaatggtctaggaccagtctagcagcaggaagaggaagatggggctgtgatatggagaatagactcatacagcacaggaaagcaagatggggctgaacctgggtacacagagaggagagaagtccgtatctcattctaagtgcactggggagccactgggggcttaagcaggagagcatgccagatctgactgatggatcctggaagagcccactcacccactgctcacagatgcagagagaggaagcaggggcagaaacaaaggtggatgcagccctggccaagtccagactgagatcagaatgcattgcctgggtgctgctccagcctcttctctccggggtgttgctggggagggatgagggaaaatgcacaagtgatgggaatttacttagaagtttctggctgcaagcttgggtgactagaatcacccaggaccccatggtagtgatgatctcacaccagcaaatggctttaaatcagaattcaaatgagtctggtaaaccaggataaagtgtgtaatttaaagcatcccggaagccctgggaacttgcgctagatgcttctcgatctgctctcaggggatctccagcattattctggagagatctggtagcagaattaatgactctggcatttcccacctgatctagggctttgatccttcctgccccatgactgtctcagaaccaaaggttgtgggacaatgggcactgtgcatgtgcccagaccaagaatcagcatttaggcctggctgcaaatttcaccatcatgcccgggggccctgctttctgctgatgtttcagccaggaatgccaggcccttcacccctcaccctggcttgcattcaaatgacccctgcctctgtctccttcaccagactttctcctcctcctctatgcctacagaacacttttaccaactccactacagaactttccacctgaattgcttgttaacatggtatagccccctaaaaatgtgtccttctgaggagcagaacttattcaagtttataacccccaagggtctagccccaaacctggtgtatctctgtgtgtgtgtgtgtgtgtgtgtgtgtgtgtgtgtgtgtgtgtgtccatgtgtgtgtgagtgagtgagagagagagagaaagagagagagacagagagacagagagagactgtgttatgccaatatcaacataaacagcagctaacacaatgggggtctgggcccacgtgcctctctgctaatcactaactttcatgatcttctctgaccctcacaataaacctgtcatagaggatctattattactccaaacatacttagactcaaaaaggctaggacatttgctcaaggtcccggcactagtaattggtaggactggaatttgaaccaggctcatgtaagctcataaatcaagacccttctccaccacacttacttgaaggggtaaacagagactgagcaatatgtgggaggagtgggtgggaggctggggagggaggtatggaataaataatcatggaaggggatggcagatggaaattagagaaattaatacatccaagaatgttctcagggttttggtcaaaccatggactgactcaccaatataaagaccactctccttgtcatcccaaaccattcaccttcaagtatccacggatctgcactgtcactttcttagcccaggtcaacctgtcacccatgtggatccttgatcaacacagcactaaaattgtatgtaaaactggcttagctaatactcattagctagccacacttaggcacattacgtatattagcttcttgaatcctcacaacaatccccatggataggtatcatcatcatcctcatcatcatcatcctcatcatcatccccatccttgttgtaaggttttccagcaagcaatggaagacggggacttgaacccaggtaatctgccaccttcaccacaaagtatagccatcgttgattgtgtccttacactgctctaagcatctccccatgtcttctgctttaagcaaacttatgagatggggagtgttttcattccaattttacagatgaggaaacttacgttcagagttcaaaccctgaattctgttcaggtgtttggggaggtcaaacccaccaaacaccacccagccaaggccacgatcattcactgatcctgcagctttatgagaataataaaaaagattccccttactctgggcaattgcagccctgagtctacagtatgccttgatgaccagagtgtaggtgaattttggctcctacttaactccctcctgtagttatatcctgaacaagcatacgcagaaacactgcagccagctaaaaataggcagaactgagattcaaacccaggcctggcgtggatctagtttttcatcatgtagatgctccatcacccactcagacaccactccccctctttttttttaatccagttcaagaatcaacccaatccaaggctgctcaattaacgctcagtgcagtatcctcaagcaggcaaacgctcagaacgtagacggatccctctagatcatactcctcccacctcctggggctgtggccacttcatcacagtctcagaaaaaactctgggctcacagaaggtaactctgcaccatgagacaatttgtcgaatccttgcagccggtaccgcatgtggccaaatctccccaccccaatcaggcagccacttcacacagtgacctttcctgatctgcactgtcaggctgcaatttagccattctgaggactctgttggaggctgcttcagccaaaagcttgcctctggggagccctcccagggccctggactccgttcagatgtcactttgcattaagggcccactgtgtggggctcctggagaggaagaaagcaaatctctgctgaatgtccctaagacagaagtcaagtgaggagcaggggaggcaaaagaaagacagacagacagacgctgggcatctaaagaaggggtggaggactggtagttccaactggcagcagaaataataataccaggagcttaacatttaccaatcacttaggaaaaaagattaatactaagtgagagtttaagatgtgccaggaactctattaggcataatttttctttttttttttttgagacagggtctggctctgttggccagctggagtgcagcagcataatcgtagctcactgccacctcaagtgaggctcaagtgatctcccacctcagcctcccgagtaaatgagactacaggcatacaccaccagctaatttatttatttatttgtagtagaagatgaggtcctactatgttgcccaggctggtctcaaactcctgagctcaagccatcctcccgcttcggcctcctaaactgctgggattacaggtgtgagccactgggccccacctagacataattcttcaggtgggggccggtaacagttactcctcccttctccaatataaaaatagtgcagtgtccaagcagagaggctacaagataaatcaattgccagcaaaacccttggtgtataacttagctatacagtttcactcatggcaagagtaacggcagctgggatttcttacttacctcctacctgtcagggattgtgtgtgattcttttgttcttcttggggcttgtcttattatgcttattgtagaccgactgtactgatggtcccaagcaatggcctgctgtatgcttgcccttggcaatgtgccctgctgcttctcccaagaggttgagatgacttgtccataccttgaatatgggcaggtcatgcgacctgctttggccaaaagaaggtagcagaggtgaccctaagtttggcttctctgtcttggaaccctgtcactgccatttgctctctactggaggatgagagaccacgtggaggcgagtccaaatgactttcctctcagttgagataatcctagaccagcttagaggcagccaatctccagacatgacagcccaactgagatcaggagaaccaccactgagaccagaagaaccatctagctcacccaaagactcttgaacagtaacaaataaaaatttcttaccgttttaccccactgagtgttgaggtgatttgttaaaacatcccaagaatacaataaatagatttttttaaaaaacctgagcctcagagacataaagtcacttgtctaaggcaacccagctgataagagatggagctgggattctacaccattgtaagttttcatccacgatgatctatacctagggtcaagaaatcattttctgtaaaggactggctaataaatattttaggccttgtaagccatacagtctctgcctcaacctctcaaccctgccattgtagagtgaaaccagtcatagggcgtatgtaaatgaatggtgtgctgtgttccaataaaactttatttctaaaaacaggtggagggccagatttggcctgtgaatggcagtttgctacctcctgctctaggttgcttctctgtatcatcaccatttgtgccagcttttttcccctttctctgtctgtcgcctccctctttccctcctctagaatttccacataaaatcccgcaattgtcttctgccatgtttatgttctaccctgagacatgtgacaagtacctctcaactcaaggggctttgtttccccagcgtaagtgtgtctcaactccctgatttcataaatctatgtcatttccagaaatcagtttgactgatgtgttttcccaatgttaggatgatatctttctggattccctaggtatgggaatttaaaaagttctgattgcattccaaatccaagacccaacatcatcagggtgacagttgagaatgcaaatgactcctattcagaatattaaaaacaaaagcttcagttctgtacctaggaaaatttgactggctccaaaaaaaagtttgcaaaaaaccaaaatgaaaacaaaacaaacgcaaacatgcaaacaaaacaaaaccccaaacccagagtgatgcagaggaaagtctaagagctgtttcatgatcccacacaccccgtctctggggcaacctctctgtaagaagcaagaaaggaagatgacgatgactttctgcagagaacaaaaatttggcttgaagcaaatgaaatcccagtgattttccattttaaggatatctatctcatccaaaaaataaaatgttataatagatttcattttttccatctctttcttgttctttttgcctcttagctgtcctacttagaatatcgaaccgtgttggcaatcaaagtagactctgaacttggctactttctcctcagttaaaagaaaaagaaaaagaggtagacttgagtgtttagcaaagcagctcatccagtttagaggctgaaagccacatcttcaaaatttcaaccaaggaaagttagggttagtgtcaaactttccataatttttaacaactttctaagtaaaactagagatgtctatctggactgactttaattttaaaagtctaaagcaccaaaggcagcggaaggtccatctcatgtttcattacggttaaattctatttccaagaaccaccaacctcagtcccgggacctggcatggatgaagctatttctggaggctgccatgactcttggagccaagaacaaagtggaaggagacgccttacaggcaggggccttcaaccgcatggaagtaccagcagatcctgtgttcagaatcccctactgtactcttagctccccaaactgttgaatcgacccaaggaggtgtcaaagcctaccatggagcatgcacttgtaaatgtctgcaaatgacatgggctttctctgtgttagatgtggaataatcactactaacataattatctccattataaagatgaagagactgaggccaaagtccaaggcccacagctagtgaagggcagagctgagattcacagccagctcatctgacttcagggcctatctgaaacatgacaaaataactgacttggtaaatgatcctattaatttgggtgatcagatagaggtggttacaatgtcctggggtggatcaacaccctggctctgccaccaaatcctgatcctcctcaggccacctgacaattgtcttattttattcatttatttatttttgagacacggtctctgtcacccaggctggagtgcaatggcgcaatcatatctcactgcatcctcagcctcccaggctcaagggatcctcccacttcagccttctgagtagcaaggactgcaggtgcacaccaccacacctggttaacttttttttggcagcgactgggttaatatatgatttagtgggcaccaccacacccagctaactggctatttatgacttttttgtagagaagaggttttgccatgttgccacagggctggtcttgaactcctggacccaagcgatcttcctgctttggcctctcaaactgctgggtgtgggtgtgagccattgtgcctggcctaattgtctcattttaaaagaactttcattcaatgagcagcatatgtaagatgtgggacctgtgaggttggcaggctgaggttatttcccattacacagatgtcgaaactgaggcccaggggtcctgcccactgttacccacctggtagtggcacagtcaagtatgaacaacagatcctgtgtgtccagcccagaaccaatagaggggtttggatttgggtggggtggaacacacccacctcaattttcccagcctctgtctgttctaaggccagaaatcctctgaggcccctgagctgtgttttcctaaagctctgaaggtcaaatacggtgctgaggacctcacacttagaatgtgctgagaaggggtacaggaatgaaagctgctggcttaagtgaaagacatatacaaaaagacctggaaattgtattttatcgcaatagctatttattcctgctgttcggtgttacaaaaatgccatgttccaaaaaggcttaaacaaaagacactgttccactgaccaaaaattaaacagataaaacacagtgtggggacgaggtgtggtaaggaaaggaatgaagagaaaagaatatgataggatggccaggcacggtagctgacacctgtaatcctagcacttagggaggccgagacctgtggatctcttgaccccaggagttcaagaccagcctgggcaacatggcaaaacatcgtctctacaaaaaaacccataaataattagccagctagccgggcatggtggtgcccactaaaccatacacacacacacacacacacacacatatacacatatatatctgtgtgtgtctatatatatgttttttgaaaggttctaaatattatatatattatatatacatgatgggaaattcaatttgccaccagaagcatttaaaataataccataggttttatgagagatatgacctctgtctctgagcttatgagacatgtgagagatatgaattgtctttgagcttcctagcaggcaatgcaaagagggaaacacaattagttatttgaatctgtgtcacagacgagattcctcacttcacaaaaaaaactctcccatctctatttttttcgtgttattatctcttgattgtgttctgtttctcacatatcagttccatctctgtatttgctgagctgatctgtgtatccaaaatgacctgctgtgcagggctcttcacaatagcccctgaaattcagagaggctggctgatgtggatccctgtacagctctggtatagtcaagtgtttatttactgagcgtcacctgaacagactggcgatgaaggagaagtttaaaaccactttggtaggagacgatgccaccagaatagcaatgggaaatgaagcagagaaatccctggcattaaagttgaagtgaatgagaaaagcacatttgtgttgacatcatccctgttggcccacacatggtctttcagaaacactttcctgcacaaagtggggcacatgggaatacagaggccacttcctcacatctctccacactttgcccagtcccacggtcagggatgagacgttcatccacttcatctcagccctgagcactaagggggccacagtgggcagggtcactgtgtgggagcctcaggaaccaggactctggcacatgctgggcagctccatgcaatggaattgtaagctgagttgggctccctgcaggcatgggagcatttcagagccaaaattcccacctgcagctacaagcaaagagagtggaggtcctactttagctaacccgtaaagcgggcacttccaagaagacttttactggaactctgtgctagaagattgggaagttgattctctgtcggctacccccactgctgcctaggggtcctggaaggttgggaggggaggagaggtgactgcaggacagggtatcatggcatccccgagtttacctccaccaaacacacccaaaacctctgtttaacacccaacaactagtatttaattttcattccgctgacctgggagcatctctctaatggaacttccacttagcatagccactgaagttccccagggacagtggtaccaattaaataacgtgacactttggaggtgtaaagctatgtatttactcccaaaccagaggcttgggtagtttttaacataaagattttctccctccttttttttttttttttttttttttttgagactgagtctccttctgtagtgcagcggcacaatcctggctcactgtaacctctgcctcttggcttcaagtgattctcctgtctcagcctcctgagtagctgggattataggcacccatcaccacacccagctaattgtttgtaattttggtagcgacaaggtcttaccacgttgcccaagctggtcttgaactcctgagctcaagtgatcctccctcctcggatgcccaaagtgctggggttacaggcgtgagccaccacgcccggccagaatctctctcttaagagtcaccactagtgcccaatgtttactgttcagaaaggtcattgcccagcagttgcaggcaagaaaccctggacgcatcttggggaaatgcatctaaacaatgcagagcagaagacaggaggggttcatgctctgagtacaggctctggggtcagagaagaatgggtccagatcccagctccatggctgtgcaatcttgaacaagttgcttaaccactctgggcctcactgtcctcacctgtaaaataaggtgttcctgaggcattaggaatgccctgggcgactgtgctgagaatgcaggagcagttacaaggctaagcaactgttcctctgaaggggtcccctgctcagcagagcctcaaaatttggtcctgtctctgcttagggctttctgacaaagcagagtggggaagggaaagggaggtttctggaaaagccagtggccaacttctgggtaccgcggacaggtggcaacacctgtccaaggaccaggcatctctcaggctgtttctaggctgctccacatgagggagaaatgatgggctttgctggccagcccaacaccgtcagagggcatgttactgctcgaaagtacaaaataagcagagtgcgcataactaaacactatttttatcgtctttccgccactctcatgccacaagcaagagctgctgtgtaagggagggtggcagggagatgtttattcagagcatggggtggcctgaataccaatggggccagttgagaggctgtgttgtaagggcttttaggggacagcacccaggagaatcgcagccaccctcaaggctgacctaggagacaaaattgccttcctccccaaactcagccctgcaccctgctgccctgggtgaggaccttatctttcccccacctaggaatctgcaagggtatctttcccttagcatcaggaacaaaacttaccctccagctctgggcaagaaggatctgaaaatgacagttctagggtcgtttggggcaggtacaagcacccttattcctggtgtccagacagtgcatggtgtaggtatacagcaggtactagatgacaattccataaaagaagtaacatccaagggcttgggaggcatctacgaagaatggcaacaaaacccttgccttcacagaactttattctagcacagggacacagaaagatgacagatataacaaatagtgcacagaatagggtagaagagagaagtcagtggttaggatgatgcaatgggtgcatttcttaataaggtggtcaaggcaggctttagactgaaaaggtgaggtataagcaaagactcccagtgggtaagtgagcatgctgcttggctaactgggaaaaagcatttcggggacagggaaactgctgtgcaaaggccctgaggtgacagcaagcctcacgttgctggtggagaccagcaaagaagccagggtggaggaagtaaaagatgaaaaacagaagcttaggtcaggaagaaatgggggatagatcaataaagcattatagagccaggtttttgttttgttttgttttgttttgttttgttttgtttttggagacagattcttgccctgtcacacaggctggagtgcagtggtacgatctcggctcactgcaacctccatctcccaggttcaagcaattctcccacctcagcttccagagtagccgggattacaggtgtgtgctgccatgcccagacaatttttgtatttttagtagagatggggtttcaccaggttggccgggctggtctcgaactcctgacctcaggtgatctgaccactttgacctcccaaagtcctgggattataggcgtgagccaccacacccgacccaagagctatagttcttaactgggtcaacttgacccacaggggacatcttgccatgtctggagacatttttgttgtcacacttggggaaggggaatgctaccagcaactagtgggtagagtccagagatgctgcttaatatcctgtaatgcacaggacgaccctccacaactaagaatgatctggccccacatgtcaacaagttcaaatctagaccactgtaaggcctctggcttttgctctgaatgagctgggattatttggtgaatgaatgaaccccctctgtgcttgcactgatgataacacagactgtaaatctggaggtgtttcatcttcctccaaaccatttctcgcattcatagagtaaggaagaaagaaaagacaccttttttttttttttctccctgcgccaaaagcacacagtggaactcctggttttgaaatgtcctattttatgtgggacctaaaaggatgccaactgtcttctggcctagtgacaacaaaagtgacttcttggaaagctgcggtaacatggaggtggctagggagcagtccaagggaacaaaacaaaacaaaacaaaacaaacctaaaccaaaccatgtttagcaaggcctggggggtgttggggtaccacaggaggcaggctcagcgcgtttatccccatgtaaagattgcagagatggggctggggcttcgcgggtgatttttttagtgctttcacctctaatctccaaatcctagccctgctccttccagaaacctacagccttgcctaaattttgtgtgggtgattaaagcagaggacccgattccctgttcctgcctctctgtttgtgaataatcaaaggctaatcagccaaggccccaggggacaggaaattagacgtgcaagataccagagaggctctgagaataaaactgcgaggtgaatctgacatcaatgccagcaggggtgtctgggctctgatgggcaggagcgcagagcccggggccaactggggacaaatccgatttctccagggctcagctgacctctggcttacaccaaagacagagaaggacaggctgcaagaatctggcttttctccatcagctcagggatcagtcaaatcaaagcattaagaatccagggtgaactctgatattagcgagggcaaaggggatgttctccagactgacacaaaccaccggggttcaaatccccgctcctccacttcctggctgtgttacagtctaaggtctttgagtctcaatttccttatctgtaaaatggaatcaaatacaaataatcaggaatgactttccgagtttcttttggtagaagagtggaaatgaatggagaggaggaagcagaagtactatttagtgactcttgtgagctagacattgtgctcaatgctttagatttatgtttatcgaattctcctaacaactcaatgcagtattggatattccattttcatatgaaaatgctgaggtctcaaaggataaagcacttgcttgagtcagggaaatgaatcccctttccatctgcctccaaatccatgttttattagtaacaccacccaacacagagcactttgaacttctcatgtgtactgccatgctgggtccttataatatatatcagcacgggtgcagtggctcacgcctataatcccagcactccaggaagccaaggcaggaggatcacttgaggccaggagttcgagaacagcctgggcaacaaagtgagacccgcccccaccgacggtgtctctaggaaaagtaaaaaacttagctgggtatcatggagaacgcctgtaatcccagcactctaggaagccaaggcaagatcacttgaggccagcggttcaagaccagcctggagaacaagtgaggaccccatctctaaagaaaatgaaaaaaaaaaaaaaacttagcttggtatgggggcccatgcctatagtcctcactactcaggaggctgaggtgggaggatcacttgagcctaggaggtcgaggctgcagtgagccatgatcatgccactgtgctccaacctaggccacagagtgagaccttgtctctataaaacaaaacaaaaggccgggcgcggtggctcacgcctgtaatcccaccactttgggaggtcgaggcgggcagatcatgaggtcaggagatcgagaccatcctggctaacacggtgaaaccccgcctctactaaaaatacaaaacattagccgggcgtggtggtgtgtgcctgtagtcccagctactcgggaggctgaggcaggagaatggcgtgaacccgggaggtggagcttgcagtgagccgagatcgcgccactgcactccagcctgggcgacgagcgagactccgtctcaaaaaaaaaaaaaaaattattcctgccgagggagccagtgttaagagctatcacggctccattctacagatgaggaaactggagcacatcctgtaaggtctcacttgccaaaatttttgtctccaagagaaaaccagaccctcccttacaaaacaagtcaaaatgagtgtaaaatcggttccgtcaggtgacagccatgaggagacggatggtgtcacatctagtgggggcgagggaatgggctggaggtatagtgtgtccagttgcaggaccaaaaaaccttggcccataactaacgttccctgcacagccaccccatgccacacgcagagcccaggagatctcatctcatcttcacagcacgcctggtggcgagtgccctcactgttcccattttacagatgaggaagatgaggctcaaggagctgacgtcatttataccacactgctattgagtggaggactgcagagttgaaccgggttgcttagcacctttcctgctgctctgaggtcccttaaagtctctgtgaagcgtaaggatgggaggtgggagtcctgaaaaactggtctacctgctgctgtgcgagattgagttgggacagtcagctctcccctctctggcctcagtcttcacccggcagggaaggggctccactgaaggtccttcagctctgacctcctgtgctgctcttcatagaccgtcagctgctgcttcctaatgcaaatgctgtcacttgcctcagggcctttgcacttgctgttctccaggccaggaaaaatatccgtctggatatcctcatggttcactcctcaagcaacttgtcagaggacacgccctatgagagccaccaccccctgccccataggcattccccattcctctaattatgttgctcctcaggccacgtatcactctctgggctattaaagattataattataatctacaatgtctattattaatatgtataatatatatttgcttattgtctgaatatattctatttatatataatattatgtatttgcctattgtctaaatcttccaactagaacgcaagctacttttttatgtcccttcagtatgcacaaaccctggcacatgacaggcattgggtaaatatttgtggaatgaatgcctggatgcattaaatccatttctgggcacctactgcacttaaggcagacgggaaatgcacgtggttaacccaccaccaccagagcatccagctccatgcctttatcaacctggccaccatgtttcatcagcaaatgtgaattgggggaaataacagaatgaagagggggtggcagtaagccccagcaggcttcaggaccagataaaggaggccaaaagattccatttgcacaaaataccatgcagccctctccatcccgttaacccgctcttcctcaaggaacttccagaacaaactattgccaaacaccattgagtttaattactcagatgatattaatagtgcagccagctttaattacagacgacgctgctgcacaggggctaaagacaccctctgaattgctagcgtcccttccacctcgcttctctagctgaggtcgccatatgtgggagttgatttagccttgactctgccatagagacttaccagcaagctttaggagaagagaggctttttgtcccctgcagaattgaatgggggccactcatgctagatttccctaactgccagaacatagctcttatataatgaaggcccaggaaggtctgcagaatgagactggttcgagttcttagagaaaagtttcagaaagacgagggacacaggaaggattctgcttttcccccatcctggtggacatgaaggacccaggataagctatgatgctgctttattaacgaccctttttcaaagcactgaccccggcagcaggaatggaatctggccgcctaggctttctgttaatgagatgagaactgaagttcaaaaataaactgtgggaagcctggtagggaaataccagatgacaagaggataatctggtgaccaaaggcataaaaggtggcgggggtggggagcccacagctaaatcaataaccaggtcgggaggaatttgggggtcaaaagagtggcttagctgttaagaacatggtgaaaactgaccttggatggctccgtaagaatcttagctttgtggagatatttttgtgcctctgacaaaatgctatcttttaagaagtgtgcacagacttcatttctaggcatgtaaccttcacatttaacttgcatttaagcaaaatgatatgcgtgtagggaggattgctatggcgagtttttaattgccaaagactagaaaccacttcagcctcagcagttgtggtatggttaaataaaccatgctatgtgaatgcaaatgcaaaataatgcagctatttctttctttcattctttcttttttttttttttttttttttgagatggagtcttgttctgttacccagtctggagtgcagcggcacgatctcggctcactgaaactgctgcctcctgggttcaagtgattctcctgccttagcctcccgagtggctggggttacaggcacctgccaccatacctggctaattttcatgtttttagtagtgacggggtttcatcaccaccttggccacgctggtctggaactcctgggctcagatgactgcccaccttagcctcccaaagtgctggagttacagatgtgaaccaccgcgcccagcctaatgcagctattaaaaagaatgggggccatgatatatatactgaaccagaacaatcgatgagctagataggtaagcgacaaaagcaagacacaaaataacacgtacagtttgctgctataagttagactgtgctttaagcaccgtctagagcaatccataagacaattcagatcctttctcattagctgtgcaactctgggtatgttactttacctctctgggcctccgttcctttctctctcaactagagctttaataggagttagtttgtatatctaaagcacatattctcaatagggatgactgtcacccccaccaagcaagcaaaatttgggggagtatatgtgtgtgagaaaaaaaaaatcttaggctgggcacagtggctcatacttataatcccagcacttcgggaggctgaggcgggtggattagttgaggttgggagtttgagaccagcctggccaacatggtgaaactctgtctctactacaaatataaaattagccaggcatggtggcgggcgcctataatcccagctactcaggaagctgaggcacgaaaatcccttgaactcaggaggcagtggttgcactgagccaagattgcaccactgtactccagcctgggcaacacaacacaactctgtctcaaaataataataatagtcttagatattgcaatggtcagccgtcccccaaagctcaaccctatctgataaaatcttttcccacagtatttaatttctctcacaagggagaatttatattaaattaaatttttcttcttgggagggtgataatgaaagaaagtaatgcttgagtaatactgagctaaagtactcagaacagcgtgaagcagatggggtgacatttaccttgcaatgtcgctgccaagtttaaatacaataatagatgcaaaggccacagtgcgaaggcgtttcatcagactccaccgcaacaacaggtggcgaatgctaatatcaactctcacttcttagatgaagactcggaggtttacaaaagtggaaagactaggccagaggtcagcatctgagctggaattttcacctggtctctctctcagactaagagcttcctctttatgctccagtggtgcttggagaccacatggtctgtttgttctggtagcttccctaaaatacatgtcagggctcggcacagtggctcatgcctgtaatctcagcactttgggaggccaaggtgggcggatcatttgaggtcagaagttcaagaccaatctggccaacatggtgaaaccccatctctactaaaaatgcaaaaattagccaggcgtggtggcatacaccctagctactcaggaggctaagatgggagaattgcttgaacccaccaggtggatgttgcagtgagccaagattgtgccactgcactccagcctgggtgacagagcaagactcgatctcaaaatactactactactactactactaataataataataataaaaaaatacatgtcgaggtcaacccaggcccaggtaccaggatgtgtccttactctgctgagtatcagcataagatgtcgagtctagaccaggggacaccgtcgtagcagacagccatgaatacctcatcctgtctgctgttagcaagctgcaaagcctgctggtccttcctcttcctcctcttgtgaggccctctggagaaatttccatctgaactgagcactgagaacagatccacctgccatgagcaatggcctgtgtcaattatttggatacagggcagtggaagggacagatttgttttccttgatggcagccagaaagctctttgtcaaatctccagttccccaccatggtgtaggtgttaatacctattccagctccaaggtatgatggtcctatggttgtgtttcctttctttgtctcagttttaatttttgcagtcttattttgtttagtacacccatgcagactgccataaacccttcctgaaagagggatgggtgtaaagagatgaatcaacaaaccacagaacttcaaaaggttccagaaaaaagccaccactggcacaataacgggttactcaatcccccaaggcttttgaggaagactagggaaggaaggggttgaccttgggtctagaatgggtgagggggagagaaaagagaaagcgagagagagctagcaagtgagcacacatgtgaccgtgagcttaatgcaaggggataagctggggtagggttggcagtatgggtagggaaggggagtacatgggaaaggaaaggggaggactggagcttcagtcgtgatggatcttgaaagacagaccactcactgattccttggtttactcattcattcattcaagaactaccatgtgcaaagaattgggctccctgcatgagatacaatgatgtaaaaaataatgacgtggttcctgccctcatggaaatcatatttagttcaggggttggcaaactacagctttaagaccaaatctggcctgcaatcctcttttgcgaaccaaagttttattggtacacaaccactcccgttcatttgcatattatctacagctactgtacagccacgctggcagaactgcttagcggtgacagagcccatgtggccagcaaaggctcagatatttactaatctatctggtcctctacagacagtttgcacacttctgctttagctgctattactgttgctgttgcatattatttgtgagcatataaaaatgtttccaataaacaaagagacatgttgatgcccccgtgagtccccagttttctctgccataaaactggcataagagggccattgtgagggttctaggaaaagctctaagaaataagcccagaacacagacacctacaatccttttacattttcattactaatgatattacaatggctgggagtaagaggaggaatcatttcacgccacatgtctgtctttaaaacacattcagccttttcactctgattctagaaacaggtatgattagttgatcaatgggacctcaatctagacaatccaggcatttgaccacattctcctgatttttcagatgaagattttttttcccatcattttgacatttctggaactgaggcttatcttataaacactgtgtacatatgatttattaatttgtatttgttaagagcaaatgatgtggcagacacacaagatacaggaacaaaatacatatgtgagcaatgcatgtgtgtatatacatgtgcgtgtgtgtgtgtgtgtgtacaggtgcatgcagatatatatgatagttcataagacatcaatttatgctaacgttggaaggtaagaaggcataatttatgcttatgttggaaggtaagaaggcagtaacaccttaaagtctgtcagttggtaataaccatcgtggtgaagggaaaaaaaagtagatcagaggaacagaggagagcagcagtttgcaattttcagagcaatggctgggatagcattcctcccaaaatgacctttgatcaaagaccagaggcaggtgaggagcagatgtgctggaattctggcttcaggcacaggtaagggcaggtgcaaagatgactatctctgtcagtgtgtctttttttccccctccttcctccccaaagctgttgccaacacaatactgtcctccagtcacagaaatgctgtatgtggatggtataagcatgctgcgaaaaaatgctgcagggatttggaccatttggaccgcgcaggggagggtgttaaagtgattgtaacatgttttatttcagctagttcttcaagctcagctcctttgaaatagctgacatgttttcttggccctcaacctgctgtaagcctacgtccaaaagcgtcatatgtcaacaacctggtaaatccacagttaagattttttttttcccacaaaaagtcatgggaaccaaacaggctctgaccaaagttgctggaccagttaaaccactaccagttacttctttgcccacggtgagtaaggctgcttgggaaggtaacctattttctctgaatactctcaaagcattcaagataaatatatctattcatttgtatatcccccaacttggcacagatgaggccttgggtttggatagtaaaatttaacactaccctatgacatttcaatgctaagtttcttggcaaactcaccaagattgcagctgtaggcccagaaagaaagggtgacagcttccagatggcacaggaatgatctggaagtccttgcatgtttatagcaccactcagtgccgcagggtgcccactgtgggccgggggtcatgtttaatttcactaactcctgatgatgagcctgcatcatctccctattgtacaaaggaggcgacagaggttcagcaaagtgctgactgcaaagccatcccagttccccaaatcaggatgcccccttgtcttgaccacccaggacaggatgggagtcattctccaacttagattccagttcatgtgtccaatgtgagcctaagactacagtaactaatctcactactttccctatctagtttccaaaacaaaatgtcctctggataagagcgaacagcagaatggagtttgtgtgtatgtgtgtgcagctttagttttcttaatatttacatataatacagaataccttcttcttcttcttttttttttttttttgagatggagtctcactctgtcacccaggctggagtgcagtggtgcgatctcggctcactgaaacctccgcctcctgggttcaagcgattcttctgcctcagcctcccgagtagctaggattacaggcatgcaccaccacgcccagctaacttttgtatttttagtagagacagggtttcaccatgttggccagggtggtctcgatctcctgacctcatgatccctccaccaccgcctcccaaagtgctgggattatagacgtgaataccttctttcttaacagcattaaacagacgaagtattgctcgactaagcatttgtaactataaggacccggcaaaccccagactctgacttccggagaactttatttccacatgaaaagagcccacacatgttagaaacagtcagtcctgtgttcagattccccttcccctgacaccgccgtggtggggagtccctgtgggggcagtcacttctttcttctaacctgagtctgactcatcctctcactcctctggctaaggacaggaagggacagtaccctctgagaacctgctgagaactgctgtgatgtcccttccctgacccaaacagaaggaggtacccctgaaaaggagacaggattaaaaagccaacccagagagcctctgggtgccaaaggactgccgaagctctttaccctccctctgtatgtggaaatttcagggtaacttaccaagtgctttcttctcttaggagccacagtctgtgtgtactcagattgggagaatgcaaatataagcggttgggagagggaaaaagaacaagagaataggagcgagaacattgggagagagagaacaagagacagataataaatgagaggagaaaaattcgagctacacaccattttcaccctatatactgactttgaagccttaaggtcagccaggcacagtggctcacgcctgtaatcccagcgctctgggaggccgaggcaggcggcgcgcatgtgtatactccaagctactctggaggctgaggcaggagaatggcttgaacccaggaggcaggggctgcagtgagctgagatcacaccactgcactccagcctgggtgacagagtgagactgtcacaaaagatatatatatatatatatattccctctaagtctaagtaagatacaattcctctatacgtgtgtgtttcactttatgcagcagacagacttccaaaaaactggatatgaataaatttcttaaaatctttttatatacatgaaaagtcacaactttaaggtaccccattcatgaggacatgaatcctttggtaagattaaacatccaaattcctagaaatatatccccttgggaattttgagtttcctagtcttgaatgtccttacattcatgaagtcaaaagggtattagaggcatctcttccagccccttcactatgcagaggaagaatctgaggcccagagaggcagggtgacttgcccaaggtcacacagctagagtgagtcagagctgaagcctgaacttgggagtgtagtctctgtagaggtgcacgtactggcggttactcacttgtgctacctgaaataaatggacctgagaatctggtagttatatgagcctgcagttttgtggggtttttgttgttgttgttgttgttgttgagacggagtctcactctactgcccaggctagagtgcaatgacattatctcaggtcactgtaacctccgcctcccgggttcaagcaattctcctgcctcagcctcctgagtagctgggattataggtgtagaccaccacgcccagtaatttttacattttagtagagatgaggtttcaccatgctggtcaggctggtctcgaactcctgacctcgtgatcggcccgcttcggcctcccaaaatgttgggattataggcatgagccaccatgcctggccgagtctgcagttttaatgccttattttctggaagtcaaaactgtattactgaggtgtttctctttttcattacaggagtcatctctattttatttatattttgcagtgaaatgatttaaatcaaatgtgcttgggtgcagaggaaatctgatctgaaagagagtttttatggcagagagagagccagcagatacttatttcctgccttgaagaggccagtaacatcctggtacaaggggattcatcaatacatctttcataagagggcttctctgcacagtgagctggaaaatctttccaatgactctggcccatttgtaactttgcccctgaataaaagaagggattgatcggggcttggaatgcttccatacccagggccttcctgcaccccaggaggcagagtctataaatggaattcaactgggcaattgctcatggagagaaaacccagcaggggtaagcacagcctctaaggagagggcagtgaagggttaaaggtgcaccaccttcctctgctggggtctgcagagggactgatgcctggaagtctctaaaataaagagtctcaaaaatagtcagagagacttgctattgggtattctatggactgcagatccattccccactctccatgatctgcagtgtatgctggtggtgggatataccctcagtgtgtccatcagtcagtcagttggcatttctcaagatctacaatgaaccaaagcagagtgagagagcttgaaggcttcgtaacatggcaaaggggcacggagaattgaaaagtatgtccagttcctgtagacacatcccacaaccccaacctcccaagatggtgccagtaagctttctgttgggtgagagaccaggagacctgagctccaccctggaccctgccacttaagttagcagctcttagggaactgatttctccctttgggcctcaaaagcatgtccaagttgactaagcctgctttaaaagttacttggagaagtgctgagatgattaaataaggacagagtccaacaccaggcacaggacaggccctgaatgaagagattacttcccttctccttagaacctttcctctcctcacccagctccctgtaaggtgaagatacagctctatctacaaagaacggtcacttctctcttcctttctctagggtggtttgggttcaaagacggaaactgtatttgcacccttgcaagctggttcggtccacacttgctttcctacccaaagaccaccacaatccctagcttctttagaacttccttggcatgtgaacttgaacaataccctactcttctccaagacccagtttcagggtaaatgggattagaaaacctaatttagtcagagttgctatgaagattagaaatcaataggtttcccagtacctgacacatggtagatgcccaataaatgaaatttattattttctgcaaggaaaataacatctatctcctctaattgtcatgaggattagaagtaaaatacaaagagcatttagcgcagtgtctggcgcaaaatagcggatactgtatacatcttggttgatggagacaaaagatcaaaagaggaacgtaaacgtgagcaaaagcaaaaaataaaaataaaaaaaaaaggttcaaggaaaaacaaacgtctagcccagagcctagcaatcagagagagctagaaagatatgcgcctaatgcaaagtaggagaggtggaaaggcggctcagagacacgcaagggtctacaacacagtttctcaaccttgacactgctgacattttgggctggatcattccgtcttgggtgagtgctgtcctatgcagtgtaggatgttgagcagcatccttggctctacccactagatgccagtagcatccgtcccccgtagttgtaacaactaaaaaaatgtctctggacattgccaaatgtcccttggggaggcctaattacccccagttgagagttgctagtctaaaatagtgtctgacacaccgtgggtcctcactcagcaaatacttgttgaaagaaggcagggatggaggggagagggatcaacgctgaccaccccatacctgggtagggcaagccctctggcttgcctgggctgcttcagccataatgaacgggtgggagggaggctcttcatggacatgcatcagcttggtttctctgaaacaggagggtgttcctagagtgtactgtctgtgctgtgccttgttaagaggggaaattttccaagaacctatttttccagcgctgcagatttcacgtggatatggccttaaacatccacaaccctgaacctgcatctcattcctctgccttcaaagggattctttggaagcacttcttgtcccaaatggtttaatgcctttattttgcgaatgagccattgcagtcaagaagattaacagggttaagatgtgtgcttgtggttctgggcttagtggtggaaaaatcatgcttcttgcttgtgaacttaaccttttggtggatggtgagaaaggctatgtggggagtgaaataaaatgcataggtcacgggggtaggggccccaggggccaggggtggcagggaagagatgccgtgtgtgctcaaaggcagctcaatttggaggctgggagtgggaacacatcatccctgtaaagatgggatcagattgaaacttctgggacctgatttcaggaatgagctgcaacaaaatgcccgcacacttcttgaacaccttccttttcctccccagctaaaatcctttcctgattcctcagtctcccttgggttcattcacttccctccagccctacttttcccctcttgcttctgggcagtatctttagccattaccaggttttcactcacaccaggacctttgcacatgccacttcctcttgctaaattaatcttcattccatttacacttcttcctttcagcttaaatgtcacttccccggggaaaggctcctgttccctttgggtcaagactcacagtcatacagtctccgtacactgggaatttaatcccatttcacttatcacagtcccactcagtgactggcatctgtccccaccagatagtgatgtggcctgagagcaggaattgcatcttctgctcaataatgtgccctcctcctactcagggtcagtaaacatctgtggaataagtaagtgcataaatggggaaaaggcaggcccggcgcagtggctcatgcctgtaatctcagcactttgggaggccagggcaggtggatcatgaggtcatgagttcaagaccagcctggctaacatggcgaaaccccatctctactaaaaatacaaaaattagccaggcgtggtggcacacacctgaaatcctagctactagggaggctgaggcaggagaatcacttgaacctaggaggcagaggttgcagtgagccgagatcgtgccactgcactctagcctggatgacagagcaagactccatctcaaaaataataataataaaggagagaaggaagagagagctttgttccgagtgtagacaaagagggtttctttcaggggtcatgtcccacagctccattcccagacaccattagaataaaacacagcatggtgtcagagcacggagaaaaaggtgaacttccttctgcctcctttccagctcacacgcatcttgtttccagccccaaacttgatgaagatggggctcccttccttgccttcagcccaggataatcacctgctgcaaatttacccggtgtttaaattgtaacagcaagtcaccaagctcttattgtcacagtagcagaaggggttacatcagagtagaagatgtggaccttggcctcaaggagcccagcagtatcagcactcaggagctggttagaaatgcagactcccaggccccacctcagatgggctgaattagaacctgcatcttaactaggtcctctggttcatgtgagcagcctcgtgggctgctcatgggcttcagtagcctgctcatcagaatcatctggaagatttgttaaactacagattgctagagccctgccttcacccccagtatgtgattccaagagtctgggggtggcaggtgaaggtgcgtttctttccatttcccatgtgatgcagctgctgttggttcaggaccacgcttcgagaacagctgccctactgctcagacccaggcacacagcttagtttccagccagatccatgggactgtgggtgaattccttccttcttcaacaacgttgatgctgatttcatgctgtttgtgcaacttaggcagtaaaaagtttcctttcccccttgtgtgtattagtctgttttcacactgctgataaaggcatgcccgagactgggtaatttattaagaaaaataagtttaatgaactcacagttccaagtggctggggaggccgcacaatcatggtggaaggcaaaaggcacgtcttacatggcagcaggcaaaaggaaaatgagagccaagcaaaaggggtttccccttataaaaccatcagatctcatgagacttattcactacaatgagaacaatataggggaaactgccccgatgattcagttatctcccactgggtccctccatggagggagggaattataggagctacaattcaagatgagatttgggtggggacacaaccaaaccatatcaatgggggtttaagcagaggtctgaggcccagaaaggccttctagaagagtcaaggtgtgagctggaggatgaaaaagagcttgccgacagacaagaggaagaggggcgttctagacacacagcactgcccaagccaaatgaagcaggcgtgaagccaggcacgcccagggggtgactcatctgctgtgcccagagctcaggccaggtaggagggagatccaggggaagggtagggcctggagatcacagaagttctgcctcctgttacctgtaagatccctgctggcatagtactgtgaaggactcaatgaaacatccctgaaatcctcatgatcatcagggctggcattcctgtagcgcttaccatgtatggggtcttgtctcagggccttacccgcattaacatgtttttctttctaacttaaaaaaataataattatagactcacaggaggttgccaagatagcagagttctgcactccctcacccagcttcccccaatggtgacatcttatgtaactgcagtgcaatattaaaaccaggcaattcacatcagtacaatactgttaacgggactgcagattttgtttttgttttcacccattttcaacatactcatgtgtgtatccgtgattctatttactgtttaatcttcacagcaatcctattatcccattttgcagatgggaaaactgaagcacagacagaataaagacagaataaagtgacttgtccaaggagctcgaattcagggaatctagctctaagctactatgcagtgttacttctccggcaagttctggtaactagtgcaaactcgctcatggatcagagatgtttctgagggtactcatatttgaaaaggacttctaggtgtcaaatgtaggttccagacccatcccaaagaaccggatcctcttggaaaagctccccctggccggggctgagcagggaagctgggagagagggcatgtccgcccagggccatggccacagatccccagccttgttggctcctggatagtctctatcccagctcaaaggtgtgcctgtctgcctcatctgctctcaggtttctggtctggtgatgttctcgggactggcctgggctgcctgccaacaccagaactagacaaaaatctgcagttctgagcctcagcccctgcccctggagccctggcaacttcacagaggcctgcttgtgaggccaggaagcaggaagctgggctgctcagccctccgccaacctccaggcccctggctgctggggctggaggagggagagagaaggggacagacaggacatccagtaaagctgtaacaccaccaaaaaaggcctcccacacaagccagccttggcagccagcgacctaccagacaaggcccccctttcctgctgacttttatggagtgttgggctccttggaagggaatgttccctgtgcttagaaatatgtggagatgatctatgcatgtggacagggactgcttagacccatgcacacagcttggtttctagccagatccgtgggactgtgggtgaattctttccttcaacagcattgatgctgctataatgctgtctgtgtaacttaggcaagaaaaggtttcctttcattagaggggaaaacatccaaaccattaaaaaaaaaaaaaagttcataggaatccatgatagcattgggagtggttctgcccagacatggagcgactgtggttaggacccaagaaacagcctcatctgttaacctctccaagactcagtatcctcagctgaaaagtgtggattaggctggaaggatccagcccaaactatgaacctacagggagaatgggaataaggggatataattaaggggcttttatttctattctgtccagagattcaaaatgcagttgcctcagacaggccaggcctcagccatgtgtcaaggtcatcagtgataaatcaatccaccctgggagggtcaggacactggagagggtctgtccagccaaaagaacattagaactcaattgttttaagacactctgcaggccaaaccaaacttgtcgactcactagttactagctttgaattctaaagtcgactcttgtccagaaatcatttcaggagctccaaaatctcaagatcaggagatcctagagaaagattagaagcaacaggccccttgtgtgtggcccttaagttaacacgtcactggctccccagcagggaacctggtgggccctgacttcaggagcctccccaggcccactcatcacccacaaaacagcacccttggggtgctgcagagagggaggaaaagtgcttagtcagcccaccccgctgcacgttgccgagtcagtcatttttttagagccctctagaaaccactagattccaggtcctagaatatgcactacaggcttcccttggagcatgagaagtacctctctgactcccaccaattgctcctccatgaatggcagccatccatccatctgctatccaagagaacgcatactgggtgaaaatgtatgcacaatcagctgagagcaacatgcgaaaccaaattattatctatcccctcccattccaggaaagaaaggcctgtgatgaaagacacagaaacaagaaaaccactacactagtgagagaaaaatcaataatcaaagtgatagaggagaaacttgacaaaccaaagctaacagaataattatgattaacattagatgaggctctgagctccctggtggccaaagcaaaaagggatgctttgtattatataactcatatacaacttgacagctagaagcttagccaaagaaaaagagaaaagttcagtcctggtacgagtttgtcaggcaggtgtgtaggtggcggaggtgataaagtagagaggtgagaggtacccaggtcaaatgcagcctggtgggccaaggtcaggccttggcttatactgaaagaggcatgaggagccacgtggcgggttattcgcagagtcaagacttcatctgactcatgatttaaaagagcagctctgggagctatgctggggatggcccacctggggaaaaggcagaaggagggaggaagatttagagactacagaaaaaagccaggcaagtccttaggagaaaatccattctccttcctaggactgacttacaaagctcagcatgtcctgaacctgcctctccattcaacccaaactcatttctctttccctccctccagctaccctggtctccatctatctcctgccttgtggatgctctttgtcaccttgtgcatttgcacatgttcttccccctactggcatgttcttctccccagcctcatcctttgcatctcagctgaaatgtcagtttcctggagagccatttcccaaacccctatcacaagtagagaattctcgctcccctaactctcaattctagaatcttctgcttctatctcagcactagtcacagcagatcgttattgtaacactgtacctatgtgttggttgttggttttgtcccgtctctctaccaggatgtctattattctaggaagtcaaagataagtctattcccattgcatttcctccagccccatagcataagacttggcacaaagtaggtgcttaataaattatggcgaacaaatggaccccatgaggcagacacagaattagcttcaggttagaaaacggaagctcagagaggctcaggcaacttgcccaaggtcacctggtggtagatctcaagtctgactccaaggctaggccctttgaccctatacccagtttctctgaactcaaattagatgaccttgccctgatcatgcctcggcaagtccctggtaggaggtccttaccactgcattaaaccaagatcttagcgctttgacaaagggccaacgagaacatgaagatgatctgtaaagtccctagaagacgccaggagaagcttaggaaattgcagccgcacctgggtcagatcccaacagagtacaacagcaaaggggcactaggaaatagcccccacctggttggccacactgcctccacctttcaccactcacaacacaaactattctccccgaagcgcacagcttttatctgatcaattttctaggctgtggaaccaaacagtggaatccacaggaaattaagcttattgactcagtctttgaacaccacatggagaagagatatttacacatgtcatcggagccctggggactgtaggttattggcagcatgtatttacagagtttcgcccaacagtggagatggggagaaaaaccaccatgcctccccctccatgcagatttggggaattcagagagatgaaacaagagttaggaccccctgctttttatttatttatttatttatttttgagacagtctctctctgtcgccccggctggagtgctgtggtgtgatctctgctcactgcagcctctacctcctgggctcaagtgattctcccacctcagcctcccaagtagttgggactacaggcacgtgccaccatgcctggatgattttgttaacttttgtagagacaaggtttcactatgttgtccaggttggtcttgaactcctggcctcaagtgatcctcctgcctcagcctcccaaagtgctgggattacaggcgtgagccacagcacccagccaggatccctgctcttgaggctctgttttacttctgcttggctggctcagacagcaggatttggtggtaaagctaattttacacagaccctgttacctgaaagagctcactttgaaaccacaggcagattttttttttttttttgagacggagtctcgctctgtcgcccaggctggagtgcagtggcgcaatctcggctcactgcaggctccgtcacctggggttcacgccattatcctgcctcagcctcccgagtagctgggactacaggcgcccgccacctcgcccggctaattttttgtatttttagtagagacggagtttcaccgtgttagccaggatggtctcgatctcctgacctcgtgatccgcccgcctcggcctcccaaagtgctgggattacaggcgtgagccaccgtgcccggcccccaggcagattttatggagctctcaatgttgcagcaataaactgtgatctgtttccccatctaggtgtttgcctcctgccatttcttcatggttccttgactgtaacttctctttgggtcatttacaattagagaggtgaggcaacctttgacattcttgacggatgccctggaagactggtaaatgaatgcccaaattaaaattaaccacaataaataatggcatcagatgaggcacagtggctcatgcctgtcatctcagcactttgggaggcctaggcgggagggtggtttgagcccaggagttcaagaccagcctgggtaacagagtagtaactcatcactacacaaaatacaaaacttagctgggtatggtagcatgtgtctgtcccaggtacctgggaggctgaggtgggaggatggcttgagcccaggagatcgagtttgcggtgagccataattgcaccactgcactccagcctgggccacggtgggagacgctgtctcaaaaaaaaaaaaaaaaaaaaaaaaaaaaaggcatcaggagctagtatttatggtatgcagtatctctttaccctcacatgttaaatcatgtttccttttgtaatcagaataaaatccaagctccttatcatagcctatgatgtcctacaggatctagctactgcccacctctgtaatgtcccctctcttcctctcactcatcaatatgtttcagccaccacggcgagctcattcctgcctcagggcatttgcacacactattcctctgcctggaatgcttttccctgcatccttgaatatctgtctagtttattcccattgctcaatgctgggatcagttaattacctaccccacaccagtcattacccgtcttgtcaccctgtttaaccattatcacagcaccttttcacttgtttgaagcgttcttatgtatttccttatgtgtttatcatctgtgtcttcttgctaaggtcggtgaagctgagaccttggattttcagatttccagattcccagtatatctaatgcctgacgtgataccaacacatagcggatgctgaataaatactcaaggaagaaatgaaagagagaatgggaactggaccctgggtttacttgatctcactccaaagccggggctcttaaccactgagctacacagcctcatcacaggacactctgctgaatcagcagctcctgttcaaacagctagacttccaaagtcaacaccagcacatggcttttcgggggaggagtacatttcatcacaaggccaagattgtgttttgttttgtaaatcacttcctaagtattaccaaggctcccacaccaatgaatccttcctcctttcctcctgcagggtagaaggtcctggcttggttctccaaccagctaaaggcctgtttcccgcatgcaaagatgatgtttgtgctttagcaaaatgcaacgtcatgcaatcctggggtcagttatgcagatccgaagcactactggaattcagaacctggttccatgaatttgttaactgagtctacagatgtatataatgaacttccagacactcaagacgatgcagagaaaaaccagaaaactatagtgggaaaagcaaggattatgatgacaagaactccatgtggttccatcctgggatctgcttactctttttttttttttttcttcagatgagtctaactctcgcccaggctgaagggcagtggcacgatctcagctccctgcaacctctgcttcctgggttcaagcgattctcctgcctcatcctctcgagtagctgggattacaggcatgtgccaccatgccggggtaatttttgtatttttagtagagacagggtttcaccatgttggcctggctggtctcaaactcctaacctcaggtgatctgcccgcctacgccttccaaagtgctgggattacaagcatgagccaccatgcctggcctctccttattctcttgctgggtgaacttgaatgagctacctccactttttaagcctcagttttcaagtacgtaaaatggaggcaatgactgtgcatttattgggaagggcttactttcaaggccacagaaagaaatacatgaaaaaaaatctatcagaatgcctggaacttataataaatgatcttgaaacatttgttcaatgcctaccatgttcaaggtgcagcacagtaccttgcctgagagattctaagagcatgacaggaagggtcctgtctttattctatttcccaaattccgcatcagaacacataggctgatcaaagaatgggtcagagagtgtgaaacagagaccattcaggaattttttttttttttggaaactaaatctgtgtcacccaggctggagtgcagtggcgcaatcgtggctcactgcaacctctgcctcccggattcaagcgattctcatgactcagcctcccaaataggtaggattacaggcaagcaccaccacgcccagctagtttttgtatttttagtacagtcagtttcaccatattggccaggctggtcttgaactcctggcctcaagtgatcctcccatgtcggcctcccaaagtgctgggattacaggcgtgagcccccacaccccgcccaggaacatctcatatcaagataccaagcctgaatttgaattccagctctgacatttgaggcacccctcaccccatttctgggccttagtttccccactgaatggaaataatggcctatgtcatctggccccttcgtacctctccaccttctcccatccccttttctcagctcccctccccactggaattcctggagtcttcaaccatgctaagcgccaggcagttcgcatgctcttttctttctgcccagaacagcctttcttctggctcttctgggactagctcctcattcaaccctcagtcttccctggccatcctacataacatagcccactccatttgatctgacagcagctccttcttcacttctttattaccactaatcaacatttgtagtgatatatgtattgtttgtttcctgtctctttcttccccagactacggaggttgtaaacattcagaaaaaggaaccgtgcctgttttgattagcagtgtatttccaaaaacctagcacagtgcctgaagcacagcaggtgctcaataaaggcttgatgaggggatgggtgaaagtttggcattccctccaatctatcgcatcaaggccttcatctaacccactatgaagaccctcaaacacaccattcccaatgcttacatccaaaacctctttctgccccacctcctgaggaaatggggcatgagttgtgagtttccttagctgtgtgaccttggaaaagtttcttttttttttttttttgagactgagtcttgctctgtcaccaggctgcagtgcagtggtgcgatatcggctcactgcaacctccgcctcctgggttcaagcgattctcctgcctcagcctcccaagtagctaggactacaggcccccaccaccacacccagctaatttttttgtatttttagtatagacgcggtttcaccatgttggccaggatggtcttgaactcctgacctcgtgatctgcccaccttgccctcccaaagtgctgggattacaggtatgagccaccgcatctggccgaccttggaaaagtttcttaaccactctgtgcctaggttttcttaccacggaaatgaggttaatgataatagttcctgactcatagaattgtttttggcactgcatgagttaacatacataaaggacttcggtaaaatatacgtaaggcacttagcactttttatgccttgtatgtgaataaatgtcatctagggtaggtggagccctgtccctaccattccatgcaggtttccctgagtacctttttttcacacaggtaggttagctcctcatctacaaagtgctcctcaactctgaggcccattggaatcacctagagagctacgaattaccctggagttgtatccatacccacaacatcagactccagtggggcaggctgtacatctgctttttactctccccgggtgattccaacatgaatctgaaattgaaaaccactataaacgcctcatgctcaaaggatctcacaactgcccactgcacactgccctccccaacaaactttactatttttactgtaatagcccacattggacagttcccaaagtactaactagcctttttttttttttttttttttttttttttttttttgaggcagtctcactttgtcatccaggctggagtgcagtggcatgacctcagttcactgcagccttgacttctttggttcaagcaattctcctgcctcagcctctcaagtagctgggattacaggaatgcaccaccacgctctgctactttttgtatttttagtagagatggggtttcaccatgttgggcaggctggtctcgaactcctgacctcaagtgatctccccgtgtcagactcccgaagtgctgggattacaggcatgagccaccacacccagctatctgttctgttctccttagagcagtggttctcaatcgggggcaattttgccctgtaggggacatatggcaatgtccatagacattgtggttccagggatggggtgctattggaatctactcggtagagaccagagatgcttctaaacatcctacagtacctgggaacccctgcacacaaaaaatgacttatccagccccaaatggtatggtggcaaggttggcaaaccctgctgcggagctatcttttctgtgaacttggggaggacagcgcagccttgctaacaatgggaaggaaagaagaagtagtgaagggaacttatcatcactgagtttcaacaccaaacacataccaagcagatgtttcacgaataatgacaatagccactactttctgagcaccaaacaatggcttacaacagaacggaacccctgagttatcttacttaactcacatggcaactctgagttctttgactgtgttttcgcttcatgcataagacagcggggacagcaaggttaggtaactaggccaaagtcacaagacttgtacatgacagatttagattttagcctattctgttaaacttcaaagagaaggctaccccaacagattaatgatgccagctcacacctcctaagcctcacagtacctaccaggcagtgctctgaagacccgacaagtagaaacttaattcattcccatgaactagataatataatcatcatcgtcatcatcatcatctccattttacatcctgggacgctgagacagagtgctgcagtgtcctttgaagaatttcatgcagctgagatagggttttaacaaggggtttagatccagaatctggctcactcccaccatactctcctgcctctaatagagcaatgagcagaaaggatcgaattccagcctgcctcaggacctctgcacatgctgctcctgatgatgtatatgtcttcactctggcctctttgccctgctaactcttttttactcattggatctcagtttatacttccattgtctaggacaccctcctagccctgccaactcactgaccagatgagttatctccgttaaactctctcctagctccccttcatagcatttcacactttaaaagaacccaacacttgtgcaagtgtttggtgaccatcagtctcctcctatagactatagactccatgcagacaggaactgtctctgccttgtgcagtgctgtatctccaggcccctggcatgatgtttggcacaaagggggtgcttgatgaaagcttgtggctgaatgcatgaaacagagaacctaaaggcaaaacagcagctggtgccaatccggtccatttcctcatccccagagagggacagggccatctggcaggtcctagccaaatacctccatggcaggtcagggctgcagagctctccaggcaagctggccatggaggccataaaccaactcctcaaagccatctctgcttcatggtggctggtctttatcattttccaatcaacactggttgagttctaattgattttctatgatatccctctccagaagggagaaaggctctgtttactggggcagtacgtagaggacaggcctattcttcctgctgtatttaatgctgctgctaatcacggagattagactaaaacaattacaacagctaattaaagaacaatgcggtttttggcatcttcgcgcagacggcaccattgggaattcctaactcgggcaaagcagggataattaaaaccccggctccactctccccactccagcagctggatcacgctgattaaactgcaaataaaacacatgaaaccaacactttgtagtctatccaatttcacttaaaagggcttttaactgattcataaacagagaagcggtaaacagcaaattatttaactaaagccagttatttcgtcatcacggttcactttattcccagctccggacttgtacatgtagcccaggggacattaggttgatggggcctgaggaatcactccagagcttactgccacttgctcctgttcactggcaacaggacatcaccagtgtgtagctgctttctctgggttttttctccttttgaaaaaaaaagatcaggtagtgcccaagtccccagatgaatatgcccaggtctgatcagactctgctctcgattctaggtcaagagcagatggcagagacacagaaagttccgaagcgcagataatactaaaagcatcatatgtagctttaaaacatttaacttattcagagctggccaacttcagatctaaaatgcaacccgtatctactaaagtatgaaacagacttgttctcaagctatgggaagacatgtcacaacagctgggtagaaagctcatttgttttagacaggcacactctgagaccccagctcaggtcccatgcacacatgcttcccaactcatcttaacaagcatggtcatggggattgctaattctctctccaccttgccaatccagagacaacaagggaaaaaagtgagaaataaaaagaaaaaggtcaagggaaaaagaaaaggacagaagagaaaagggagaaaatggtaacgctagagacaggctcactgggagcagcaagaagggacagaaaaagaaaaaaataccacaagaaagcagacacagggattttcagagcccagcatgacacatgcggtgaggacctaggagccagcgcctgtccctttgcagtggccaggtatgatggtcacgttccacagcagtgcttctcaaaccagctgtggagaaaggcctttgtatgcccagtctactgcagggtgctaattttgtaaaataaaacaaaaaaagaagcattaaaaataaaagattgacttgcttaggtgccatgccatgtccggttactataaaagctgctgaaagcttgtccttcgtttctgagcgcgtcttcgtgcacacagtgagaaaccctggggatggcactggtccatggaccgacaacgctctgagtagtcctttttgaaaagatcccccacggtcattgggaataaacataatcagattcataggattctatttaatgtgcaccacatgtttttagtgaacaaatgcaggctttcagacacacataaatgtagaaaacaaagaccggaaagacatgcatcaaagattttatttcggaataatgatttcaccgatctttcttctctttttttcaagctttgttataaaatactcatgaaagttatttttaaatgaatattccatttatgaaggcaaagaaagacgatgctttatcataacacgagttatagctatttatatataattatggatgttatttatttataagtatctattatgtggttcaaaaaacgctatgtaactgcatgtagcctcatggaaaaaaaaatatgcagccaatatatatgatgtttgaaaagaatactctgggcgggggtgccgggcacggtggctcatgcctgtaatcccagcactttgggaggctgaggtgggcagattgcctgaggtcaggagttcgagaccagtctggccaacatggtgaaaccctgtctctactaaaaatacaaaaaaattagctgggcataggtggcgtgcgcctgtaatcccagctacttgggaggctaagacaggggaattgcttgaaccagggtggtggaggttgcagtgagccaagatggtgccactgcactctagcctgggcgacagagcgagactctgtctcaaaacaaaaagaatactctgattttagaagatgcttttgcaatttgatcatcaaattgccaatattgacccttttctgaccaatgaaaacagcaatttcatataatttaatctaatattaaatgggatctaaaaggttcccataaatagaggttgaaatcaattatgtagaaaatacacatacacggaaaagaagactggaaaaaaacatacaaaaagctggcatggcgattttattttttccttcttggtcattttccaaatttccaaccgtgggaatatattgccttatgagtgggggaaaaaattccattcaaacatttaattcagagaaattgctagcatttttgagagtcttaccctaatctggctacttactctgtgtctatgtgtactgggagaaagaggataatgagaaatttaaattcataagtattaactgttagatgattattaaattagctcatcatttctaagcatgaactgggcaggaagcatcatgtctatgcaggggaaagcccctatgttcaggagggacctgagatccgtgttccgcttgtctgaatctgccatccattatcctgattgttttcaaacagctttactgaggtataactgacatacaaaaaaaagtgcatgtacttaatgtatgcattttgaagagtctggatacatgcacagactcgtgacaccatcaccacaatcaaggtaacagacatatccgtcacctctaaaagtctcgtgtcccccttttttggtggcaagaacattaacatgagatctactctcaatacatttttaagtatacaatgcagtattgttaactacaggtgctatgctgtccagcagatctccacaacttactcgtcttgcagaactgaaactttataccaattggaaaatgcctccccattttcctctcccccatcccgtggtaaccattcttttatccatcctcctgtgatcttgggcaagtaactccctctttttggcttcagttctcctacctttaaaataaagaattttgaaaggttgacctctaagctccttttgcctttggtattccatgctcttagtccatgatggctggaatagaccccctaagtcatgagacccaaggcaaaataaaaacacaggacctcggcctggcacggtggctcacgcctgtaatcccagcactttcggaggccgaggcgggcggatcacaaggtcaggagatcgagaccatcctggctgaaacggtgaaaccccttatctattaaaaaatacaaaaaaattagccgggcgtggtggcaggcacctgtagtcccagctacttgggagactgaggcaggagaatggcgtgaaccggggaggcggagcttgcagtgagccgagatcgcgccactgcactccagcctgggtgacagagtgagactccatctcaaaaacaaaaaaaaacaaaaaaaacaaaaacacaacaaaaaaaacacacaggacctcttatgcaaaattaattaagaatcttaggatgctgacaacagaaattcaaacaagtgcagagccatggagctgtgtgtgactgcacaggccgcatgtccatgaagccgaccctgctgatggcagaaggccaaggacaaacaccaccaaccaaaataaaaaattctcagttatacaatagacaagttctgaggagctaatggacagcacgggtggggaatgatgtgttcattcatttgtgtaatgtcatcatcacacaatgtatgtgtatatcaaatcatcacaccttgaacacattgaatacattcaacctttatattccaactaaacgttttaaattattttttaaaaagtgtttgagaggccaagcatgtatatttaagaattattcacaaagtagataaaacacctgtcaacaaaaacagccatactcgggttgaatgattaaaaacgagcaacaacttccttttcttttcttttttctttttttttttttttttttgagatagagtctcgctctgtttcccaggctggagtgcagtggcgccatcttggctcactgcaagctccgccccccgggttcacgccattctcttgcctcagcctctggagtagctgggactacaggcacccaccaccatgcccggctaattttttgtatttttagtagagacggagtttcaccgtgttagccaggatggtctcaatctcctgacctcgtgatcccgccccccccccccccccccccccgcctcggcctcccaaagtgctgggattacaggtgtgagccaccacgcctggccaacaactgccttttcataattgatcacaatcagcttctattttataactacgtcttggaataggccattatgcttggatttcacaggcaagtctgcattttcctcgtcttaaattccatcgcggtgagccaaactcagtcaaccttttctgtgctaacatctgtgatcaagattaaagtaactaacagccagctctggctcttgaagcataactggaggataagatcaggtatttgcaaagtgtgaggctccagccacactcctctgcttcaaggacttgatgttgccttgactatcgttactctgaacactgggaggagaggaccatcatggagggagaaattgagtccacctccctcctttgaattaattgcaggagtaaacaaccacagaccacgtaacctccctttcacagagctcggctgtacagaacagcctagaatagtagggagagacaggtgccccgggtttaccaccagagcctatttttctctgtattcatttctaatgaatgagattatttctagggttgagaagcagggccagctgattgtcacaatcaggcatattaaaagccatgataggccgggtgcagtggctcaaacctgtaatgccagcactttgggaggctgatgtgggcagatcacctgaggtcagcagtttgagaccagcctaagcaacatggcaaaaccccgtctctactaaaaatacaaaaaaattagccaggcatggtggcgcacatctgcaatcccagatactcgggaggctgaggcagaagaatcgcttgagcccaggaggtggaggttgcagtgagctgagattgtgccactgcactccagcttgggtgactgagcaagactccttctcaaaaaaaaaaaaaaaaaaaaaaaaaaaagaaggtgtgataaataacactaggcaagaaatgcaagagcagaaaaaaaattatcaaaaaagaggcagatttttattttttaaagggactccagggtcactgagtgaagagctacagcatttttgatgcccgtgcgcaaccatcagtgcttttagcagaatctaaaacctagtgcttgaaatgatggctggattcttcaaggaaggcttcacacacattcagcgtactctatttgagaaggcaggaaaataaatgggtgatagagtttagaaaaattccttaaaagtaaagcttaactctccagaaatgaggctcccaaagcctccaaaacgctccagatggctgaagttttgctggaggtatgcgtgtgtgcatgttcacattttgtagcatttctatgtactgcttttaaaaatccatccttatcacaggccttcttagaacagtggtttgcaaactttttcagtaaagggtcagacagttaagattttcagtttagcaggccacgtgatctctctcacaacggctcagctctgccgctgtagctcaaaacagacatagacgagtacgtaacaaatgggcgaggctgtgttccaataaaactccacttacaaaaacagatggctggcagcatttagcccatgagccgtagtttatcaagccctgctctgccacaaggaacatgggctctggacagggcaggatctggattcaaattatttcaatccaccactctgtaaccgtgagactcagtttccctcttttaccatggggggatataatacattgctgcgtaactgtaaacatcaattggaaaacatagtagatatttgatacatgttaacgtccttatgccaatagtaaatcttttcatcttgctggttttcttagttctttatctatacgggtcttcatccacatggttcttttcagtcaaaaatggcctttctccaacattatctcattgccccacccttttcccctctcatattccacaaggctggtagacagacatcactaactgctctactgataaggaaataaacactcatggaagtagtactccagccagggtagggaattacgtgctccaaaccagcaacctgtgcctccgggtctgttacttgcacaaacatggacacccgtgagtttgtagacatgcccacttggaaatctacacatggacacagaagaggcagttaaccatcacagggaggggcaccaggcttggatcccaccttggtgacatacagattgtgtatccccaggcaaggtacctgaccacacagtctgggtttcctcatttatgaaatgaggctaaaaatagcataggttccagaagtttctacctcaaaatgttgagcgtctaacacctagcccatagtacatgttccatcaatagctgttgaatgaaccaatgtgatggtgagggttaaatgagaacagtattcatagccccaggatgctcaataaatggtcacagctctgcttagtgacaaatctatatgcaccacatatggaggtagatacacacacacacacacacacacacacacacacagctgtcagctccacatgggcaggagccatatctgacacaaagcacttgctcattacaaaactgtgtgttcatttatgaatatacaacacactcgtgcgtataaacaaataagtgcaaacagctgataaactgggttgggctccccaaggtccttgcaattctctctctacatccactcaacccccagaaggagcagaacaggttgatccagacctcagatgatgaaattctgctggctgtttactggattccagaccaccaccacccatacatatcaaagacccgcatcgtttcactccctgggctgtgactccagggtcccataaggtgacccaggctagaggtgccatagaaaatgtccctgctgggccaggcatggtggctcacacctgtaatcctagcactttgggaggccgaggcaggcagatctcctaaggtcaggagttcgagaccagcctggccaacagggcaaaaccccgtctctactaaaaataaaaaaaaaaaaaattagctggatatggtgatacatgcctgtaattccagctactcgggaggctgaggcaggagaatcgcttgaacccgggaggcggaggtagtaatgagccaagatcgcgccattgcactccagcatgggggacaaagcaagactccctctcggaaaaaaaaaaaagaaaagaaaagaaaatgtccctacttaagatgtagaggagcaaggggcagtgatatcctcaatgcgcatatcaggtggcgtttgagcacctgaggagtttcagggactgctgcccttgaattgctgagatgaggttctacctttgaacaaagatggtccgtgcatttggaaggaaagagctgacagatgttccaccgccctgcacaaagggagggcttatgctcaaccaggtcctggccattcccatgggcagagcaggcagccactgggcactgccagcttttcccaatatctcctccgagtccccacagccccttggctctgtgcacaggcgaggccgcctctaaagccaagaaggcaatgacccaactctggaggagggggagatgactcaagctacagcacacaaggccttctcagggccgccttgaccatgccggcctcaatcccaggcagttgccttcaccacaccaaggtagagtactcggcacttggacagtggcgtcagaacaagggtggaggccatgtcctctcggcatgacatcaactaacagcctggctccttggccctgaaagagaatgagccaatgtctgcctctggccatgcaaaaccaatcctcatttagtctgtggaaacagtacatggaaggccagatgtagcctttggcttgaagaactgagtttgctcaacagacacacgttttccattcaacactctttctgatttggttgcggttgtactgctgttgtttaaaggagggagggattaaaccaccctttttgagaggataaatgtgtggtgggtctgtatatgttgatgacagacagatacacacacacatatggtagatgttaacgagcccattttattgatgggcacactgaggattgaccaggtgaatgacttatctcagattgagtccacagccaggactcaaaccaagatataattccactgtccacttttccccaccacactgtggtataaggcctaaaattaatattatgtgctgccttgacacctggggaaagccaagagcatctcatatggcttgaatgtaagtttccctaactactttgcttcctcaaataaggtcctctagccagacagcctcctttgtctcagcaagaccaggtacagtgcctgcctatccctggagagtgggtttctgttccctgccagcctctgggattatttaaacaagacaatcatatccccttgtgggacacagggattattgcatcttcttgcttctgcatagcctgcctcccatggcccctggatgttcaccctgtccccagatacaaccgtgtggccctgcatggtgcacagcacctgcttccctggggctgactgtacgtgacacataaactgctgtccatctggtctgtccagctttgggtgttatccccatagggtgggaatctacttcaaccatggggtgaagtggaggcgatcaaaacacacaccaggctgggtgtagtggctcatgcctataatcccagcactttggaaggctgaagcgggcagatcacttgaggtcaggagtttgagaccagcctggccagcatggggaaaccctgactctactaaaaatacaaaaattagccgggcgtggtggtgtgctcctgtaatcccagctactcgggaggctgaggcagaagaatcacttggacccgggaagcggaggttgcagtgagccaagatcgtgccactgcgctccagcctgggtgacagagccagagtccatcacacacatacacacacacacacacacacacacacacacacacacacacacacggcttcctgagcaaagtgggactattacaatttccacagaatgatattccaaagtccctctctagaggtcagcttgcaacacacctccccacaggtggacactggtcagttttggaagagacaggagccaaggactctggccttcagataactaaacctcaagttcattcctagactggccatttatagtcatccagtagatactccatcattccattgtcactcttccacctgtctgtccgcaggagctccgaattctgcaacctccgcctttccgtgtgtagctcaagcagaatccagagagggcatgagcagtgggtaacaagggcagagtgtttgcaaacccaggaagaggtgacggcacaggcaattagaggcagaaccctgattaactgagcccaactaaccagaaccatcaattaactcaaatcttttttttttcttccctctcaggagactgaggccaggaattgagaaaatcacaatttaaaatggaaaaaaaactgtgttccgggcttttctctggctcaactctgacccaggtccatttccttcatcctcattcaagacacatgtacaacttcaaattttctagtagctgtgttttttaaaaaagtaaaaagaaattgattaatctatttgatttaaccaaatacatcctaaatattgtcatttcatcatgtgatccatatggaaaaagtatcaaatctaaacaaatatgaaaaagcattaaggagatgttttatattcttttgtttgagctaagtttttcctagagcacagctcagttggaactggctgcatttcaagtgctcagtaaccctgtgtggctggtggctaccatatgggacagcacagatctggagctaaagtgtgaagtgattgtttagaatgatgattctggagggttgctagggtttcaacgtccatgtcacctccaaaattcatgttgaaattaattaattaattaatttaatttattttttttttttttgagatgaagtctcactctgccgcccaggctggagtgcagtggagccatctgggctcactgcaacctctgcctcccgagttcaagcaattctcctgccccggcctcccaagtaactgggattacaggcatgtaccaccatgcctggcccatttttgtatttttagtagagatggggtttcaccatgttggccagactggtctcgaactcctgacttcaagtgatctgcccacctcggcctcccaaagtgctgggattaaaactgtgagccacacgcccggcctcatgttgaaatttaatccccaagggaagagtattaagtggtgggtcctttaggaggtgatcaggccagaagagttccgctatcatgcatggggttagtcccttacaaaaggtatggagagaactaagtaaaccccttttgcccttccatccctttcaccatgtgaggtcacagagttcatcccctacaaataatacagtgacaaggcaccatctcggaagcagagagcaaccctcaccagaccccaaacctgctggcaccttgatcttggacttcccagctttcagaactgtgagcaatacatttctgttgcctgtaacttactcagcagcataaacaacttaggccggggctttaaaacaaattggtcactagtgagtaactgcgtgctaagtgtttcctcccaacagtgcctcatgattgacaaactggtcttgggcttacacgggtctatgacgtcctggagtacagactgccaagtcccttctctacagccagggcctttcttcacaggaaagtgactgcagtaagagccacctgccatgacctccaccccattaattacctctttgtctgatttgcaatatgcaagccttctccataccttccacctaaatgatgaattcacacttcagaccaaaaaaaaaaaggaaattatttgaaaaggccatttttctactaaccacccaggaatgtgtaggtgtagcatttaatagtgcctacaaagtccctccccgaggggaccttgcagtctagcaaggacagtgagaagtacacatttaaaaaaagatctactattatcctggctaacatggtgaaatcccgtctctactaaaaatacaaaaaattagccaggcgtggtggcaggtgcctgtagtcccagctactcgggaggctgaggcaggagaatggcgtgaacctaggaggcggagcttgcagtgagctgagatcgcaccactgcattccagcctgggcgacagagcgagactccatctcaaaaaacaaaaacaaaaaaaagatcaactatttatgggtccaataaaaactagctactgggccaggcgtggtggttcacacctataatcccagcactctaggaggctgaggtgggtggattgcttgaagccaggagttcgaaatgagcctggccaacatggcataaccccatgtctactcaaaaatacaaaaatcagccgggcatggtggcgggtgcctctaatcccagctactcaggaggctgaggcacaagactcaactgaacgcggggacgttgcagtgagctgagattgcgccactgcacccagcctgggcgacagagtgagactctgtctcaaaaaaacaaaaaaacaataacaaacaaaaaaaaaactacctactggccacctggaacaagggttaaccaacatatgaggcagccccttttattggtgagaaaaccgagatcagaaaaatgaatgaattactatccacatgctcccacaggaactgcagaagagcgcagcccagaacacaggaagccttcccattttaaaatcattcatcgagtgtaatcccagcacttcgggaggccaaggcaggcagatcacctgaggtcaggagttcaggaccaccctgaccaacatggagaaaccatatctctactaaaaatacaaaattagcggggcatggtggcgggcgcctgtaatcaatcacagctactcaggagggtgaggcaggagaatcgctttaacccggaaggcagaagttgcagtgagccgagatagcgtcattgcactctagcctgggcaacgagagcaaaactccatctcaaaaaaaaaaaaaaaaatcattcattgagtaacttttccattttttgccctatccatgtaatgtctgttgttttatttatttttcagggctctttaaatcagctcatctatatttttacttcaatggcttaatttaaaagggaaacattactcctaaattagtggaaaaactagtataatttgctataaatggaaggtaactagaaaaataaacagagagctattaatttctataaagtctgtggagttatagcttaaaatcatcttgtgagtcaccagtttgcatgtgacactttggaaaaggctgcaacagagaagttgagacctacgctttgcctggctggctggcaagactttgtaaaggaagaagaggaaaggtgtcccaggtgtgtgcacagcatggagaaacgtgcggaggtggatggagggcagagcgtggaaggcagagaggaaactgatacctacctgattaaatcaccgaagcacattcagttccgtgccatggatttaacatggactaacacactttggaaatactttcaaagcaaggtctgcaacaatagtgtttttgtaactcctagttaacaagaaaaacaacagatccaagcccccacggcggttccccagtgtttcccaatactgtcatctgattctgttttctgtcagggaaataaaatatcccatttcctccatgatggtgagttctgaatgcagctgtccacggtcaggggagatggagaggaaagaagccaaaaagcagcaggcaggcaaaggccagtgagaagatgttgactctggggccccgtccttcactactgtgtggttgcgggtgtgggtatggatgtggatatggatgcgtgtacagatgcaggtgtgggtgtgcatgcatgtgtgtgagagagaaaacctcctcctcctaggctcaccccaggccatcaaagagacacacataccttgcagaaagtcaacttctacactggttggggcaagtccagcccgtccgaatcccacagggaagggccaccatggcttctaccccagccgagctgacatccccaaacacagggactttcgtatgtgtgtccgactggccttgctccctgccagtggctgcctcttcaggggccagaaaccctgatcgtgtcaagcagtcctagaaaaaatgctcacccgctttctcagatgaagtgcagtagggctccctggcctgcacaagccagtgaccatttttttaaaagcccttggaaaagaaaggcatatattctgcaacacaatatttggtggacactatcatagcattttgtaagatcgtatgtaaccccaactgtggctctgaacaaaaaaatattattcagccccagaaaggcatataaatccctacaaagtacagggtgggttttttgggtttttttaagtggttaaattctcacaattttttgcctttgttcagtgcagggagacagtggtctgcaaaggtggtaacactgacttcctgagaatcttttttctttgagacagggtcttactctgtcacccaggctaaagtgcagtggtgcagtcatggctcattgtagcctccacctcctgggttcaagccagcctcccacttcagcctcccaggtagctggaactataagcacatgccaccacacccagctaattttttatagagatgagagggggtctcactgcattgcccaggctggtctcaaactctagggctcaagcgattggccagcctcagcctcccaaagtgctaggattacaggcgtgagccaccatgcccggcctcctgagaacctttaattgaacttgcagcattgcaattcagcccaagctccttgggtgcaggacttcacgttgctaaatccagggaagcctaccttggttacctgggaaaatggtgtgggaggttccttagatctctccctagccacctgctccttaaaaacatcacaagaggttgtgggaccacaaacccttgtctccgagaattccttcttctctccaaacttgccctattcacacattcccgatcttattttttcctgagtcctactttgtctgttccacattttttctttttctttttttttttttttgtgagacagagtcttgctctgtcacccaggctggagcgcagtgacgccatctcggctcactccagcttctgtctccagggttcaagtgattcttctcagcctcccgagtagctgtgattacaggcatgcgccaccacgtccggctaatttttgtatttttagtagaaacggggtttcgccatgttggccaggctggtcttgaactcctgacctcacccacctcggcctcccaaagtgctgggattataggcgtgagccaccgcacccggcccccgttctacattttaatggccctcaaatctgtcccctcctttcctttcccactttccctgtcccagttcaggcctttatcataactcccctgaactgaatgtccccttttctgattccttgcctctaggctcacttctgcaatccattccccacgaagcagccagagtgatcatctcaaactgatcttggaccatgctcttctgctcctcaaacatcttcagtggctccccattacctacacgatacatctgaagctccctgatgtggtctacagtacctgggcctgtgcctgccttatcagtcccatcccctgccaaggcctgctcctctcttttacatctgacactttggaaaaggctgcaacaaaggagaagttgaaacctacgctttgccgggctggctggaaagactttataaaggaagaggagccttgtgctccatgaatattgtatttcttgtgattttctgacaaggctcaatattttcatctctgttctctgtcgggaatggtctttcgtgtccccttatcctggtcattcgtggcctgctcacattcacccttttttttgggacggagtctcgctctgttgcccaggctggagtgcagttagttcaagcaatgctcccgtctcagcttccaaagtagctgggactacaggtgcccaccaccacaactaactaatttttgcatttttagtagagacgggctttcaccatattggtcaggctggtcttaaactcctgacttcaggtgatccacccacttcggcctcccaaagtgctgggattatcattcacccgttaaggtcatgctgtgggcaacagctcctccaggaagccttccaggagtgttctaggttatactgcccactcctacatgatcacagaactgataacactccgcaagggagaaacatcagaaatctatcttacaaaaattcaactataaacagtcaggagggaaaaaagagagagatagatggtgacacaaatcatttaaataatgtggaatcctgtgcaccacttgactctgtgagtatataccctgtgatgaacatcttgctatgatttctctctccatctagcccagagtcatttttctggaatctgtgagtttggggatctatggagagagaattctgggggtcttcgaacttgtacatacccgctgatgaacttgtacatattcataattattttcactaactctaactgaaatttagcatgaccttcaattatgaatataggcaacagactgcagtagtattagcaacacccgagactttgacaccaacagaaattgcagatattttcatgtcacattgctttggtggcagatgtctccaaatattgtttatacttgtcattacttcaaaattagggtagttattagacctgatgccaaatctactttaatgtgttaataaagaagcaaatgtattattactccacagttttctgatttttatatatactttgacggctgtacttcaatataaccactttcctttttaatcctctgcatttttttgcatttgaaaatattcagagaaggggagcataattttgaccagattccgaagggatttacaacacagagaaggtgacactatcctgctgtagacagtgagctcactggtggcagggcaccaggtccttcatcttccaatccccagcacctaaagcagtggttagtatacaataggaatttttaaaaaatgaactgagatattttatctatctatccttttttccctccttccttcttccttccttccctccttccgtcttttctcccttccatctgtgtatccatcatcatccatccatcacctatccatccatccattcatccatcctccatccatcatctatccctccatcatacatccatccatgatgcatccatcaccccttgtccacccatccctctatccatccacccatccctctatccatccacccattcgtccacccatctattatccactcatttatctacccactcacctctctatccatctgcccacccatccacccacccatcctgtatccactcatccctctatccatccgcccatccctccatccaacatatatccatccatctgattcaatctacagttctaacagttgacacctctgcagttggtttcccagatccagttctgcagctcaactggagactccctaagaaggaaaagtgactcactgtggaaagaggtgatactatttccttgtatggccgtgggcatgtcacagaatgtgcctgcagctcagctgtctttcacaggctgaacacagagctctgtctccagctgccaccacatgggctggggccccaagctcaggcagagcgccatgcctgtgttcagatcatttccttacccaggaacattttggttttctgctttcgaggtatcacagaatggttaaatcttaaagaacaatcgccaccattaccaattacacaaactgcacagaatggtagttaagagttctgcgtaggtccaaagaccagctccccactcactctctatatgaccttgggtgactcagttaaccctttcctctctgtgcctcagttttgctatttgaaagagggcataacaaccatacctcacttacacaggtttatggggagattaaagagaatcttccttatgggaagactgagttaatccatgcactgcacttagcacaggggctggcacatagtaaatgctcaacaatttttagccatcattatccatcatttcctccaaggaggcagacaatcagaacattaggacccagaatcctgaaaaatggagctatggaattcacaaataccccatgtaaaaaaatgcttagatccactcatatctaaaattcaaatcaaggcagcaagatactgtttttactcattggtttgtcgaagattataaagatggacaatcaccagtgcctttgaaagaggaaacaggaaaccacgtaaggctttgaccggagatgtgaagaaacctcctcataggacaatataaaatttaaaatgcacacaccctttgagccagtgatgttaaatctagtcacttaccctacagaggtacatacccaatcgagcaaaggtgtatttacaagaatggctaaaggcagcatagtttaaaatagggggaaaaaaaccaatctaaatgtctaccaacaggaaatcagtgaaatagatgatgaaatatttagtgcatttaattaatctttattgaacagctactacatcccagagactgtgacaggtgctgaaaacagaactggacaaaatagaaaagttaaaaataacgacgaagaatgatatgtgctgacaggagatgagtgataagatagagaggaaaagcaagttaccataaaatatgtttcagaaaatacatgtcataaaatatgatgttccatttcaaggaaacaggttcctgccaatatgcacatgaatacactcatgtacacatattaaattggtgcacaaagtaattgcagttcttgccattacttttaaatggcaaaaacttcaataacttgtgcaccgacataatacaagttaaaatgcaaaggaaaaatctggaagtagtagcaaaaaaaaaattaacagcagttatctctgaagaataggtataggaagtgatgtgcttttgaatcatttaattgttttcatcatgtgcttgtattgcattaatcctctgtaggtcccgtatgctctatctcctttcagaacacatccagcatcaaactatttcatttttaatttttgtgtacacggagtaggtataaactacttcttttggctttcactattaacactctggtccaaaccacccctgcatgtcccctaacagattacaacatccttccccctcacccatctccctgttcttgcccttgacccattacagtacattttcagcagggcagccaccaatcccattttccaaggcaaggccatgtcattcctctgtttaaaatcctctgaagacttcccagtgtggagtgaagcaaggacccttctaagtttcccaaggttctaatgatctagcttcacctccaccgcccctctctcccttactcatgctgttctagccacaccaggctctgctggcaaccaacacaccaaccacattctatctcagggcctttgccctggctgctcctgttccttcctctttctgcagagctccaccactcatgcttttgagatctttgctcaaacactgctgcatggaattgtctccaccaaaggaaaagggcaacctatctccaactggccttacctagcccacagtcctcccctgctttgctctcccatgctctcatcgccatctgacatgacatatcaacatgcatttctcggttgggcgtggcggctcatgcctgtaatcccagcactttgggaggccgagacaggcagatcccatgaggttgggagttcgagaccagccgggccaacatggtgaaaccccatctctactaaaagtacaaaaattagttgggcgaggtggcgcgtgcctgtaatcccagctacccaggaggctgaggcaggagaatcgctggaacccgggagacggaggttgcagtgagccgagatcgcaccattgcactccagcctgggcaacagagagagaccctgtctcaaaaaaaaacacatgcgtttctcatttactacctgtatagaatgtgtgctcagaagagtaagaatttctgtcatgttggctgttgtatctccagctcctaaaacagtatccagaacgtagtaggcactcaacacatatttattgaatacactgatcaatattatcacatgataatatgatatgctattgataattgcgatgatgaaaagcaaatccagaaaaaaacttcgagtccctaaagaaaaatgtttataaaaacaaaacataaattttgaaaaaacatgtttccagtcacagctgcccgcagagaacagggtggaacacccaacaagaaagtaacacgtaaacacctcacggccaacatggcacacagcagcctggttgtctcaggcagctgctctgcacacaggaccctttcacagagtccagggagtaaatgccagcaagggttgaacatgttacaacgtcagcccctgaagccacagactattttcgggtgtcaggcaaacccacaatctcctgtgacagccaaactactgcagatctgaaaaccgtctccctgcggtctttcaggggacaggcctccgggattgtgccacgaactcctcttgcttcacggcacccagtgcctgctgcatcaacagcgactcaggcataggtgggcttggggtctccatcccccagatgtgagctggaggccctacatccttttgtgcctcaaggttgtgctggcgttttagttttaaaatgaaaaaaaagaataatttgagacaggatctcgctctatcacccaggctggagtgcagtagcgcaatcacagctcactgcaacctccatctcctggcctcaagtgatcctcccacctcagcctcccgagtagctgggactaaaagcacgggccactacacgcagattatgttttatttttttgtagagatggtcttgttatattgttcgggctagtctcaaactcctggcctcaggcaatccttccaccttggcttcccaaagtgttggcattacaggcatgagccaccatacccagtgtgcttggctttttaaatgagaagaggaatcaagagagcgttcttccgtacctcatcacacccacagtgaaacacttggcacatgctatcttgtttgtaactccaggtcacatgaggtcacttggaagcaaaaaattaaagcccaatgacatttacagggaggcgttcaaccagcagacttcacctaaacgtcaccagctccgtctcattacagtcaacgggtgttgatttttacacattctctgctacccatacttggttaggaccgtggttttcagctcaggggtgcttttgctccccagagatattcggcaatgtccagagacatttgtgagacaactggaggagggagtgtcattaaaatctagtgtgtacatgccagagatgctgctaaacattctacaatgcagagaacagcctcacaacaaagaataatcctgtcccaggccgggtgcctgtaatcccagcactttgggaggccaaggcgggcggatcacgaggtcaggagattgagaccatcctggctaacacggtgaaaccccgtctctactaaaaaatacaaaaaaaaaaaaaaaattagccgggcgtggtggcgggcgcctgtagtcccagctactcaggaggctgaggcaggagaatggcacgaacccgggaggtggagcttgcagtgagccgagatcacgccattgcactccatcctgggtgacagaaggagactccatctcaaaaaaaaaaaaaaaagaataatcctgtcccaaatgtcagtagtgcccagatcaagtgaccccaggttagtcagtccacagggtaaacaaggttgccctggggaagggagtcccttaagcactgtagtgaggctggaggcaaaagaatggggttgataagatctggtacaccttggggcttttgagatgtgtcttcgcagccaactgtctaaggattctttttttttttttgagacaggtctctgtcacccaagctggagtgcagtgtggtgatcttggctcactgcaacctctgccttccggattcaagtgattctcctgcctcagcctcccgagtagctgggactacaagcatgcgccaccacgcttggctaatttttatatttttagtagagacggtgtttcaccatgttggccaggctggtctcaaactcctggcctcaagtgatctgcctgcctcagcctcccaaagttctaggattatacataggcgtgagccactgcgcccggcctaacacaggcaagtccactacctggccatgtctgaacataccccaggccagaaaaggagcttcctcagcctgtgggtggcagaggtgagacccaaggggccagctgttggcccgtttttatttccttagaagatgtctcagcctctgctactctgaccactcgtcatccaggcagttctgggcttcactcatgtggtgacgacacagttcatctctgaactgcacgcaggcaaaaaatgtcccagcttgctcttgagacaagcacctagtttggctgccaaaaacatcctggtatttcaactcgtgctgcttccctctctgtaaagaggaaaccagctacctaaacagaggaggaggaacattccagagaaggcacaaagcaaatccctgcagagaatgccaaagtctttgccctctctgtggcacagggatgcaggaggcagtgcatggaggcacggaggctggagagcctctgctccccaagcctgctacttccacaagagagaaaaggcagggggtgacgcagcttgcattcacaagtgacaagagggtgtctccagcttatcctcttagcagtcctcatggctgctttaactagttgggaagctgaagctcagaagctaaaagcctttctcaaaggtgatgcactgagcaagtgaaagagttgggattcaaacgtaggactatgaaagtaatactaagtgcttaggtgccaggcactgttctgttgcttaatgcacgttaacccatctgatcatcccaacaagtctaggaggtggctactgctgttacttcaaccgtttttatttattattattatttttgagagagagtctcgctctgtcacccatggtggagtacagtggcttgatctcggctcactgcaacctccatttcctgggttcaagtgattctcctgcctcagcctcccgagtagctgggattataggcgtgtgccaccacacgtggctaatttttgtatttttagtaaagacggggtctcgccatgttggtcaggctggtcttgaacacctgaccccaggtgatccacctgccttggcctcccaaagtgctgggattacaggcgtgagccaccgagcccggcctactctgaccattttttaaagaaactgaggcacaaagggatcgctggcgtgtggaaggtctcacagcagctaagtggtgagccagggggtctgctgcatagaccatgacctgcccccacgaggcccgttctcacctccccaaggggctgcttggggttaccaggtccagactgcccttgtccactttgcaggtgagaccctaggaggatccagagtcctgagtgtgcaggggacaggacaaacaatacccaggggactgtcactgaggtgaatgaacgcagcaggccaggtggggacttctatgaaccagtgaccccatcccgaggccccatgcaaaggggcagctggtggtcaccagtcatggacatccagcagctcagagtggttttacctatcagtttttcaaaaatcttccaaccccactcttcccctctctaaaaatttaaaaaatttaaaaatcttcctgaggccaaaggcaacccatgtgcaggtcagagatggccacgaggaggcccatggcacaactttgagtccagggccatgaaatgagaaagtcacctcctgctcccataactggtgcctgattctaactgggccagtgaacgtggagactggtcatctgaccaagaactctctttgagcccgttttatagctggaagttccttcttctagcattgagctggctgggtttttccttctcaggacaataaaactgcatttctgtcctcgaccccacccatctggcacctgcaccacagctaacttcagctttccacccagttctcttttgttcagtggaaaaaatgagctacagttcccagaagaaaatgagaacggggttattattaataagatactctttttcagaaaggcagttgaaggcagcggggaagatcacattgaggggggagccggggtagccccactgctactccctcctgcaggaccacctggtctggagaagcagctacgcgctggccctccctgttggctctcagaggtacaaaccagaggtggcggcatttctaagaaattagattcaaatactaggacagttaacatttcctggaggtgtgaccgagaaccaagaaaaagtgattttgtgaaggccttgcttgcaggcagaaataacctgtcttctctgtctgtctgtctgctctgggggctaccggaaggagctgaaggcctgtcccccgcctctccccaccccaccatgccctaggccttagtccctccccactgaagaatgcctttaccaacttgggacagacagaggagtatgaatgaatgagaatactccaagctgaccctgcctggggcatctcttctcacacatgtggcttctctggtgctttatttagcatgagactgtttagaatgtttatttttggctcagttttgggggacagttttcacaaatagaatgacagctatgatcttctctctaaaaaaagagctcgtacaatccaccgttgggcattcagtttcaagagcttcactgtcccatggtctccattctgggacctctcctccactggaagaccctctcctttaatcaaaacatgacacaagatgacagtgactccccatggcaagtcccattggcagtgctgagccagcgaggcgggggcccggtcagggtccctgaaggaaagagatgttactctccaaactgaagagactgtacaaagagattctttataaggaaaactaacaagggaggtgctatgcaccagggctggccacagccaggagctgtcaccaccctggggcctgaaggggagggagtggtgttcctggaccacggagacagtagctgcagccacgggagagggcagccccacagcagctgtggccttgctaggggtacagacacagccaacccatggaaaccctcatctcatctcttcccaccttcctatctcctaccagttcctctacttggccaaagcaaagaaaagtccttgctgatgaaacccatcaaggttagcctctggaggcccagagaagaaaggagaggggtggagagtggatctggggctggggcttgcgggggaagaagacacccaacatgtttcatcttgctaacacccaacatggagacagcaggaggaggcacaaagagggcgtgcggggctgtggatcttccacgctgagcctccacctcccactatccctgagcagcagaggaatcctggtttgctactgagctgctgaacgactgggcaaattgttcagcagctctgggtcctggtttccttccatgtcaagtataaagatggaacccaacaggccctaaggtatgggagtcacagccagcactgcagaagagggaggcctaagtgtgggccctctcaatgccactcccaaactctgtggtcttggaccagggactgagcctctccatgcctcagtgtcttcacttgcaaaggaagggtgtgagagcaccttcgccaagggatgttgttatgaggaaacgaggtcacgcatataaagtgttgagcaacatcccaggcacatagaaaacatgcaatcacccctccagctctcacgttccccaagtttgggccttgtctacggatttttacatccctcatacacctggacctccctcgtgctgctatcttttgtgaaagcaattttcttcattgaatgattccattaactagaacctgcaaacccagcctgaacattctagcatcgaaaccttctcttttaagctccgcagtatgcacagccctgccccaaaaccccatggagaagatcgcttcagcttcaaagatcttggtgcgtgtgctatttatgccaaatgttagtgatgcctcctcgctgagcctccggctcgtaagtcaatgcaaaaccagccacactgccttgttgctcagtggcagcaccacgggcttctgcctcagtgcttgaagtcaatggcggtgggggtgccctgagagaagatgcgtgtgctggaagggaaatgtgagtatggcctcctcaaggtgccactgctgtgctcaccgtctgcagggcaaaccgtgccacagcctggggcttcagctactcatcctagaatccactctgtatggacagatgtttccaagcccatgtgctctggattgccaagtgagtgatctatagcaagcaagatctaatctatatccacatctaatacatatcaaatctctgtatcaataaatagatatcaaatctctatgtcaattctttgtgtcaaatctgtctagatctaatctctaatctccttctatatcttattgatatctctacctatcttgtaacatagcagggaaggagacagatttcatttgtcacctggctctagtttagattctatcacctactgaccgtacaacttttaaaaggaaacttggtctctctggctttagcaggctcctctgtaaaatggggttaaggttagtaactcccagggttatttcccaatatatgaaagctaaactgctaggttcaaatcttgctgcctttgctacctgttgggcaagtaacttaacctctttgcgcctcagtttctcatctgtaaaacggggatgacagtaatacttcccataagagatagttgtgaaatgcaaatgagcaaatccatgtaaagaacttaatttagaagagggactcgcatgcagtataaatgcttaattcatgttacataaaagtgctaaatttatgaatgcatgtccaatgtacagttcccatctcaatgaaacatctattcagtgtatgtaatcattattgacaagagtgatcttttttttttagacggagtctcgctctgttgcccaggctggagtgcagtggtgcaatctcagctcactgcaagctccgcctcccgggttcacgtcattctcctacctcagcctcccaaatagctgggactacaggcgcccaccaccacacccggctaatttttttgtatttttagtagagacggggtttcactgtgttagccaaaatggtctcaatctcctgacctcgtgatccgcctgcctcggcctcccaaagtggtgggattacaggcgtgagccaccgtgcccagccaagagtgatcattttaagtgttctgagttaagggcttaaattcaaactttcaatgtcttcggtgaagtccactcccaacaagaaggggggaatggtgatctcaacacgatctattttttgaaatggtgcatgtggctgcactttggggaacttgctggctatttgcggaatgttgtatcacatcattcaccctgagtcatacagactagagaagatcccatggccaggagatcgcagatcctctctgagaatgactccatgctccaagtccagactccctgtccattgagccaagtctctgcccaggcagtggtctggctggtcacctccctgccccaccagggctaactagagaggcagcaaatcacagccagaggaaaagattatagtaaagcaatctggtccctccccaaactagccttctctgccccagagaggttcttctcccataaggaggctgacgggggaaaaaaacatatgggctgagaagcaatttagtctcaccatcctctcaacagatgctgggcaccataagaattaatgggctggagactcaggtaagagccattcagaagcttcccgattactccaaaaactgctctctgtggaggaaaaggttaatcgaagcccagagccggaagaacggagaggagacagcaattgtgttaatcccaggagaggggaagagcttcacaagaaagaagtttgcacaaacaagcctgtggtctatccctgaaagaagaaccaggcctaaatatcaagatatttgaaagatcttctccatcagtccagagaccttggcaaacccctctccaaaccccagccaagtagctggattaagaaaaaaaaattttttttttaactctgcacattctttgcactagtaagccataaatctcttaggaaaccatctcctgatgaggtttcttctcccataatgatccaacagaactcagtttttaaacacatgatgtacatgttcctgtgtatcatgggtcattgtgtacccagagtcagtcatgtcaatgcaggtctggacacattagaagataaatgtgtcggccaggcatgtggctcatgcctgtaatcccagcacttttggaggccaagatggatggatcacgaggtcatgagttcgagaacagcctggccgacatggtgaaactccatttctactaaaaatacaaaaattagccaggtgtggtgtcacatgcctgtaatcccagctactcaggagactgaggcaggagaattgctttaacctgggaggcagaggttgcagtgagccaagatcacaccattgcattccagcctgggtgacagagcaagactctgtctcaaaaaaaataaataagtaaataaataagatgaatgtgtcacaaccacagcctacagctggttaaagtctgaacttaaaccagaaagggtgatgtttgaacataaacaagagaacaaacaaggaagttgcaattgtatggctggaagtgtctttgtaaaataaactgtcctcagaacaaacgaagttactccagggtttcctaaccttgccactactgacatttgaggctttttttttgggggggggtgctttcctgtgcattatgggatgtttagtagcatccctgatctctacccactagatgccagtagcatccttcaccccgaagttataataatcacaaatgttgggccaggtacagtggctcatgcctgcaattccagcactttgcgaggctgaggcgggcggactgcttgagcccagaagttcaagaccagtcggggcaacatagcaaaatcccacctctacaaaaattacaaaaattagcatacacctgtagtcccaactacttgggaggctgaggtgggagcccaggaggttgaagctgcagtgaaccgagatggagtcactgcacttccagcctggttgacagagtgacagagcaagactctctcaaaaagaaaaggaaaaagtctcaggtgattgtcagatgtctccttggcggtcaaaattgacctagttgagaactactggtttatacttaagtttaagttcagctgaacatcagtcagctaattagctattagccaaatttcagacatcagcccccagctcagcataacattgctaagatctaaagttcctccagccttccaaatgctcacatcagacattagtttcactggatggccctgaatttaagcctctctccttctctcctacctccttagtccttttctttctcccctgcctgataaagtaattctttattcatcttgacattataatgacacaaaagcactgaaggagcaaatgccttaattgaatctaagaataactggcattatttttataggaacccagacatactacgcaaaaaattcagaactctgtcattgggtctttttgcaaggttaacttttaactgtaagctcctcagcacatctcacctcctgggctcagaagctcaaacctcatctctccagctcagattcccccactacctgggagattttacaaccacctccactctacccagtcactctcttacaaacatgtttgtcttatttccatccacttattactatctgaagttacggatgcatttattaatatctatttgtacctttttcatctgactctcctagaatggatgctttctaggcaaggaaacttctgtttttctctgctgtatctttcacagttagcacaaggccttgtctccacatggcccaatagtgatttacggaataaggaaatagatgaatccctttacatagatacaatttctcaagtattaacttccattcatatcactactcatttgctacaggagccctgttcacaatcatcatggccccagcatcatctttaaatcatgtgaatgtcattcccttccctctaacccaagttagctgatcaaagaaattcaagtatctggttggttttgaaaacccagaagttgggagttttcctcctgatgcctttgatctccaggtcctgagggggatctcagcataaacgaagacctgcttccctctaactctagctgagttcacaaatacccagattgacaaatcttgactcggcaaaagagctcctttattatatctcccaacgtatctcagtgtttgagtggaggccattagctaattgacagagagcctgttgagggtgggggaagtgagggcaggaggaggcagagacactagaattaaatggcaagagaccttgccagttggagtggattcagaaatgatcaactgtcttggggatcgatgagaaagaaagaataaagtaataaggattccaatgtatcaaaacactactgatgcgcagggacatgttttgcttttgttcttttaaaataaattttcattcgggtccattgcttaaaccattttacccccaagccctctgacaaactgtcaaagataactcactgcgcaaagcattgaatctttctatccatctacccatcatgcatctctctacccatatatctaagtacatctgtggatagttgtgctaggcactgtctatctgtccgtctgtctatctatggacgttggattgcatataccaagcccatttctccagctttgcctgaatgttagcaaatctttctactagtcaaggcaactttattttcttgcaaaataggaaagcagttgagaagataagattctgatgtcatgcaaccctgagtctaatgtgcatcaacactatctgcttcctgtgtgaccctgggcaagttacttagcctctctgacccttaggtacctcatgtggaaatcgggtatcacacaaacacctgtgtaaccatggcatttgaggataaaatgagagaagtcagttcttggcaaatggtaaatgttagtaagaatgaggataagaataatgccacctagccactcactgaactccttttttatttttttttcatttctaggtcacctgattcgctggcagtcaccatctggagaccagaggagcattcatcactgcaagtcagggcttccttggtgcctccccaggggcagcctgccgagccgggaagctgacaccagggatttaaaccttcctcggcttcctcattctattaatctggccgttaagcagagagtcctgctgatgccaacagatgcaaagctctgctgtgctaatggtaaagagcattagaggagtcctcagcagccaatcaatccatctcccccaactcagaacagctgcacagggacagattaaccaagcgatggctgaggaccgttgcaattcacacgagggagagagggatgcgtgaaggaaagggcccctgcacagccgtgttctaatgcaggccaggtcttggacaagcaaagcggctgatgcattgtgcaaggacacagctctcagtgaaatctaacaggcaggctaacctgtgacagctgggctcaagatggagcaggcgatgctgtccttagaagccaagtgcactgggagaaaagcgggaactgacccagggctcagggtacatctgtcacctaacctctgcagagttaattcttccaagcttggccacatctgccatcttgttcatggcatatgggtaacatttgaggcactacttcctgccagaaagggacctgacccccttgtctgacctgcctgcaggcagctgaacaggatcccatcattcacctcacaatgggctgaggccagcacaaagtcagatctggccacgggcttgtgccaacagtcacaaagaaacatttgcactttggttgggttccaacatctctttaacatgggaaatcagaactcggggagcgagaacaatattcccaggctccccaaagacagggaaccaaatgagactgatggagcatcgtttgcagacaaattgaagctcttccccaatggcatagcacaaatgctgagagtctaccttgtgccattgctggttgcagatggaggttcaggtcccttgggctaacagattggactttaagagtcgccactgtgtaaggagctgctgctggaagcctcaggtgctggccaaagccactggtctgcaactcctctttcccatgagggttttgaagggctgatggggtggtgtccagagtgaaggatacaggaaggtcaaagacagaaccatccagggattctgctgttccactcccaggagataagatttgacttccagagttccggacacagatgttcgcccatgggttttcataagtttaatagggtatccttctggggaaggataaggaaaagaaggaccatcattttaaaaacacaccgtggaagttctctcatagtccctggggtagactgggtagagacacgtttcccaaagggtagcacacacatctctgataggaagtttaggtgacatcagagggtgcgtacaggaacaatattttcacagtttaatatctattttaatgttgtgcaaaaaaatatataactagcccttcaaacttgtggttccatgaatattattgcttgagacagtgtttctcaatctcaacaccattagtatttagggctggatcattcttttttgagaccgagtctcactctgtcacccaggctggagtgcagtggctcaatcttggctcactgcagcctctacctcctgggtccatgtgattctcctgcctcagcctcccaagtagctgggattacaggcacatactaccatgcctggctatgttttgtattttttttcagtagagatggggtttcaccatgttggccaggctggtctcgaactcctagcctcaagtgatctgcctacctcagccccccaaagtgctgggatacaggcgttagccaccgtgccaggcccaggaccagataattctttccagtggggagctggcctgtgtgttgtaggatatttaacagcaacctgggtctccacctactagatgccagttgtaaaccccccaaccagatgagaccaccaccaaatgtcttcagacgttgccaaataaccactgggaatcaaaaccaccccccggtttagaaccattagattaaggtaagtctatttctgaaagcaaagtgagttatgttaaggaaaaatgtatttttaggtgactttatagaatagatgaaatttacataaggcaaaggtggtcaaggtgataaggacagacaaaaccaagccagaggacagccaaacaggcagaggaaaccgaatccttttcctcctcagagctgcaccttctatacttccctgccggccctggcgcctggtcagccctggggcccccgtggctatacctgtgtgccagagaatgcaaggacagaaaagcacaaggaaactgtgaagatctgctggccttccccatcagggaggaagcaaggaaggtctcctcattcctcttaggagaacccaagcagagatgccaaggagagggcaaggacccaaggtggaggaggcaaaggccaggggagcaggtggtcttttccagtccaccccagaaacccttgaaatcgctgagctgtcattcagccttgaaacgttcgaacaggtttgactgtgtctgacacttgcaagctattcactgtggggctctgaacgaggcctgtcctgtctgcctactctctttactgtcagccaaacccaaagagctaaggaaatgattaatccaaagataagaaacgtccccttcagatccagcaggaaaagtaacagttctattggtttaaaaagctgccacttgccggacgcagtggctcatgcctgtaatcccagcactttgggaggccaaggtgagcggatcacaaggtcaggagatcaagaccatcctggctaacacggtgaaacctcgtctctagaaaaaatattaaaaaattagccgggcgtggcagcgtgcgcctgtagtcccagctgctggggaggctgagacagaagaatggcgtgaacccgggaggcagagcttgcagtaagccgagatcatgccactgcactccagcctgggcaacagagactcggtctcaaaaaaaaaaaaaaaaaaaaaaaaaaacgctaccactcacaagcacttagcacgtaccccggactttataaacatcatttcctgtgaccctcaaccacaactctgcaaggtgggcactatcactgggatgacgtttcagatgcgaagacactggcttagacattatgtggccccatgaacactgcagggctagaagacacagaggtggaattccacctggctctgttgaactccaaggcctatactcatagctgctgcactgtcctagctcccaggaaggcagaaagcagacagtcagggccgtgccctcccttacaagacccgctggtcatcctcctccccacacggaaatgccactgcaatcacaattcctcagaatggcctaacacgcaagcagatgaaagggtgcaacttccttccatatgctgccctcactgccaaggaataaaagtcctccaagttcaggcatcaaagagtagcatcttcccacttcatggctctcctctgtctcctctctcctttgcatgaacctccgcatgatggttgggcaggagcgaaggacagacgaaaactcaaaagaaatgattatggttctcgccacaggtgggaggggcaccagacacctgggtgcgaatgtgcacccatgcacacccacaccattgcacacacgtgtacactatatgccagtgtgtatacatacatgtgcaggcacacacacatccaaatgggaccaggggcagccatgggcctgtccagcctttcagagccacgggacaagtccccttgagagctggaatactaaggctgagataagtggccaagacaggaaagatacttacctgagtctccagggtgatgagcggacttgggtgtggatcctgtaggatgaaaggagaaaatgcacgtgaggagtgaaaaaaagttaacttactaccccagcatctttttctttctttcctttttttttttttttaagagacagggtctcgctttgttgcccaggctggagagcagtggcatgatcatagctcactcactgcagcctcgacctccagggctcaagtgatcctcccacctcagcctcccaagtagctatgactacaggcatgcactatcatgccaggcttttttaaaaaattatttttgtagagatggggtctcgctatgtttcccaggctgttctccaacactttggcctcaatgatcctcccacttcggccacccaacgtgctgggattataagcatgagccaccacgccaagctcccagcatcattttcaaacaaagcttgatttccccagtggtcaagccaccccacggggagggcagcccaacctgtgtcctccattctacagagacatcaggacagcttggcccagtctgcaggccgccccaacacttcctctcacgcacaagtgatgaaagaggctcaagtttttatgaaggaaatgcccacatggagatcacacaaaacaacaaaatgtaaagaaaaaagaaacaaggcacccttgccaaagagctcaacgtgtatccaaaccctctataaggagagtttggctccgtaagaggattaggaataaaccagaaagaatataaagtcctgactaggaacaaggccatcatcaatttgtgtctgatcttggaaagaacaagggaaggaatgagagcgagcagcttaatttctggtttgaggagcacattccatggtctggggaaggtctttttttaggatagagaaggccagagaaatgtcctattcattcactctgtacaaaagccgattgactgggaatgcttggtggtactgtctcgggtcattaagcatgaaccctttgggttggaggagagacagggagggtacaggaggaggaaaagactgatgggaggagttggtggtgtccagtgagtggtttccaaagaaaacaggaaacccagcacatgaaggctatttctgtctataccacgtctgctctgaacttaatcatcttggatttataattctgggaaaaacaacctcaagcttcctctgatagagaatgggcatgattttagggccctgaagtacacatccagtttgaagctttgctttgtcttagcagattttccaccacggggttttaggaagccatgcaaattagcaccagcccattgtcccatactgtgagcaagaaggaaatgcagggaaattggaactttctaaaccccttctctaggtgagctgccattcactgtcttgatgactgttctacggtatctttgtaatgatgcccaattctgaggagtgtaagaggcacgatctcagaaatacggtgagctctgctcagctctgtcctttaggaagaggaattcgtcgtcccccaactccaattctgagtccaactcccagtaattctccattggtgtaactgaaaggaaactgccaagagaacatcccactctaattctcacattcccccaggcattgagtcttcctcatacccaagaaaacatggaggggaatatgttctccccgtctccccacattgcagccttgacctataaaggaatctggggaagtcatgaaggagctgttttgggcctgtctcttcaaatccttactgattccttcccaggggtgaagaagtggcagctaggattggtaaaacccgacattcatagagcaactttcttttgatcaggcaggttttgtatcactcgcatgcagaaagagtctactctgtacttcctgtttccctgtgttggggcaggacccatttttgtctttgggaagcaagaccatcctcctggtctgtgggtggcagcatgagtcagacctggtacgagcttagtgggcgagagcatgcaacatctgctgttcaggtcagagtagtctgtgtctgtctgtctgtccattcagatcttaccacctcgattttgattataagataagaagctgcatctcagcctcaaaattagcctcaatctccaagccaagtgctagcaaagcaccagactggggtgttgggtgcatgcccagattaattaagctgtacttcacagaccatttggctattgtctgagacttaatgcttcattgcttagaatctccaagaggttgaagaggggagaatgccatcctgacccctaaaagcagctccaatggacaagactttccttgggaagtcacaggaaatctctgtcaactgtgttgacaaaatcaaaagcctgatctctagacacagtgaagcatcagctctctatttgatgttccaaaatcagagaccttatcagtgcatggtcagggatccaagattaagaagattctggaaagcaaaagcacaaatgctatctatttagcatcttcattaactaactgggaagaagataaagtcctcacaaggggccacatcattaatacttgggtttcacttgccagcatcattatgctctcctccctctgcacacactggaaatggaagactctccctaaagagcctcagtccagaggattcaaggtatgactatatatctgtgaggtctcgctttcagcaacatcctccttaattggaaaggctaacgaagtggaaccaggtcaatgatgctgtctgcctaatccatcctatctgtctaaattgggactctttggtttacagtagagtaaattcctgtccatcagaggaaagcctcctggagaccaaaggggaatttgcaatgtgcgtgcacgctacagtggagtgcttttagaatcttaatgccggtaccagtaaccatggaaccgcctacaacaaggaaagccctttcctatcatctattgcaatggctcagttggggaagtcaaatggggaaccaggtgcactgaattggtggccctcattcgtcacagctcctagatccatgccctctggtcatgtgactcgacagttctttactgtgtgcttctgcagcccttaagcttgggtttgcccatttgactgctttgcccaatgggaggttagtagatgtggcataagcagaagcttgaaatatgcttaggtgatcaagtgtggcctactgtgtttttgccattgccacaagagatcatgtccccagtaccttgctggtccaaggaggatgccagacacgtgaaacaaacctgtacacaatctacagcgtgcagccacgccccgcctagatcagccgaccccctgccaacacagagaaaatatatgcttgttgtttcaagccactgagttttgaagtcatttgttatacagcattattgtggcagtaactgatatactttctaaacactgacctcgatagatcaaaaagtgttgtcacaaacactcacagactcagaacctaaataatacatgctctttctctaagtctgcaaatgcatcccaggaacctgaaattactacagctaacagcgatcatttatagagggcctcctaggtgccaggccctgtgtgctagctctattattacatcaagcaaggaaataagtgaccatcaggatcttgcatgcctctgaattagccttcaatcctgtgtgcccaatataccagtccttctgaatttattatttagataccaacacaacatgacaggaaatgattactcagaatccttttgcctgaaaatacatacagttttcattcctttggtttattcttaactttgtcctatgggcatattacttgactgaggttctgaacagttgaatactagcaataaatgacatttgttaagttctcactatgttccaggcactgggcttaacttctatgcgtgtatcatttcgtttacccctgtaataaccctaagaggtagatactatcattatcactatcattagtatagagatggagaaactgatgaccagagagactggtaacctgtccgagtcacacagatgctgttgaaagcctggatctgatcccagcatcttacactggagaacactgggttccactctttcacaagagctctgctggaaaatatattattactttagacaaaataatcctacaatttttggataatgtctatcaaaatcaagaatacttacagcaaataagcagtaccaccttaacaaataccgtaatctttttttttttaccatctgtcttttttaaaaaggtagcggacatggttgatagaaattagcacacatatcatgactagaaacaaaacagtcactttgccacagcaaggaaccatgtaaagttagctaaatcaatccacacgtgtttactaagttccgattcagtagctagctctatgcgtggcaggcaccatgagggagacagaaatgagtttaaagtgactctgtgtacactgctattcccaaaggtaactgtttaaataagaggcaggagcctgattacaggtcttagagcaatgaaacttgtctacacctcaaaagtcttgcttgtaagaccaagaagccaggctcaaggccaaaggcttaattttaacaagcaattaagccccaacaaagaaagtagagagaggaggaggactttgttcgttatcattccacacatacatcaaacctatctggctctcctggcggattctgagccctgagctaagcctcagccattggaaagcatgttctcttcctttgctttgaggacattcagaagacagtgcttgttctttggtgttaggcaatgacattggtgtagagataatgacactggaactcacgccttcagagccaggtatctccgtgaagcccaccaaatcaacaacatagacaatggacatttacatgctaccttcttccacagacgctcccagggaacacttcagaaggctggcttggtgccttctctccgccaagagccctctaattaaggccagaactgggaatcttccaccatcaaaagatggtgtctcactgtcactcatcatccaaccaccagataacttggaaaatctaagaaactcttcttgggattgcagatcacagcgaatgaaaactcactcatgactcgagcctgctggagaatgtccagctctagccaagtctgaatgaccagccagaaacctaaagggacactgtcacttagctgcaggcctagtagtgcaggacaaagatgaattattcagtgggaaaagagggcaggtttaggggtcgccccagagttcaaaccatacataaccactgtattcatttgctagggctgctataataatacacaggtgaggtggcttaaacaacagagatttatcctttcacagttctggaggttgaaagtccaaggtcaaggtgtctgcaggtctggcttctgaggtctgattctcctcctagcctgtagagatggtggccttctcactgtttcctcacacagccttttctctatgcatcccgggtatctatgtgtcaaaatttcctcttctttttggggtgccagaaatggagtctcattctgtggcccagactgcagtgcagtggcacaatccaagctcactgcaacctccgcctcctgggttcaagcgattcccctgcctcagcctcccgagtagctgggattacaagtggttgccaccacgcccagctaattttttagaatatttttagtagagatggggtttcaccatgttagccaggctggtcttgaactcctgacctcaagtgatccacctgcttcagcctcccaaagtgccgggattacagctgtgcaccatcatgccaggctaatttttgtatttttagtagagatgggcttttgccgtgttggccaggctggtctcgaactcctgacctcaggtgatctgcctgcctcaccctcccaaagtgctgggattaaaggcatgagccaccaggcctggctcaaatttccttttcttataaacaaaccagtcagattggatgagggccccattaatttaatgcaatcacctcagtaaaggccttatctccaaatagtcacattttgaggtattgggggaggaagggtttcaacatatgaaattagggtgggggtacaattcagtccataacaaccacctagcaccacttgcgaccttgggcaaagtccttagcttctgtgagctttatttttctcactgacccccacgtaaacaggtaggattatacttgccaacagagctactgtaacaaagtggaaaacagattttctgggacctttttgtaagggacactattaataattatacaagcttaacaggtataaacccagactgtcccaggaaaccctaagataggctcctctttgtcttgaacacagcataccactgacatcatgagttgtcgtgaacattaaataaaaataaatactgtacatagttacaacctcagaaatgatcttctctttgatttcttcctccaggcttacaaaggctgagacatatccctctatactcaaccctactaaaccacaagtcttctgaactgcaagttaccgtagatacgagtgcaacctatgtcacgtgacggcagtgaactgagcaaatttagctaattcgttttgaatgcttactttatgccaagcatacgaaattcctgcaacgctgccaagggaggtatcatgatccccattttatagatcagataactgatactctcagagaataatttgctcaaaaacacagggctaatcaggaatggagccaggagcagtaagcaagtttgtaagttgccagaaactagtcctttaaccgatatcctggtgttaatcaaaagtatgaacttactgaatcagaatctctgggcaagggtccaaggaatctacattgttatgaaacacccttgggggattcttacgtacgctgaaccggagagactttacatgatacctaaactctaccatgtgtaatgcaagactgaaaaagcttccaaactgacaaagaatacgattcctgcctctgatccccagccagccatcaagtgtcggatgcatgcgtgaaactcttaagagcgttggtgttcacgctctgcacccccaagaaatttccaggacgggtgcaaagtgttcccttctccccactttggtgaagagatttgccttgccctaaaaaacctggctaccaccctccactttccagcatttcctcctcagggaagtgggactctttttcaactcctccttcttagggtctcattgcagcaaccaaggtgttgcataacggggctttctcttcagatgtccccatgggatttcacactggctcctaagacgaaggctgggcacgtgcagggcaggcggcatggggtgatgagggagggatgccagtgatacagaggtgtccttgttctctaaaaaagactgcatttggaatgtgaatgcaggccagaatcacacagccctcaccttgttggaaaatgtgaactcaccttcaaatagggctcaggggagaaaacagaaaccccacagagagaacaaggggattctcaatgttttacagaaacgttggcagttaaaactgggtgtattgcgcgctctctttctctcttttgtattaaaagcttaaaaagctggtctttctgctatcctactttcattctacatttttttagcccaggacccagaaatgagcagtagaaccttaaaatgaagcttaggcccttggagatggcaattcatcacccacagccttggaagatagagaaaccacagactcatggaaacttgggaattatcttaatgcttctccagcttggtatgtgtatccttgagcacaaatggttatcaaaaatctaaactcctgtatttaatactttgttctgtgtgtgcctcaagaggttttgtaattctttaaaaagtacacagaattaccatcttagaattacaaggttttgaagaaacctacctgaaaagattagaggcttgagctacagagtgttaagacaagaatgcccaactggtggcctgtggatgcttcaagctggtttgctttttttttttttttttggcctgcagccttgatgaaatacttgaaatcattcattgccaatgttttaaaaccaggatacttcacatgcaaatctagatttctcacgtctcctttaagaacagaagatttagcaacactggatgtgtattcttgcaagaaaacagctccagactgagtagctggcctggctactgcaagcaacagaatttatcacccccatattaatgcaaattgcctaaggtcacatagctagtcaatattgacaataatcaaaataccagctaacattgttctcacactgaatgccaggtattactgtaaggggtttgtaaatattatcttatttaattcttacaactgtctgggtgttgtggctcaagcctgtaatccgtggaggccaaggctgacggatcacttgcggtcaggaggtcgagactggcctgaccaatatggtgaaaccccatctctactaaaaatataaaacttagctgggcgtgttggtgcatacctgtagtcccagctacccaggaggctgaggcacgagaacagcttgaaccctggcggcagaggctgcagtgagccaagatagtgccactgcactccagcctgggtgacagactgggaccgtgtcttaaaacaaacaaacaaacaaacaaaccaaccttacaagaactccaggaggcaggcaccaaaagccccattttacagatggtgtaattgaggctcaaaggagaagtaattttttcaaactcattcattagtgggtggtgaagccaggatttgaaacagggcatccttttggaccactaagctaccctgcttcccagtggtacaaccacatcttgaactggaatcattaaaccacagttcctggttctatcagcatctggcactaagaagccataaggagcactgaattggatcagatgctcctcatactagatgttctcatttccttgctgcgagtcttcaggtcgactactttgctttttccagtggttaatggtaataatcatcaccatgatcctctcacactcattgtggagcactgactgagatgttctaccagagcccggctcagtcctgacagagtgggtgggccaccaatgttagttcctcttagaagacaattggcgacactttacagtgttttgcttttcacagctcagaggcatctcagaccataaacaagacctgccacgtgccaagaaggcagccgttacccgacatggcccagacaggaagtgctggctaaatcccaccatgccgcaaatctttctaaaggtggccacccaggctgtgtttgaacacacatcctcctggagctgggaacacacgccacatctataattcatcccgataattagcttttcccaggcacaggccgcagcacctatcaattttgcacccacttgctgtggtcaccaagatggcaggtggcccaactggaaccaatactgccaagtgtcccacagacattgtctggagttccaatgatactatgtgacttctgggactgctgggtgagatctctgttccacaggaaaatagttcatatttgagctccagaatccaaaatcgtgagttcaagaaaagcacttagaggtgcagaccagttatgcagcgaattcacaataagttgcccgaggcagctgttactaagcagtccacctggcctcaaattctcaatacggcccgaggagcagatattattaatagattccagtttccctagatgtccgtccctgacctgaatcaaacccatcactgtttggtgaggcatgggagatccaggaggaaaggcctatttcctaagggccacacacagtttggattaaaattcagtgtagaatgtcagttttttgataccaaatctggagttcatcccattttgccaaaataaatttctatgcacatccctccctgcttttcttcacttcctcctcttttgctccttcacaagagcctctgaccaggacatctattgtcgaagatacaggaaaactgtgattcagcagtgcttcgcgtctggaatgactccaagaggccacacacagaactgccgacacaaaccacggggggcggaaaaaacgatcccaggaggtggggagtggagagctttgcagtcccaggctacagctcgggatgtagagctgccttcctaggacagaagagagacgatgagaacacctggctggaaggtggccctgcaggggacggatgggccttctacatttagagtcaggatggagtcagaaagcttcagcaggggagggactctgcctgcagcctgtcccctcaacctcctctaatatttcttaatgaaacgatagtgacaatgaagatgacagccttgatgacagcgcccagtagaccgctatcattggttaagtccttatgagataccataattcaccatttatgagcattacttcaataaacccacattctatcctcatgaagtggctgttcccagaaggccataaagactggatagatagattttttttttttttttggtttttactttaaaaaaaaaaaacgacagggtcttgctctgctgcccagattggagtgcagtgatgtaatcatggctcaccacagccttgaacttctgggctcaagcaatccttccacctcaccctcccaagtagctgggactacaggcctgtgccaccacgcctggctaatatttcattttttgtagagatggggtcttcctatgttgcccaggctggtcttgaactcctggtctcaagtgatcctactgccttggcctcccgaattgctggaattgcaggcaagagtcagtgtgcccagtttgctttttctcttgatgacattaagtatttccttgttcctggattatgaataccctgtagtactgttcctaatttatataggaggaaactgaggctcagagagtttcaaagacttggttgaaagccacagagccaggcccatttaaccttaatatcttcagagaggtttaaaaaaaaaaagaaaaaaaggtaaccaaaatgcttggatgtggtatggtgtgatctgcatggtgcacaaaaatacttctttttttttttttttttttagatggagttttgcttgtcacgcaagctagagtgcagtggcgtgatctcggctcactgcaacctccacctcccgggttcaagcgattctcctgcctcagactcctgaggagctgggattacaggcacatgctactaagcctggctaatttttgaacaatactttttttaaaattaggtgccagcatttaaaatttagggtgaaatcatgatattctgatttgtggcttttcgtgaaatgtggaaagatctgacccactgggtaggcaggtccacttaaggcaggcacatccccttctgtttgccacaaccccaccctgcccacctgggctgagccctgaaagcatctaagtttatgaccttcctatctgttcaccaccataccttacccctcccccacaaaggaaggtaccatgttaccccatgaacatgactccaaccctcacccgccaacctcaagaagaaaaattcgggatcccgtgacttcacagcagaaacagaaaaactcaaataatccatcaggaagttgagcactgaggttaatacacacaggaccatcttcctctagctcaacagtcttgacttttcagggccgtgacccagaagggaggtgcccgtgcagaaggcagaacaggaagaggttcttagcacccactgttttctcttcctgcacagccgccttgggcagctgcctgtgaacagcctggctgtttttctcctagctctctcggaaggaagtgctctcatcacccacgacaacagagttggcccgaggagccaaaaacgtgcaaaggggctccaagcccagctctccttctgttcggggcagcctcagagacaggaagatgggaagaaagtatggcctgggatagaacatcctgcgagacccttacaaagccccagctgtgggggaagggaacaacaggagggggccagaggaagggggtccaggtcacaccaattttatacaatgagctcctttcatccgtgaatagaggactctccttaactctgtctcaatggctttgtttctgaaacgatcaattctacacccagaaagccaaatttgccagacctcatgccaaggtcaggcaagagcctgagatcccccaagcaagttgataatcaacacgcaggagacgacgctgtgctaagtcccatttggcggatccaaagcttacaacgatccgctttcatttctacgccttctgcagtggggcggggttgggggaccctcgctcacatgcatgccacgcttggtggaactgtaggctgtattcaggagagtaagtgttactttcccagggacttcattgagacatctgcggggagggcaggatgagaaagagctggagaaacaagatgcaaggtaaagtgtgtggtctcacactgaacacgttcatgaagtggtgggaagcaaccctagtgactcagcagtggcctctgtttagccagcactttgagaacacgatcttcatgggctgactgcagaggtggccaacagaaactggaatctacaagcagtattcagctcaggcatagtttgttcagcctgcacaatgttttaaaaagaacaacaaaaacctacataggatgccaatacttcacattcaggaggtttcccataaaactgcaaagttctggcattttttggaaaaatcagaagacctagctacacaaatccagcattttcctaaggcactgcctttctggcactggaaagcagctatctcccttagaagggtcacaggccctcctgcttgccacagtccccgccccagacacatgtccttcacttacggctgccagtgtggctgctgtgggcattggtgtttgtaatctctggtttagtggatcctaagctaagcccagcactttcagctggaggacctgaggttagagagaaggacgggatatgaaccatagacaggttgtaaagtaacgtggctgcaaagtccaagaataatttaactcaagaagcacctatgaatgcacacccaggaatacaaggcagagagcaaagttgactcccatggataggggtgagagtcctgtcttctcatcagcccctgctacatacttttgacaacttgtcccacttccccaggaccagggactatcttctttgtttttatgcttaatgaagtcctaagactgccacatagaaagcacttggtaaattcttgctgaaccaaaatcaacggaaacccaattcatgttataggtggaatctgagagatgtatgctgagaactcagccaacttctgagctgtaggatgttttcctgactgtaagtcaaggcaagtcctccctataaagaagagtttggggtataaatgacacagcagaaggagacaagctcaacctactgattggctaatgtctgagatgaggaagcagaaaggttagtctttataggatatgtagcatatctgatgagctatggtctgttaggaaggtactatacgtactaatttcataaaattgaagtatgttccaacttatcaaaggatgcaaaaactccacagaaggaaggaaggacctcatgtggtggcaggtgcagcatattttactgcaacctttctaggtctaaaaaggtaaaatgaggtttatcacatctgcttctgctgtgtatagccatggctagttttctccagctctgtttattaagagacagagagaaagaaagagagagtgtatgtgtgtgaatatgcatgtgtgtacacacacatatgtgagcatccacatgcacatacaggtatgcatgtgtggtctctttcattcaacacccccccaaaaaaagttgctatgggatctgtagattttgtttgctgagtatccctaattttggaattccctctgttctaagttgccccattcttggtactaatttcaaatggctgtgggggaggggaggctagcttcagacaagattccactaagagttttacttctgagctgggatagaagcaggaaagaataacaggaaaaacatgcagcatcccatctctgcactttgcatttagttataattattcacgcaggagcatctttaaacaccaaacgagggaaatattacagttgttctgatttcacatgctaactgtgtttacatgctaacagcatttctcagggacaattatcttattactagtgcactaatcttttcaatcttttcaacacattttacagctgcagacttcaaaaattaaggctaattaagaccttgctttcagcaggtacagtaaactactcacattccaacatggtaaaagaaaatcagtttaggggaaagggtgttagaggggcacagtgtcaatggcagacagaatacattagatagcttccatcagtgtgaggactacaactctcccaatgctaatgttcaagaacaagttccattaatggtaaggcctgtcgaattcaggaccaaggacagctggtctggcccatttttaagagaaagtgggtattttgcattcaattatccgtttccattcattatcttcttccgtgtgacttcagcatagaatagtggctaagaacatggaaacttgtatcagagtctctgtgtacaaatgccggctcaattattttccgtttgaacttgagcaaattacttgagatcttggtgcctcagtttcctcatatgcgaagtaggaataataataatgacatatacctacttcccaggcctgttattaggattcaccgaatatctgtaaagcacttacaacaatgtctgatcataataaatcatcaaatacgtatttcttttaaaaagtgtggtctataaggactaacaacaaacatctgttttctaacacgttcttgacctcacatgtactcactgcattatgggccatttgagggctgctaatatataatcatagctatatttattgtgcctgttagcaatacattctccagttacttgccctgctatctcattagctgccatataaaaccagcaccttggatcatccaatattattttttgttttgtttcgttttaaatcacagagaagcagaatgctctctgaagggctgttgttggaatccatattcacagtccagcttctcagatcccaagcaaaagctctggcatcccaagttgtggcgtctgagaaaccagtaatcagcgtctacagtgctcgggccactgacgttcatcaggcacctactatgtgcctcaacctaggcttgagaggctgctttttgaatgctcacaccaactctgtggggaagataatgctggccccattttatagatgaggaaactgaggcttcagacaattctacagccacaaaacttgtgaataaaacaaagttaccgtgtagtacacgtgtttcattctctccagccacacacttttaagccagctggcggaatttctcaagatgatgaatactattatttttactagctgtagaactcataataatggttgttaccatcaacaccaacatacagcatgtgccaggcactgacatattttactcacttaattctgacaactgcccttaaggaatggactcctattagcctctatttacagatgagggacctgggctcagagaggttatgccatgtgcccaaagtcacacagctgcacagtgttggagctagaatttgatcaaattcaggagatccagcttgagaacactgctcgtgaacactattctccagcctctcgtaatacctataaaattcaacaactgtctccttttcaatggacacataaggtatctttaacaagatagctacagggagtattgattccatcatcttatatcaaacaactgattgcaaaattggtgatttagttagatttgtgataaatgctgccaaaggggagaaggtagggacagaaaacacaggaacttcatccaggagagaagatcagaaaggttctttcagaaagggagaattaaactggctgccaaagaatgagtgagaatcaacttgtccaaggtagaggagaggacaagcattttaggcagaaggagaagcatgaataaaggctctgtggtgggaaggcactcataattttgaggacacaaagaaaggaagtctgaatctagaatcaacattgagaaggtgagtagcatatgataaagtggtaggatttggtgtaggggccaccaggtcagggagtccctttgggtgctaggaaggagcttgagtcttatccaaagagcaacagggagtcactgccaaagttcctgtgtagattgattggaatcttcatcaggatcagccttcactcctactccctagattataatatttggcttttacataatcagatccaaaggtacttctgaaaaccaactcagtgaatcagcacactgaagattttcaaaataagtctcaaataattcctattccccatttttagggatcatgatataacccacacggtctaagacattatgttgctactaccatgccgtactaattattcaaccctcagtattgttattacagacagaaaaaaaaaaacaagaggtgatatcttgtaacatgaaagtcaaaaaaaatcttttttctgtctaaaatagaaggacaaaaaaaatcaatctaggttagaaaacatcaatttgcaagagttctatggctgaggaaaatggcatgagtatttgtaggctgaaacaaatgagcagctaaaacatccccccaccacctcccacacataaccaaatgggacagactacttctggcatgtttccatttactcacacctacaatgtgctaggtgctatggtttatttcaaccccataaccagtgtgaccaagcatcccagcttgcctgggactgaggatatgggacgttcagcactaaaaatcaggcatatcccagaccaactaggacacactggtggctcaacctgcaacaaccacagctattaatataaggcagacacaggctcagagaggtggagacacttgttaatgtcacacagcaggtaaggggcagagaccaagattcaagttccagtccgtgcaacttcaaatcctataataacatttcttaggcacttattatggactaggtagtgctttaagcccatttagaagcattataagcattaattaatcctcgcaacatctctatgaagtacatactattctgggtcttgttttatagatggaaaattcaaagctaagattagctaataactcacccaaaatcccccagccaagagggacctggctttagtgcctatattgttaaccggcccatccaacagacccctgggcaaaaaccctgtcgcaatgcaaaaaaaaaaataaaattttagctgtttcttgttcaagataacatttaaaacacacacacacacacacacacagaaaagattagacgagaggtctggaaaaacaagttgctctgagtcttacagccaccacaaagcaggaattgctagtggctgctgatttacaaggctctctggtgaattacagaaagggaaatacagtcagatttgataaggctggtcaagttcggtgctcaagagcagtccatgatccagagaggccgggaacatgctcctgggccctcgtgcccatcagatcaatccccaccggccaggtggatgggtctgctgttgggacaggcagcctggaaccacatttccacgcttcagataaaggtggcttccggagcccggcctttcactaccatgccctgggggcaccacaggcaaagacccagacttgaacggctggagccactggtgtccctacgatgtatgtgcagggggaggtggcagtgttgaaaagggacggtcatcactgcaccaccattaccattagcattaatcactgagtgtgtttgcttgcgtcagagcctgtactgttaataaaccctgacctgtgtatccaaccactttacagagaaggaagtgggactgtggatcacagccagcgttgccctagggcttagaggggcccatcccactgtgctttcacgacctggtggcagtggttctcaaccaggggggtggttttgtcccccagggaacatttgacactgtctagagacacgcttatttgtcataacttgaaagggagcgtgtactggcacctagagggtagagacagggatggcgctccatatcctacaatgcacaggtcagctgatcctttatccagccccaaacatctatagtatggggctgagaaaccccaacctaagaggacagaggtaggccaaccacagccagccaagcttgcaggttgtgtccttccagacccttcctcagggtaccagccactcaaactagaagccagtgctcaagaggatgggtgatgtctcttttgctcacagctgcatctgaagggcctaaaacagatttggtgacttgtcttttctgttaaagaacagggacctggctgggcacagtggctcacgcctataatcccaacactttgagaggccaaggcaggaggatcacttgaggtcaggagttcaagaccggcctgaccaagatggtgaaaccccgtctccactaaaaacacaaatattagctgggcatcatggcttgcacctgtaatcccagctacttagaaagctgaggcaggagaatcgcttgaatccgggaggcggaggttgcagtgagccgagattgtgccattgcattccagcctgagcaacaagagcaaaactctgtctcaaaaaaaaaaaaaaaaaaaaaaaaaatagggaccaaatgacgaatgaacaagaaatgcacccaaccaggccaggtgtggtggctcacacctgtaatcccagcactgtgggaggccaaagcaggcagctcactttaggtcagaagttcgagaccagcctggccaatatggtgaaacaccatttcttctaaaaatacaaaaattagccgggcatggtggcacatgcctgtaatctcagctcctcaggaggctgaggcaggagaattgcttgaacccggaaggtggagggtgcagtgagccaagatcgcaccactgcactccagcctaggtgacagagtgagactctgcctcacacacacacacaaaattaggtactattctgggtcttgtttttatagatggaatagtcaaggctcagattaactaataactcacccaagatcccccagccaggaagaaggacctggttctagtgcctatgttgttaacctgcccatcaaacagacctgttgggacctcatgaggccagacactaaccccctgtcctcagctagacatggcgatagagttcccattgtctggatggcagaatcttcccatcactgcagtggttcaagacatccaggctctttgtttggcgggacagccagcctgctctattctcaggggaagggctttgagaatggcttatttagctcactccccaagaagcttatcaccccaaccccacccctgcccaacaaacacattcccatcaggaaagctggacgaccctgccttccatggaatggaagctatgatcccatccattcagttcagcctctcataaacgctctgttccaaacataaccagaatagtcagggagtcctcgaaacccagacatgacttattttctatttctagcttaaccacgtgatgcctgtgagtttcaagcactggagcatccccattcacgctggaaccatctcatctagaaaggggagggtgtacaagcagctctggatcagcccactggggttcagaacaagcaaaagaatttctttacctcccctgagtttcagcctcaaagagcagcaaagaacctggagcccattaaatccagctgtgctcattgtacaaagggaagaactgaggctttggaggacaaagaagatacccagatgatctgcattgctctttttctcccttgcttctttctctcttgttgaattggaataggtcaaacctgtctacagtactcaaatgtcacgggggtttcctccactaggcatggggcagagcttattctcaataaatgttcgagaatgaaacgtcagcaattaactagcaggcaactttggagaggatttcacttcccctataattaaacacaacaaatggcacgaatgttgaagggacaatatgcatgggtgtgtgtgagaaagaggaagagactgcagttcccataccaaataggtatttatttgttccaagacttttttttttcaccaaaaaatgctttaatataatcaccttttaaataatatacactgtcatcttgattatgtctattgggcttactcaaagaggccaggaccttgcagagaaatgagcctgaggtttccttctgccaggtcaccagtcaatggatatttcccaaaaggtggatcttttaatatatgactgcataatttaacctaaaatcctagttagtattctagcaagatgtctccttctaattgaggtaatttctaggaatatgttgctaaaagtttccttttcttcaaataaagcaataactgccatttatgaagcacgtattaggtgccaggtacttcactggccttaactctttgtaactcatgttttcaccgtcacgacaacactgtaaggcaaattacgaccagttcacagccaggaaaactgagactgaggcagaaaagtaactggcccagtgctgcagaaccagtaagaggctgagctggggttagaacctaggaatgactctcaagtccaagctctttatactgtattctcctaagctcagattaaaacccactccatcccctactttcttagtatttcttcatagacagaatatttcaaggaatttaacttttaccacaagggatacaaaacaaggaatgagaggacctgtcttacctccgctttatcacaaccactttgcaaagttactgagattcaacagctttgtctgctaaatgggcacatagcccttcaaccactcctttgctttgctgccagaaacaaaggaaaaggcaggaaaaaagtgcatatttcttccagaattgtcagaggccagcagatcttcctgcaggatgtcagcctaagcaatctttcaaatgctccccgggcaggcagcccaacccaccacactccgctccaaggagacacctcctaaaataaaccctgctaacttcagttagctcaccctaaagactatatatagaagaaaagactcaggagttcccatttggcagcagcttctccaaaactcagcgcaaatggctgatttctaacttaatctccaacatctgacaggcggctttaaatcagggaggccgactaagagatggaaaacctctgtgaggccagcccagcctgcctgggggcagagacaccccagggcttttcagcaaactggaatggcatgaaaatgggaacctggcccccggaggatgcgggagagaaattagacaaggtgtggtgggtgggagcaggatccagcccagccaggccactgggcatgttgtgggggtagctgggggtagaggacagtgatctgtacagaggcactgctgtgaattctgaatcttggtgtcttctgggcctcatgttatcctagagaataacagaaagccagggaaagctttgagtctccacatctatgaaatgaaggatatctctctctctctctctctctctctctctctctctcacacacacacacacacacacacacacacaccccttacctccagagagccagacattcactctcaagacacttttgaaaatactggtctttccaaagaccatcatttgtatttgtatttgaaagattgcttaggctgaattctgtaggaagacctgctggcctctgatagttctggaagaaatatgcacttttgtctccattttcctttgtgtctggcaacaatgctaagaggtggttggagggctgggagcagtgcctcacacctgtaatcccagcattttgggaggccaaggcaggcggatcacttgaggtcgggagttcgagaccagcctggccaacatggtgaaaccccatctctactaaaaacacaaaaattagctaggcatggtggtgcacacctgtaatcccagctattcgggaggctgaggcagaagaatcacctgaacccaggaggcggaggttgcagtgagctgagatcatgccactgaactccagcctgggcgacagacccagaatctgtctctaaataaataaataaacaaataaataaaaataaaaagaggtggttggagcgagatgtgcccatttagcagacgaagcagttgactctcagtaactctgcaaagtggttgtatatcccatggaaggatatacaagaaattgttagcaatgattcctttaaagacagagactggaaaagaaggagaagtctcctattttatatccttttctcatgggggaattttgttatcacatgcttatactccttatatttaaaaagcaagtgtcattcacagatggagggataataaggtggcttctcaaaaaattaaatatagaaaaactagatgtcaaatgctatataatcagcaattcctcctctgggttcacaacctagtgaaaagaaggggcttgaacagctattggcatatctgtgttcaaagcagcattactcacagtagctaaaaggggaaagctagcctagtgtccctcctggaagatctgcgtggataaaccaaatgcaatacacacataccatggactagtcagccttaaaaaggaaggaaattctgacacattccgtgacagggacaaacctcaaagacattatttatgctaagagaaaccagccagttacaaaaggacaaatactgtgtgattccacttataggaggtacttagcgtagtcaaaatcatagacacagaaagaagaatggcagtttccaggggctgggggtgagagtggacaatgaggggctatactttgttgtcgttgtttctttttttgtttgttttggcctgcaaagcgttttagaacttttcaattaatcgctaatgtttgaaactcagaaaatgtaaacaaatctagagtgagagaaagctcatcagttgtttgcctgtggatggggtttggggaagagggaggtagttattgtaaagagaaataagaaaatcctgggggtgatgttcattatatccaataatttggggtgatgatgtcacaggtggatacagatatcaaaactcatcaaattttacactttgaatatgcataatttatcacaagctaattacatttcaataaagctggacaattttatttatttcatgctattcaaacaaaaaagaaaaaaaagaacaaataaaaggcaacacctttttttttttttttttttttgaaatggagtctcactctgtcacccaagctggattggagcgcagtggcatgatctcggctcactgcaacctctgcctcccagtttcaagcaattctcctgcctcagcctcctgagctgggattacaggcatgcaccaccatgcctggctaatttttgtatttttaatagagacggggtttcactatgttggccaggctggtcttgaactcctgacctcaaatgatccacccacctcagcctcccaaagtgctgggaatacaggtgtgagccactgtgcctggtcgcaatatcttaataaaataaatggagattgaattattaatagaaaatgtctaacattttagttctgacagtctatgaaattgattctaaatccaaggaaacattacagaaggagaaattaagatttctaggaatgaatttatttactcaactaacagtggcaatggatgtgggctaacagtgcacttcaactttatctcagttaatcctcactgcaagcccatgaagcatctgttggtattttccccattgaacagatgacaatactgaggcacagagaggccaccttccagaattgggatgagggcagggatgattccagagtccatgctcttacccactgtgccgtgccccctccctcaattgtcattggacacccactatgtgctgggcactctcttggctagattcacagtgagagaagccactttgggccaaaaggctgcaagaaggggcaaatggagatgccggtatttgggcctctccatctttctggggtggaaagtatcactgcacatcatcacaggtacacggagagctccacggtgggcccatttcagcaagaggcattttaaggtcccaggaattgtccaaggcactgctgccccataaaactttctgtgatgatagaaacagtctctgtactgaccccagtggaactcactagccacacgtggctgcccaccacttgaaatgtggctgttacaaatgtggaattgcatttctaattctatttaagattactgaatttcagtgttaatgggaccccacacagagtggattgcacagtgtcactgtgtcagcagagcacagcctggagatcaaagcacagcacaaaggttggcatctcaggactcggggcaggccagccaagagtgcaaccagcacagcacatgggagatgaacttggccctacagaggagccagtgtaactgcctctgaatgcccccttatctacgtttgagtcaaccaggatactgagggccatgtggaccacaacacacatgctccagataacagtccccatactccagataacggtccccatactggcactcactatcccagacgtctcgtgcaagacactttagtgcattacttcctagagaccgcaagaaggagtaactcccatccccattacccaggtgaggaaactgaggtacagagaaatgaagcaacatactcaaggtcacagtcactggcaaagctgggatttgaacccaggaggtttgactgcagaggacaaatttcaaacaactacccagtcccatctcccaagacagagtcacaccatgccgcctgtcctgagacccacgtactcacttccaacaagctgcaggcagaggctttccttttggtgggaggagaaaagccaggcttcccatggagagagtgagaaagacacagtcacaatcccaagcacagggacagaccgttccttctaaaccaccgtcactagccacaaacacaggaaatgcacagcagcttcacatcttcctcctcattttgcacggcccattctctctgccaggaatcccttcttctcttgcccacctggaggattcatatttatccttcccaattcaagacgttttattggaaacctttcctgacctccgaagataagtagaccactccctcctcagctagctggttgcggtcactgccaccacgactctatcctgtaattacttctctctaagcacccatcttcctcactccactgtaacattcaagattccttgtggcaggggctgggtcttatccacttgttttcccagagccaaacagggtgtctgacatacggtcctggctcggcaactgttgacttgcaatggcaatgataagatgaatgatttcaacaaaaggaacatttacattttaagagctgaatcaagaactcgcttatgtcaaagaaagagactagtgagtatccctcaatgtcttgggcactggaaacaggccagggtgtgttttccaactcagctactttctataatagctgtgtgacccaaagtggaattttcttttttttttttgagacggagtttcactcttgttgcccaggccagagtgcaatggcaagatctcgactcactgtaacctctgcctcccaagttcaagtgattctcctgtctcagcctctcgagtagctgggattataggtgcccgccaccacgcctggctaatttttgtatttttagtagagacagggtttcgccatgtgggccaggctggtctcgccctcctgacctcaggtgatctgcctgcctccacctcccaaagtgctgggattataggcatgagccaccgcgccggcccctaagtgaagttttaacctcttaaagctttccggtttccctccataagatgaggataacattaggatcggcctctgggggttgctgggaggatcacctgggctaataatgtatgtaaaacacttggcatagaacctgggcttctataaagcagttccagccctgggcccaaaggatcagaatgaaagcaaatgagcaggtaggagttgatgctgtacaaccaatcccaggtaagtaggtggttttgccaatttcttctcctttagtcccaccaagttctgagagaccctgggcccattctgtctctcggctggccagacccggttttcaggggccctcagaaaagaggtcacccactgatcacctccctagctgaatctgactcttatatattttgttttgaactgcaaagtgtttttaaatttttcaattagccgccaatgttcaaagctcaggaagactgtgcattcaaattctggatgtctaaccttctttgaaaaattagatttggcctcactgggttcatactttgaattgactgaatctgagaggcactgtctacttcagatgtggtgtgggagtgcccagtccccatgtggccaggacacttgttctcactaccaaccctgcccagaaaacatctaactttgcaactcctgccctagggaaggaagttggccagaaataggctgttttatttagcaaagctattagctaaaagcagggagcagctccgagggtgagtaaaaatccgcattccaaactcatctgacttctctttgacagcaccggtatgtaaagatacagatgaattaatcattccgtttagtaataaactaaccctgttgttgctgcctctgtcatggagaaagcaaaaaatcaatcgctggtggaagcacttctcaatctacacctgacagaggggcgacagttagtgctgtcctattcccagcatcgggcctggaggaattcctgattttaggtgactgcagagtccttgaaggaggtaaaagctgctcacagcctgacagttctctgcatttactcccaaagaggagatgacggagcagagagacatgatccgatgaagagacaaacctgtccatgtcactcacctttatgtcttattggaagtgtcacctcttcgtagatgtgacaactgaacctagtaaatagaggcccccgctgcctgccccatccccataacacacataaacacacatacacacacacacacacacacacacacacacacacacacacacctatgtactccactgttggcctccctggaacatctgccagaggctgtaatatcttatttgttctcttgtgtgctcttttcagctatattatatgctgtacgaagaaagtagccttgtctgatttgatctgtttccagctacttgtctgtttctggcacctcacatagcccttggcacccaacgagcccttcctgaaaatttgcaaatgcatttttgacacaatacacggtattctgtaacgtttccaaacttccaatgcccatgcactagtttcacggtttttgccatatttctgtaccacccagtccagtaactcagtattttcttcaaccaactctcatcttgtagtgaaatagatctctttttaaaataaagctttacggccatgcatttggtcaatagagagacacctgtaattgatgagctctggagttgacagtcacctatgagcagtgtgaccctggacaagtgagttaacaacagtctatgaaattgattctaaatccaaggaaacactacagaaggagaaattaagatttctaggaatgaatttatttactcaactaacagtggcaatagatgtgggctaactgcacttcatctgcaaaacagcactaacaatagcacctactgaatacagaggtggttcaagggtaaatgacttaaaacatgtaaagttaatttacggcaagtgcttccaatagtgcctgccacagagccaacacgatatgaatactgcttgtattggtattatttaggggggaaaaccggtatcgctttaaataaatacatgacaattaaaaaaatcacttatgtaacagctgagaaacacttttggagacatgggctaagcctgagttttactgctacccaaatgtgaaaagcacccccttcgccaggtcctcatctcccatcttttaaatgaagatgttgggccgggcactctaagattccatccatcttccagttctgaatctctgactctcagtcatggataacactaccttaaaagaaataaaataggaaaaacctgaatttacacaataagctcaaaaggaaagagctggaggcggggaggttattcacattcccaaaggatttgcttttacaaagggattaacagcagagttgctttaaatagcagcttaagccttgtttatggattactagatacttgatggagaggtggaggggctcaggaacttggaacaaaagctttactacacccaggcagaaatgaaaaagcgcatatgttttctttaaaattacaatacacatcaacaggagaaatgattccatttcaaggaagctgattcctactcagtatttccgttgcatgtcaattgcatccaagaagatatgcctgtatccacgagccagtttagagcagtaatccagtgttcatatttttaagcccctattataagagcactgataatttattaaatgtcccaggcactgttgagcatatgacatgcattacctcatctaatcttcacagtaacccaataaggcaggtgtagttgtcatcatccttttacagatgaagaaactgaggctaagagaggggaagtgactcacccatgtcaaaagatggcaaatttaatagtcaagccaaagcgcatgaacctggctctgaggttagattataaaaggtaagatccttgtctcaaagagggcacagaacagccacggaggtcaacagactcagaggaggatgataaatgccccaagagacacctttgagggagcagaagaagaggatatcaaggtctagggtgtgcccaaagccaggagtgacctcatctgacccccaggtgtccatattcgagcatctctaaacactcagtgtatggattcctctcctccatccttcatgcatagaccctcttatctgtacctccctatgcacaaaccaatgtgtcctaggccactctattcccgaaaggtgggctgtgggactggaggcaaagagagaaagaacaactgttgcagggtctctgccagcacccacactgcttcactagactacctgagagcttcccattgcctggttttcctcctttgaaaaatggggatattcgccaccccccacctccctcagcagggaagcactagtgattaattaggtaacatctgtgaagcactcccagctttccggagaagggcaccttgggagaggagctataaaaacctgaggcacaggctattatcagcgtgatcattattatcatcattgtcattatgacattctcctgcccaaagacctgcagtggctcaccactgcccagagaagaaggtgccattggctgcctggcaggcaagggaaccgctgctaccccctccctggactctcccacccccatgcatctctaaccaataataccctatatgtgagtcctgcaacttccacatggaaccccttctcctcagagcagctccagtcttgcccggtccaagaacctttcctaaccacgtaggctggaagctcaacattggcatgcctatttctgctgtagacaccaagatttttctcctcgtgaagattctattcagaggaatacacaagtgcataaaaaacagtgatattgcatgagtttctcttttcccagagctataaaacaaagatgctacacaaaccatgactcagtatcttagactgatgctcgtgacttataatgggttagatccaataaacccaccgtaagctgaaaatagcctaagttgaaaatgcatttaacgcacctaacctaccgaatatcacagcttagccaaccctgccttaaacatgctcagaacactgacattagcctacaattaggcaaaatcatctaatacgaagcctagtttataatgaagtgttgaatactgtacatggacattttgcagacatgacaggatgctaaaacacaaaacacactatccaaatacatcgctagcctgagaaaagatcaaaactcaaaattcgaagtaaggcttctgctgaagatacatcgctttgcaccaacgtaaagttgtaagtcaaacccactgtgagtgactgtctgtgtctctgattagatgataagcatgtagaggaccagagagagttcagataaagtctacaattcatgaacagggcctcaggaactagttaagggaacaagcacggtctctgggttcagacagaccagagctccccattctgcctgtcaccacctccctgagccccaacttcttcctctgcaaaatggagaccagcatacttaatatgaacagttaaagaaaaaactaatccggattaagtaaggagaaacatcattggaaaggattattgcgaagggcagaaaggaaaaatcacactacggagggtgctttaccataagatcttaaggatcctgaagcatctcaaaggctaggcaaaaaggagttttcttttaacaaaaaggagaaacaaaagcaggtttggggaagaaaggatggtatgatcagagagtagatcagagaatgttttaccctgatgccagccttttctcaggaggggctgtgtgctggctcacgctcagtgtgggtcaaggcaaaagcacctggaggaagaagagagtctgatccaaagtctggtgatcaagcatgttgttctgattgatcagtgggaatgagcagccagctcatcctttataaggtaacaaatgggaatatgcagggtctgggtctagccctgtcctggggaaacaaaagggtatccacgagttgtagctaagtcacgtgggcaacactggttctttgcagcgaggcattttctgcaacacaaacaggtgagtggattcctttaacctttgttcttttgcaggagcacagggctcaagtaaaattcagcattgttgatccccaagaaagtggctgtgtagattcaatgtgccaatgcatagaaagcctttaacaaattgagtttttatcatttttatttttcttagagatagggtttcaccctgccactcaggctggagtgcagcggcacgatcctggctcacttcagcctcaacctcccgggctcaagtgatcctcccacctcagcctcctgagtagcgaggactacaggtacacgccaccacacctcgctactatttttgtttaattatggtttatctgcaggatagtatagaacaatcattgtaagaggcagaaggttgagaaaggagtacagacattctggaggtgtcttgcaaataaatatgcagccccggagtggatctgtttagccagccaggcatagaacacttctgactcacactggactttctgtctgatcagccccaggccatttttacatcatcttctcttaagcaagacaggtcttcagcctaaaacacatccaacatagtccctggcgattgagaagttcaaagaaaaataaagtgaaatatacagcccaccactgcaatccatccaagaatcaaagggtgtaggcttcaagacaggatggagaaccaggagttaaacaaaattctccactaactttttatcctctgctataatcagtggcatgcaaacctgttttaaatttaccgacagcttaagctgccacccaggtcttgaggtatttttagtcaactagaaattcatttagagcctgaagtcagggaagggaatcgtgtcaggtgtggctcctgcaggattcaggtcgtgccctgtacctgctttagttaccactcctcatttgcacacaattaaataatcacttcaccccctgcccatctcttcagcatcttcagcatctcctcacaaagcagcaggagaggggaataaaacgtcagggaagtcaactctaggtttaagagatctgttcttaatccgaacatcatttccattagcagaaacaaactcaacagggggaggcgagtacaaggaatatagggccctgagccgaaccaaaagagaacaaattcctctttccccactcaaaacaggcctatccaataaagttgcggctgtatgtacgtgaataagctgccagcaagaacgaggcagacacaggaggaatgaaattaatacttcggggtggggagtggtaagaaggtgcctaagtcgaaagcaaaaccacccaccctagtgtacaagccaagcatggaggaggcaccttcaatgcctctttatccttcaggcccctgtggccaacacatctccaattcactggtaagtcaacagagtctgtccagaacttgaaactgcctttgcaaaaacggtaacagtgagaaaattatgacagtgaaagaggtctgatctaaccaacccccatcttgcctttacctccaaaccgctcatgatcattcctgggcttgggtcaagctaactttcagagacatttagtttatactttaaaagataacagtccttccccaaaactaaaccacctttgtaaagctaatgtaggtccattaggttacaaggattaaaaggagccttggccaggggcagtggctcacgcctgtaatcccaacactttgggagcctgagattggtggattgcctgagctcaagagttcaaaaccagcctgggcaacatgacgaaactcccgtctctactaaaaatacaaaaaattagctaggcatggtggtgcgtgactgtaatcccagctactccagaggctgaggcaggagaatcgcttgaacctgggagatagaggttgcagtgagacaagatcaccccattgcactccagcatgggcgacagagcgagactccttctcaaaagaaaaaaaacaaaaacaaacaaacaaaaaacctgaattctgctagtgtaaaggattcccagccattattcctgaggtcacaagatttgcaacttccctgattcctcctgcagataacatcactcctgtagaacctaagattggccttttgagatgtcttttcaggtttttgcatttcttttatttaacacttgatatgaactaggggaagatttttacatttctgactatgatggcttgacccagacccaccaaccagtactgtgtcctcaccagaagaggaccattttccacccacccctgtgattgcatccccaaccaaccagcagcacccataactttgtccgccaaactatccttgaaaaacactagcctcaaaatttccagagagactgatttgaatcataaaactccagtctcccattcagccagttctgcatgaattaaactctctctattgcaattcccctgttttgataaaatcagccctatctggacagtgagcaaaataaacccactgggcaattacaaactgtccacttctgaccttgaccaccactatgctaacccaagtcccagtcatcttggatcccaacatccctttactcccagggtcctttcttcttccagcagccatcagaggcattgatagggcttggctgtgtccccacccaaaactcatcttgaattgtagctcccataattcccacatgtggtgggagggacccagtgagaaataactgagtcatgggggtagtttccccccatactgttctcatggtagtaagtctcacgagatctgatggttttataaggggtggttccccctttcacttggctcttattctctgttgcctgcctctacgtaagatgggcctttgctcctcatttgccttccgtcatgactgcaaggcctccacagccatgtggaacgttgagtcagttaaacctctttcatttataaattacccagtctcaatgtctttatttcgcagcatgagaaatgactaatacaggcacccttataaaatcataaaccaaagaacatacaacatagcaatttgtaaatcctacatgacttccccatctccctggaaataaaatctaaacttctctccttgatcataaagccctataggatcttacccctgcctgttcctcaagctcatctgacaccatgcttccttcttcctctgtgctccagcaccgatggccaaaggtttctagaacattccattctctctgccgcctcaaggccatttccctctgcctgggaggtttttcatccaagttttcacatggcttcctggtcgttgaggtctagggccaaatgtcacctccctcagggctctcttgggaccaccctcttcaacacatcctcctattttaatcccatgtataatatttgccatgttaacaggttctactttttttggtctgtttgatctctgtgtgttattcactgctgcatcctcatcgtgcacactagctgatactcctaaaaaatatttattgaatgaataaacgaccatcggaaggagaaaggaaaccccttctctctcaggaccccaaattcactatgccaaatgggagagttatgcttggaaactgagtcatgcaaaacactgcctttccctttgttcctaaacagacagctgcaagacagaaggccacatatctctccaggtggcctccctcgccttgacaatgtaaattaacagcttatcttcagaggtatgggacaaagacaagactagaaatcatcccccactgcccaccctaagacaaatgtatatttgacgtttccctccactttatgtttactttatcccatgtaaaatacagatttactgagcttgagacaaatatataagtgactgttcccctaccccctcctttcaaatgcaagatgtgggttcggtaagagttaattaaagcctcataagaatgtgacctctcacctcactccctaccttccctcttttctttccttcctccttcccctcctgcccactttttcccctttaaatacagagtcctcaaagccctctttggaaaaagcacaggccagatcctccagcgactttcatccctttttcctggggatgtcctcaaccttggcaaaagaaacctctaaactgattgaggcctgtggcagacactttggtttgcagaagaaaccacaactgtagcacatgatgtgagcaggtggatctgaaggtgatggtgtgtattttacatgacggcatacctcaatgtgtttattttttatttctataaatgtaaggggtgcaggagcaattctgttacatggataaactgtggagtggtgaagtgtgggcttttagtgtataccatcatccaaacggtgtacattatacccatgaagtaattctcatcatcccccccaaccaccctcccactcttcacagtctctagtatctatctcattccacactcaatgcctgtgtgtacacatatttagctcccactcccactgatgagatcatgctgtcatatctcaatgtagatgctaaatgttcaccagcaatacatgctacatctttagagttcggaaaaatgtcatatgagtctgggtgtggtggctcacatctgtaaccctagtgcttttggaggctaaggtgggaggactgtttaagcccaggagttcaagaccagcctgggaaacatagggagaccccatctcaaaagaattaattaattaattattattattattattattattttttgagatggagccttgctctgtcgcccaggctagagtgcagtggcgccatcttggctcactgcaagctccgcctcctgggttcacaccattctcctgcctcagcctcccgagtagctcggactacaggcgcccgccaccgcacctggctaattttttctatttttagtagagacggagtttcaccgtgttagccaggatggtctcgatctcctgacctcatgatccacccacctcggcctcccaaagtgctggcattacaggcatgagccaccacgcccggccaattgatttttttttaaatgtcaaatgaagtaaattctcagacccaagtagttccaaatatatttaataactgaatcaggtatcaggttttaaattaatgaaaatgaaataaaagtaaaacttcaatttctcactgctctagccacatttccagggctcctgatatagccccatgtggctgctggccacctcactggacggtacaggggtggctcatgtcacccaccacagcagcgatcaccgttgcagttcacggagaacagatttctactctgccttcatggaggtatcttctccatgggaggcagcggtggtctccacacgatccaccaagtccaaccctgccagctttttcattctgctctctcagagaagctgatatggcccagtgattccaatagggagcatctgggcagagtgccctggaggcagcagtccatcctcactgacatacagcacaactttacccactgtgcaagaagcacctgagcttccatgtcagaccatggaggaggacagcatttctggagataaataaagccaccacgcttagagaaaacaacagaggagggtgggaagagctctggccctggagctagaccgcctgggtttgaatcccagcagtgctactgaccagctatgtgaccttgggcacacaatttaacttctctatgactcagtttacctataggcaaaaggtcagcacctaccccttagaggagttgaaaaggacaaatgaaacagagtatataaagcatttgttgggctgggcatggtagctcatgcctgtaatctcaacactttgggaggccaaggcaggaagatcgcttgaggacaggagttcaacaccagcctgagcaagagagtgagatccctgcccatcccccctgtattagtccattttcacactgctatcaagaactacctgaggctgggtaatttataaagaaaagaggtttaactcactcacagttccacatgggctggggaggcctcaggaaacttacaatcgtggcagaagaggaagaggggcaaggcacatcttatacggcagcaggagagaatgagagtgaagggggaactgccaaacacttttaaagcatcagatctcatgagaactcactcactatcatgagaacagcatggggaaaacctcccccctcatccaatcacctcccaccaagtccctcctttggcacatggagattacaattcgagatgagagctggatggggacacagagccaaatcatatcaacccccacccacaccaatctcttaaatattaaaaaatggaagggtggtgcattcctgtagtcccagctacttgggaggctgaggcagaaagattacttgagcctaagaattcaaggctgcagtgagccatgatcgcaccactgcactccagcctgggcagcacagcgaaaccttatctctaaaaaaataaaaataatcacataaaacaaagcatatgtcacaagtgcctggcacatcacaatgactccctataaataatcataataattattcttgctcattataatactttgagctctgctcacagaagtacagaacaacacaggtgcccctgttaaactgaagccaaacttctaaagcagatcaattaccaggagatcattcacaatataaaggattctcatcggggactcctttaaatacagtgaaatctgtgaagggcttttcaaatcggaatcaatttaccatattgacatggaattcttcagggacccttcggggaaggactcagatgtagtgtcctctctgtcactctcatctgttggttggtgaacagcagactctgttcaccattcctacaatcagccaaggggggctgtgatgtttcacaaggcgccacggcagagagatgaaagttgttatgggtgctgttggattttagggctgctaagagaaccagatgtttaaaagtagccctgtgcaagtccaagccagagctgccaaattctcgacgcatgaaaaacaaaggcgtctggcttgggaaagtttgtcccaggcagactctctgagtctatttagaaagggttacaatgcaacgtttgtatctacacccctcctgtacaggtttgcaaaaccggaaataatgcctgtcactcatgcagtgactcctgggcacaaccttacagccagtccctgtgctgggcatcaaggaaatacagagatgacgtgaaatacctgctgggtgagccatagaagcaaagcgttatttgcttctgagtctgaaagctcagctgggtgaccttgggcatgttgcttaacctttctgtgattcagtcttctcatctgtgaaatggggatagcagcaggaccttccacacaaactcactgtgagaaatgagtaaagataaatgaaggggttggaacagctcctggcacacagtaagtgctcaataaatgtgtttattcttagttgtggtagtagactgctgataaggggctaaattcagggtgttagggtagtacataaaaaagctatctaggctgggcgcggtggctcacgcctataatcccaacactttgggaggccgaggcaggcagatcacttgaggtcaggagtttgagaccagcctggccaaacagtgaaaccctatctctactacaaatacaaaaaattagccgggcgtggtggcaggtacctgtaatcccagctactcgggaatctgaggcaggagaatggcttgaacccaggaggtgcaggttgcagtgagccaagatcaggccactgtactctggcctgggcagagtgggactccacctcagaaaaaaaagtatctaactagagtatcaggaaatgattaccatcccataccatagccagattcagctcgtggcctattttcgcaaataaaattttattggcacacagccacgttcatttgtttacatgttatctctggctgctttccggctgcagaggcacagttcagtagttgccaaggagactgaagggccctcaacatctaaaatacctcttatctgctcctttaagaaaaggctggccaacctctgatccaattcaattcaggagggatgtgatcagggaaggcttcctggagggtgacaacgtaaattttccttggttaatattgactcttgcatttcagagttattgaggaggatgcttggatcggcaggttcgggtaacagaaaggaaataagcattgccatcgacctctatctgaatcaaatcctacagcaggcatcacagaacggtggctcatgggcccagaaacagtctgcaatctaatttgatatgaacctgtggtgcttaaaaaacacccgagacaacattggatggctgggatacatcataataaaccgcctttccggcttctattaaaaactctgacgatctggcaaccctgggcccacccttcccatggagaccccttttgctggggtacctgttctccagatcaccatgagaaccttttcattcccccctttactctatgtctacagcctctgctctgatgctatcaaaggcctctcacacatattcttggttccctgccaacccaggcagacaaggcaagctgagaaaactaaagttcagagaggtcaagtgactttcctagggatagccatctggtgaatgataaagctggaccggaacctgagcctttgagtctagctcactgtccctcttcagacatacaaacagcggaatgagtcattgctacgattttactagggcactccatagtttgaatagctctttttttttttttttttttttgagacagtgtattgcccaggctggagtgcagtggtgcgatctcggctcactgcaacctctgcctcccgggttcaagcgattctcctgcctcagcctcctgagtagctgggattacaggcatgcaccaccattcccggctaatttttgtattattagtagagacggggtttcaccgtgttggtcaggctggctcaaactgctgatctcgtgaacagctctttcacatatacgagtccagattggaaaatgcagaccttggatccacggaggccacgtaaatattgagtggcatatggtcaccaaaggactgacaaggcaagaggctaaaactccagaaagataaggactagaagtgcatctagtctatctcaggagtcagagtgggcaaatctactgaatccaacaagcactgcttaagtgcctgctggaatcaagacaaagaaagaggcccagctccccatctggggcttagaatgtcacagggagggtgttacctgtaaagtaacaacgtaagaccgactgtgtttctgcaagactaaagggcagagacagctgaaacttcggtggcctacatggcagatttaaggacttactcagggcacaggtggagacgtggatttaagtgagtatgagtgatttttttcggggagtagatgatgggtgaaccatggcccttggatgatgtattcgtttcttgccagctgccataacaaagcaccactaaatggcttaaacaatcaaaatgtattgcctcccatttctggagcctagaaatctaagatcaaggtgttggtagggttggttccttttgaagcctgtgagaaagaatgttccatgcccctctcctggcttctggtggtctgctgggaatcttgaatgttccttcgcttgtagatacatcatgcccctctctgccttcgccttcacaaagtgtcctccctgtgtgcatggctatgtccaaatgtccccgcccccccccactgtttttttgttttgttttgttttgttttgtttttggcagagtcttgctctgtcacccaggctggagtgcagtggctcgatctcggctcattgcaacctctacctcccaggttcaggtgattctcctgcctcagcctcctgagtagctgggattacaggtgcatgccgccacacctggctaattaaaatgccccctttttataaggacaccagtcatattagcttagggacccccccgcttctagtatgactgcatctttgcaaattacatctgcaatgaccgtctttccaaacaaggtcaacttccaatgtactggaaatcgggacttcaacatatgaatctgggggcaggagaggggacataattcaacccataacagatgacatcctcaaagtcactgggaagcatggcaacggaggctgagatgctcaaggccatcctcgaggctcctccccacaaagggtaaagacctgggttctccctggcctttctgggcagaatgagagtccccagaggttctggtgctgttggaaggatcctaagcatcaagggaaggggtgtggacaactccaggcctccagcactgagagcaggagggaagccctgctccctcctcattacactgtggaaaacagaaaactcaatttatttaagaataaacaggctttaacctgaagttcattctcccgctccatgatgctttagcatctacatgcaaccgcagctgccagcatcatgccccggttgcacagtccgaaggacctatattggaaaaataatggcattttctcaacaaattatctcacagctgaagtaataacttgtttaaagatacgccaattcagattttcatccccttaacctgccactaaaagaaaagcggtgtcatccccatggcaaaacaggagcagtttaatcacttctgcacccctgtcctccggccctcgcccccaactccagcccccaccaccacccacagctgcacgtttattaattttaagccattgacagagtctctttggaaaccatgtttttttacttctcaggtcaacatcctccagctctgttataataaagtacacactgccagagataaagcaaatatttctttgggaaaggaaaacaaaatagagtggctgtgttttcaacacaatcgctaaggatccagccagcggacttcttctccaacagcagccatcaggctaactggccctcaccaggcttctcatttatttggcaacaaggaaatcacagcttcaaactctctcctggcaacagcagctttctcagtcttcggccaggtagacaggaaggacaggggctgacagtgaaaggaatgctgggagacacatcaagcattcaatcaacaaacagtgggtgcagctgaccctgtgcctggcactatgctagattctaggtacctcagtgactaacacaaattatagtacctactgtccccaaagaacttgcagtttaggggctgggcgccatggctcacacctgtaatcccagcactttgggaggccaaggtgggcagattatttgaggtcaggagtttgagaccagctagccaacatggtaaaaccctgtctctactaaaaatacaaaaattagctgggagtggtggcacgcgcctgtaatcccagctacttaggaggctgaggcatgagaatcacttgaacctgggaggcggaggttacagtgagctgagatcatgccatcacactccagcctgggtgacagaaagagactccatctcaaaaaaaaagaaagagagggagggagggagggaggaagggaggaaggaaggaaggaaggaaggaaggaaggaaggaaggaaggaaggaactaactaacttgcagtttaggaggagacacaggcaatgaatcaacccatcaaccttcaaagtcagcttgtaatgaaagccacgagtgaaagaaacaaggtgtggagttagagcgaggaaggccagccggaggaggggacacctgatctgaagtttgaaggacaaacgggaatcaaccctatattgggaaagtagtaaccctatactgggaagaggaaaaaaggggaagaaaaacagaagtaacagccagggggatgacataatccagctctctctcctctgtctctctgtctcactctctctttcatacacacacacacacacacacacacacacacctgtctacaatctattcttcagagtcaattctttaacattagtgtttgacaaaatgcaactctccctggaatgaattccaatcagccccagctcagtgtggatgagttttttcagagatcatggctggaaagcttgcaagggagatgatagcacatagggacactgggcccttgggctggaggatgttacaaaggaaaagggacgaggaagcaagggaaacggacttcagatcaatttccaaaacttccaccattctgccttgaggttgctgggaatggagccacccggggtgggagagtcttccagaaaagccagacggacttcctgcaagttcaatctctgcctaaatttatacagagagatatacttatgggcacatatttagcatttgcaagctgaagttgtggaaatggcacaagaactggccagggcaactttgagcttaccgatgtaactatgtgtagtgttctgcaactgagttttttgaggaaagggatggcttcttcaacatccttttctatgttcccgggcaggtaatttaacctctctttgtctctgttcctatatctgtaaaatgggaataacatcatccccacctcaaggagctgggaggggtaaattttaaaatgtatgctaagcactcagataatgcctggcctagttgttcaatgaagggttagtggctatggttattattattattattattattattatatcaacttccacaacatttaggagcactaaacatttatggaatgtttcttggccagtcagctcctgcttaaaaaattattacagaaataattagaaaataaaataaaagccataggcccaaagatatttacaacattatttatttagaatatcaacaaaaatctaaatgttcaacaattgagcaatggtgacattaaataaggtgcatcaacgcagtggtgaattatgcgctaattagcaggatcagcagagagatgacagaaaagctttaaaagtgtttctaggctgagcgtggtggctcacgcctgtaatcccaacacttcgggaggctgaggcaggtgaatagcttgagcccaggagttggagaccagcctggacaacatagcaaagccctgtttctacaaaaaaaaaaaacacacacacacacacacaaaaagttagccaggcatggtggtgcacacctgtagtcccagccaaccaggagactgaggcacaagggtcccttgagccggtgaggtcaaggctgcagtgagccgtcattgccccactgtactccagcctgggcaacggagaccttgtctcaaaaacaaaaacaaaaaaaaaagggtttacaaagcactattaagtgaatatgaaaaagacgaagtgtacacagtttaaaacaatgggtataaatacagaaagaaactgaagatgtgaaaattgcagttgggttggaatggtgggttatggataatgttttttaaaagatagtttacaacatgagaaaatacaaaataaactgcttgtggaaaaaataggattcaaacctatgaggggtttatttgggggctgttggagcatacagttcctcctttaagacatggacaaaaagaagctctctctcttgtctccatggcaaacacctaaatggaaggtgaaaatgcccatcattaagctctcttgatattgagcttgtcttattctacatacatgggtgtttgttttactatatccttttttttcttttctttttttttttttttaagagatagggtcttactctatcacccaggctggagtgcagtggcatgatcacagctcactgaaacctcaacctcctgggctcaagcaatcctgcttcagcttcctggaaagctggaactacaggcaacttccaccacacttggctattttaaaaattttttgtagagacagggtctcactctgttgcccaggatggatataccctattttctgatgaattaatagataaatgaatcacaaaatattcaccaggtgcttatgacatcaaaggcctgtgcggaatgaccatcatcccagcttccagagtgaggacctcaaatatgaagacgatacacagagacaaacaagtaactgatggtaataagccagccacagctaacacttaccaatgcttcctgcaggccagggatcactctatggattttatgggaatacctccctttaatcctcatatccagccttggatgcagctatagccatttgacagatgaggagacacactcacaaagggcaggcgtcttgcccaagtcatacaaccagtaagcggcaaaacctggctttgaacctacaaatcttctgccagggccggcgattttaacacctggattagtctgttttcacgctgctgataaagacataccagagactgggtaatttatcaagaaaaaaaggtttaatggactcacagttccaggtggctggcgaggcctcacaatcacggcagaaggtgaaagtcacgtcttacatggcaacaaacaagagagaatgagagagcttgtgtagggaaactcccctttataaaactatcagatctcatgagagtcactcactatcacaaaaacagcaccagaaagacctgcccccatgattcaataacctcccaccgggtccctcccacaacacgtgggggaatcatggcagctacaattcaagaagagacttgggtgtgaacatagccaaactgtatcactactctactgcagaagaagagccatgaaagctgttcacagcaggagaggcaaaaggccctttcctcaaagcccatctgggaatacctcacccttgtctcttctccagacacaattctccattgagagccgtcctccaagacctcaggttcataagggctagaagagcagcttgaaacgctggacttgccctttggagccagaggtcaggccaggtgggagccatccactagcaggttagagacaacgagattctctctgtgcagttcagaccacagccacagagaattatttaaacccctcctgggaaaccgcagcaacgtcagacagattcaatgtgcataactgtatgtgtgtgtgtctatgtgtggttggggggggggctcagggaggaggtgtgacaagcctgagtgacccaggagggactcagggcccaggaagggtcggatactcctcccccatccaggtgggacacagcgagctgagcagcccctgatgaaaccaaaagagtctcagatcctgtcccttttcctcctcagaactcagagcactggatcctttgttcagaaagcaagagaaaacaccaacacaattcctgctacagctgaggatgagggcgtggagcaggtcacacagacatactagcaagcctgcaaagtcaaaaccgtaacagccacagtaactgacacacgtcaacaactgacctggagccagatgttgccccatttaacctccaagactctcctgtgaggtgagaaccatgatcatccccattatacaggtgagaaaaccaaggctgatgggaattcatcacatggtgcataggaagcaaagccatgtttcgaatccaggaagcctctctgtcttaggaagacacgcacccactcatgcatgcaacaacagatgcacaagtaacagtcagagttggccaggcacaggggcagttgcctgtaattccaacaactcgggaggctgaggcgggaggacgacttgaggtcagcagttcaagaccagtttgggcatatattgagaccctgtctctaaaaaataaaaatttaaaaagaaaaacattcagagttgtgtacattcacaaaaggcatgcaaacatagcatagggatagaaatacaggcataaacgtgtgcagagagctgcaaccacgcgcatctgcccctcttctccaaataagggctgcctctttgcacacctctgagaggtgccctccacacagaatacaacatacacttgtaatattgccacacacaagcacataactttctggagggatgactcagattagaaaaacagcatttagagggcccctggttaatcaaacggcctcgccaccccgcgccacctctctacacagctgatgttgctgatcaatgtcgcggctgtgcagagggggcatttgataccacaaagggagccaactcctgctgaggaatgaatgtggcgcttgtcagctctgccccaggcagcagcacaacatgatgccctgtttctcctggaatcggggccctgcgtccgctccagccctcattttcatgtctttcttcccaacagacacaaggccggctcagttctggagaaacagcgtggctgccaaggcccagtggagggagaaggccttgaaaagtcactttataaagcatccgtgctcgcagcagccaagccacgaggccggagcggctgactttccattcgccacacaccccacccaaagacgagaactctgccacagccagcccttgttctcacccactgggagccctggggagttgaaatcacagggacagcagcagggagcccttggcagcaaacccagctcctggcatcttcctcgggggccgtagcttgctgtggtcagccgagccagtctgatgcaagaactgaatgacgcccattcactgtggtgccctcgtgagctgggagatgtccaggctgaggctggggcaggcaggctctctgtcacctgcagaggctgagacaacctcaaggtaggacgagaacccagggttgaagctagcagaagccaggccctggggcccctgatgcatgatgagagtgaaaagaagggcacagtgatgtaaagaattcctccatttcccctccctgccctcagttacttcctatccatacagaggggggatgaaaactttaagatttcactattcagctgagactggtgactcacgcctgaaatcccagcactttgggaggctgaggtgggtggatcacttgaggtcgggagtttgagaccagcctggccaacatggagaaaccccacttctactaaaaatacaaaaattagccaggcgtggtggtgcatgcctgtaatcccagctatttggaaggctgaggcaggagaatcgcttgaacctgggaggtggaggctgcaatgggctgagattgcaccactgcagcctagcctgggcaacagagtgagactctattttataaaaataagagactccactattcatgcattcacatgctcattcaacaaatattactgagcacctactatatgatgagtgttattgttttaggcactgggagtacattagtcaaataaatagtcaccacctgcatgtagcttgttctcaaaattctcaagctctcccaaccctccccataatgaacagctgtgtgacttagagcacactgcttcccctctctgtgctccagtgaggtctctcccagggttcctgtgaatcaccatctgggatccagtaagctcccccatggggcctaaactagactaagttggtttccgtcactcacagccagaggagtcctgcctaagaaattgggaaagagagcggagaagacaaaaagcaggtttgggaaggctgcagggagctgatgagtcatttgatcatctggaaagcagatgggaagacaagtggagaccaggaggccctggggaagagaagctgtgttcacgccaaccttccccagcaggcctcagaagctgggggtcaaaagggaccacaacgcccatttaaacaaggaggaagatgctgaacagctaaagggttaattcaaaagaaaaaacaaaagaagaaatggccatttcttttccttgttcactcaatgttccttcaacaaattattctatgtgcttggaatatatgaggccctgggttgggtgtggtatgcaacagaaaaataaaacataagaacatagtatgtctcttcccacagggtcatatggtctttcgaaagtcacccttttaatttgaaaccttttgctgcttctttatttttattttttaatttaatttttttgagacagagtcttgctctgtcacccaggctggaatgcagtgacgcaatctcggctcactgcaacctctgcctccggagttcaagcgattctcctgcctcagcctcccaagtagctgggattatagacccctgccaccaccccagctagtttttatatttttaggagagatggggtttcgccatgttggccagcagtcttgaactcctggcctcaggtgatctgcctgcctcggcctcccaaagtgctaggattacaggcaggagccactgcgtccagcctatttattcttattttaaaaatttatatatatgtgtatatatataaggggtataacacagcgttatttttaaggaataagagatattttgcttttcaaagtgcctgctaagcccagtgacatacgcttggttagcaatcactaaatgtggacacattataaatcctctatatattttatagagatggggtcttgctatgttgcccagtatggacatgcgttcctgggctcaactgatcctcctgctcagcctcccatgtgctgggattataggcatgagacagcagcactcagtctctttgtttatttctctgcctgctccccacccatctgtgtgacccctactaaaataaccactgcatggtgttcaaggaagagtatggccttgggattcaggcaggtctgcattctaacccagggccttctaccttctggctatgtgcccctgagcaagtaacttggcctctgctatggcttagatgtgtgtcccctccaaaccgcatgttgaaatttgatccccagtgttggaggtggggtctaatgggaggtgtttgggttttgagggtggatccctcatgaatagatcaataccctccttctattagttctgcaagagctggatgtttacaaacagtctggccttcccctccctctctcttgctttcttgcttacctgtaatatctgcacatgccaactccccttcaccttccactgtgagtgaagctgtcggaggccctcgccagatgcagatgcctaatcttgaacttaccagccatcagaatcacaaaccaaataaactttctttctttataaactacccagcatcagatattcctttatagtaatacaaaatatacgatgatagcctctcagagcctcaatcacctgccctggaaaatgggtacaacaccgagttctttttaaggaataaatgatgttttgcttttcaaagtgcatgctaagtaagtgcagtgacatacgcttggtaagcaatcattgagtgtgaacatattataaattctcatgaaatctaagaggcaaagccctgggaatatcacaatattgatcttctaaagtcagtatcagctttctcatggctcagactcactcctgagttttgtgcttggatacttaacaattgctcactcctaaatttcctaactagttccagcttcaaactggaaaaattcctccagtgtattcaagcctcgttgcctagcaccacaatatccttggttgatgtgcttctaggtgctaaaagaataggccggggatggtggcttaggccgataatcccagcacttttggaggccagggccggcggatcacctgaagtcaggagtttgagaccagcctgaccaacatggagaaaccccatctgtaataaaaatacaaaaattagctgggcgtgctggcacaggcctataatcccaactactcaggaggctgaggcaggagaatcgcttgaacccagaaggctgaggttgcggtgacccaagagatcgcaccattacactccagcccgggcaacaagagtgaaactccatctcaaaaaacaaaacaaaacaaaaaaaaagagtaacgagtgttagatattggtgggggtggcatcagaaggactttgtgtgacattcccaggtctgttctgagcgcaaaggccagatttagacagcgttgagaacccaaatgaggctctagaaactggtccaaacaatgtgcccataatgacacgtgtcaaaaccgaagaaggccttagtcaggggaaaaaagatgcaaattacaaagacctttttcagagccaccaccttctaaaagtgaacagaaggagcaggaagctgccaaagtgtaccagaacctcctccttcgacgctagaaagagtaacaggtcaagctccaacttgcaattcagttctattttgaagtttactggaaagcagaaaataagaagggatttgagagaggccggcagtttgaaggcaaggaggaactgaaataaacacattagacccaagaacacaaaagtcctagcagcttggacctgctatttctcgacagttcctccaggctcctcatgcataagccaatcagcaatgatgtgcatatttcagcaatgatgtgcataatattgatcttgaaccacagcgatcttcctagttccttttgccaggagaaaagatgggggtggccacacatttgagaaagaaagtccattaacattacccaagttggttttgaagtattgagacacttttttttttttttttttttttagatggagtctcactctgttgccaaggctggagtgcagtgacgtgatctcggctcactgcaacctctgcctatcgggttcatgtggttctcctgcttcaacctcccgagtagctgggagtacaggtgcccgccaccacgtccgactaatttttgtatgtttagtagagatggggtttcaccatgttggccatgctggtctcgaactcctgacctcaagtgatccacctgccttgccctcccaaagtgctgggattacaggtgtcagccaccacacccagctgagacacatttttagggtgtgtgtatgaccgagttttatggttgcaaacaaaagactccatgctgcccagttcaggcataaaaagaatgtcctgaataatgcaagatgatgtataggatgcttggacaaccaaagccaaatgtggaggctctgctgtgggtgatcatgtcccaaccacacggacactgaccagcacagaccctgtccctgctgctaatgagttcacactgccaccaccaggcacagacccaaatccttgaccgctgctggctgccccttttgccagaatggattctgtaccaggctagtttccccacataacttgctctttcaggaaatccaaaagtattgatacaaaaggtgtattagagccataagtgcatagagagaaaagcgggtacattaagctttgattctccactgcctgttgtaatagtttgttttcacgttgctgataaagacacatccgagactgggcaatttacaaaaagaggtttattggtctcacagttccatgtggctggagaggcctcacaaccatggcagaagatgaaaagcacatctcacatggcagcagacaagggaagagagagcttgtgcgggaaatttcccttttcaaaaccatcagatctcatgagactcattcactatcacgagaacagcgcaggaaagactcacccccatgattaaatcacctcccactgggttcctcccacgacatatgggaattgtgggagttacaattcaagatgagatctgggtggggacacagccaaaccatatcacctgtcattacttttttttttttttttttttgagatggaatctcactctgcggcccaagctggagtggtgtgatcttggctcactgcaacctctgcctcctaggttcaagcgattatcctgcctcagcctcctgaatagtttggatggcaggcgtatatcagcatgcccggctaattttgtatttttagtagagacagggtttcaccacgttggccaggctggtctcaaactcttgacctcaagccatctgtccacctcagcctcccaaagtgctgggattacaggcgtgagccaccatgcccagcagcctgccattactttcattagcaccaggcttcttgcatattttacagattgctgtcaatggtctaataaacaggtgtgttaacacatccagcagtaaagaaccggggccctcgaacctgcctgcctgggtctgaaccctgctccccagcccttacttgctggaagaccttgggcaaattattcaactcccatctgagaatattattcataacagcacccacctcatgggccagttgtgaaacttacagaagtcaatttaaaccaaggactgaacatagtacttgtaatatgagtttgtacaaaagtatcagttgctattgttgatgttgataataaaagctaaaataacattataacccccttcatggtggtagtttcttcataagctgccattaaagcaaagagctacctacttaatacaatttgctccctaattaattaattatatctaaatttcattgtattgtgtcattctacaaggaatgctgctactatcaccttgggctgctaaaaaaatgcccagtcactaaaaaaaattgcttagacggtattctctgtcatttctcccaacgaataggcagtttattattttttgaagaagtcttttggctgtgacaatggggcctcataacaatgaattgagaacaatcacttccaaacagcagctgaaaacaccccttggttgcctctgagtttgggggtcactgatcaagagggtgacttttctgggacctctgatctcttaatagttgtagttcaacaagagcagttgtggtacattcggcttcaccttcatcgtgggagaatgaccagatgcctacctggttttaaaccacagtcaggggctccggaaactgtccaagaagaaactccggtgccctgaaggcctctgatgagcaacagagttaccttactgactgatggacacagttaattcagctgctaactctcaaattctactgctgactcacaatccggctgcccatcactaggtggcccggaggcctaaggtgaaaaggatgttgtctttctctgggcacattttcagaaagcccatttaaacttcttggtggggcaagagggggcataaaagggggaacaagatcttccacattgcaatattcatgttttaattagcgagtgtccagaacctcatatcaacttgatttgaagggcatgtgtaagaagtatacctacaactccttctctgagccccaaaatggcccccaaaaacgctccgcacagctcctggggttgaagatcctggtgaggtgcagtttgttctcacagccaccgtgcagcccaggtccatgtgcatgattcacacgagaaactaggtgaatagcactcctgggggtgcagaggtatacagggcagaacctggcacacagcaccaggtccacgtgagggggtcctggcgcacacacacgtacacaaacacacacaaaccccacacacataccaaggattccagaattctgggcttaactcagcctagactctaccacattcttcattctgtagttagaggccaaaataaaactcgtgtaaacagattaaataccgtggtaaccaaattcaaaccaaacaccaaggattgggtggggggaggggaaatagtcttactttgaagcatttgggggtgtgggggtggggaagaaaagaggtaaagaggctctaaagattctaagacatcaaagttcttttcctgatttcccagtggaaacaggacagtttcttatactaggtctcccagtggatcaccatccaccatcttggaaggcagcccaactgactgagtcccaaggagacctaacagagatttactttcccaaacaaggaatacttcaataagggtgtatctacagttagagtgcttaattcctttccgagatgttttcctaatggcagcactcctggggagagtcagaagaatgtgtaactggtcaaatcctgaacctgatttgcagtccagcccatgttcacaatgctcgtatctgctgagcctctgacttctgcgaccaatataggccaagtgtgtctggagagataatacatatagccacactccccaccttttcctcaagactagtccagaccacaagctggatgaggtcaaaaactatgtctaatttctcaccattgtatgctcagtgcccaggctggtgcctgacacgcagtaggcagtcagtgaatacagcccaaagagaggtatggccacagtcatcctatttgtgcccccgggacctggtactcaaaaaagaagtaacatatctgatgatggtatacaggcatgcatcaatgccacacactgtgcactgaggggacactgggctggcttcacacccttcaaggactctaagcagtcatgctgggtacccacacatgagcaaggaagggggtgttctgtgtgttttcatagataatgcatttgtctatttgccatccattcatcacatggctaattagttcaactacactttcttattttttgtcatcatttttttttttttttgagacagggtctcactctgtcacccaggctagaatgcagtggtgcgtggtgcaatctcagctcactgcagcctcaacctcttgggttcaatcaacctcagtgttcggagtacctgggactacaggtgctcaccaccatgcctggctaatttttgtattttttgtagagatggggtttcgccatgttgctcaggccggtcttgaactcctgggcttaagccatccacctgccttagcctcccaaagtgctgagatgacagattttctgtattgtagatgctctagcattaggggttttatagacctgggtaaagacatcccctcccagttctagcccgttcttagagatagcaaagggctcaaccaggagcaagcctctcacatgcaaaccaacaaacccagagtctataccccctcagccatcaccatatctaactctcacacaccaagccaattttcccccgccctaaaccaacctggggccaggtagcaggcagctagagacccctctagagcccaaagccctcctgaaattattcaagccggtcaatcccaaactgtttgccctgccttgcctcacctttcctgtgggaaccccagtaaaggttctggcctagattttctccttactcctgtcttctgcctccaaaccaaaaaaccagggcctcctgctgtggccctgcaagcatgctgtgcctcttctttctagggaaactgagtcacactaaactttcaagggcattgacctcactgtgatgtcacccagacatctctatttatttatttggtgggctttatttctatttatttgacctcgctgtgttgtcacccagacacctttatttacttattcatttatttggtgggcttcatttatttgtatttattttttagagacagggtcttgctctatcacccaggccagagtacagtggcacaatcatagctcactacagtctcgacctcctgggctcaagcaatcctccagctttagcctctggagtggctgggaccacaggtgcacaccactatgcctggctatcagacatctttataaattaagacccaggcacaaaacgagacggacccgtggatgagtctccttgtaagcgccttgctttctccgcttcctcccacactccactgggcacccacaggaagccctgacacacataatgagaaatgagcaaaagggcatttctgcaaagggagatgaaaaacaaatcttagaggagtggcgagtgtcctggttaaggctatggagccaggcagcctgggtttgcttgaaggtcacccctgccaccacctcctcactgtgtgtaccagcgcagcccctcaccaccctcaactgccgtttgctcagttatggaacggggaccaggacaacacaagatgctgtgagattaaagcgcatgaatacccaacggggccggcatgtggtgagcactgtgtggacggtaactgcgatgattcctcactctgccttctccaagggaatcagaactgcagaccccccgcagagaaaaacgatcacaccctttattcagcacttcccgcgtgtctgacacacagcacccacagcctggggtataaacaccaaaaaccaccctcacaggggcggaatgatgttcattcccattttgcagaagggaaaactgaggttcagagaggttaagcaggtttcccccaaaacacaaagctggaattggtgcgtgcagccaggatttctgactccaaaaactctcctctcctctccctactttcaatctcccccatttctgatcccctcccctccactgcaacacatatatattgagtgcctactgtatgcgaagagctggtgcaggagttgagaacacagcagtgagcaacactgctggaatccgagtctttatgaatcctacaggcagcaggaaagaggtcattgaggggtaatctcagaaataaatggaggccgggcgcggtggctcacgcctgtaatcccaccactttgggaggccgaggcgggcggattgcctaagctcaggagttcaagaccaccctgggcaacatggtgaaaccccatctccactaaaaaatacaaaaaattagctgggtgtggtggcacgtgactgtagtcccagctactcaggaggctgtggcaggagaaccgcttgagtccgggaggcagaggttgcagtgagctgagatagcaccattgcactccagcttgggctacagagtgagactctgtctcaaaaaaaggaaaaaaaaacccacagaaataaatggagagttcagatggggatgagagctatggaggaaaaggagaagctgctgtggtgagcaggaatacgagattccatttgctgtgcatgcagtgtgtcagacacacgggaagtgttgaataaagggtgtaatcatggaatcaaatggatccctgatcatggatcaagaatcacagacagcttctatggggaagaacattctggaaggaacagcaagcatgaaggtccccaaatgggacaggactggatatgtttgaggaactaccagaaagtcagtatggcagtgacacagtgacaagagaaaagcaggcaatgagaggagagcagaggtcctaccaagctcggccctcccgacaatttgggttggatcactgtttgctgtggcgctgtcctgcactctgtagaataagatgtttagtggcacccctggtctgtacccactaaatgcctatacagctcccgccctgtcctgccaaccaaaaatgtctccagacattgccagataatgcaccccacatcccttccgggataaactgtgagactccacggcgatgctatttcagggacaaaaagaagcctgtgcttatggaacagaaactggccttgccacgacctcattagtggagaggatgggccccactcatttgggggaattatttggggaaaagtataaactccctagctcagcagactgcgagctccccatgaaaggccatgtgtcctggttcctcacacggggcctgagatgcgaaagcacagagggtacctgggagggactgagaaaggaggggactgtggggtccagtgggcacatccctatcacaatcagcctgtgcagctaggaggctgccacgcacatcggcagactctggctttcaaaatgaccctggaggagctgcggctcctgctggcatgtcaatgtcaacagcctttaccctccccagctcctggaatgctagaatttagattctcagttctgcgggagagcaggacagatttacggaattctcagcggctgcctccaccaggggttgccaggggcaagcatctgcaccgtggtgaaacatctctttgaacaaggaagtgagagtgagcatgtgcattaactatcggagatgtgggggagaggaggaagccatgcaaatgagcacggacagccagcagagacgtttaaccttggtgctgctagagtacccacaagtgctaacgaggtggctggtgttgctttaataatcaaataataaccaggcaatggtttagatccattttggacccttcacaattcccaggactacacttaacagtttggtaagactttatggatagcttgcaagtttgaaggcgtaactttgtaagctcagttttgaccctggaggaaggaggtcatgagtaagatagggacaccaaaaagaagtcaggtggtatgctttttccattgactcacagtcatttccaggagaaaagaaaacatcactgtgcaaggctctactgactctcttaatttatcctcacaacagcctcgtatagtaaatattatcctattttacatgggagaaaaatgaagtttagaagcttgggaaatctggtcttcattatttggctactaacccttagtttccatcacaattccctcattctctcagctctagtctagtctggatccttttgcagtcctgccccaggaccttggcacaggttgtttcctgtgcctggattactctgacctcccttcttcacctggttaacgcgacttaaccttcccattcctgcttgctcatctcccagagcctcctctgggctttttccaggccaaactactctaacaaaagctctcttagcatcaagactgctgcttctgcatcaggactcttcaaagttacaatttaacaaagaagccggcgtgtgctagttcaccaccgtaggcatatgcgtcagattcaagatggcttcaaattctttgacatgcctttatcgaaaggtagtgtcttattcccctcctcttgaagccaagatggccttactgactcagctgaccaattgaatgcagtgaaagtgatgttctgggaattctaagcctcaatgataacatacatacctttgcagctcctgctggacctcttagaatatttactctggggaaactccctcttggaacccagccaccatgtggcaagaagcccaagacacacaggatagaccatgtctgatgcagccaacagctccagctgagctccccccaacaaccctcaccaactgccaggcacgtgcatgagacaccttgagcaaccaccacagccaaaccttcagatgatcacagcccactccatatgtgtcagtaacatatgcagaaatccaagaaagaaccatccagccacgtctagtcagcccacaaaaccttgagagatgatactaaagcactgttttagtcattacgttagagaactatttgttacacagcagtagatgatcagaaccctgtaagatccagcataatgaacagttgttcagcttgtacacaccttaggcagcagctaggactagatgcttaataaatatattatttatggattagacaaagaatgtagtgtgtgaaaagattaaggtggaggctggatttatacccgtttatataactccaagttcctcctctcttttctttttaaccatagcctaatgctcccttaaaaacaataaaaccattttatttccagcctatcatatttgatgcaggtttgggaggaagaatacaatattcagacagagccatgtcacaacaaaatggcagctttggttgcttgtcatgcctggaaaaaagttcagagttaaaaaaaaaagtagcttgaggctgggtgtggtagcttacacctataatcctagcacttttggaggctaaggtgggtagactgcttgagcctaggagtttgagaccagcctgggcaatatggcaaaaccctgtctctacaaaaaatacaaaaataagccatccatggtggtgaatgcctgtagtcccagctagttgggagtctgaggtgggaggctcgcttgagacctggacattgaggctgcagagagccatgatggtaccactgcactccagcctgggtgacagagcaagatcctgtctcaaaaaataaataaataaataaaaaggctgttcttatgtcattacactcattgacagcacaggggtctctatgccctctctgcagttatagcatgagcgctgctgtaggcgatatctaaatgaatgggtatagctgtgttccaataaagctttatttacaaaaacaggcagtgggccagattcgcccaaccctagtacacagcataatacagtggtctttcaatttagcagtaagcacgcagtatagggaaaagttaatccacggacctctttttccttctgtaaattgaaagagagggagcctgcttcctttgatttgagtatggaatgaccttggctagttcgtgaagccatccatggtggtgaatgcctgtagtcccagctagtcgggagtctgaggtggaaggctcgcttgagacctggaggttgaggctgcagagagccaggatggtaccactgcgctccagcctgggcgacagagcaagatcctgtctcaaaaacaaaaacaaaaaaagatagactgctcttatgtcattacactcattgacatagctcaggggtctctatgccctctatgcagttatagcatgagctatagacaataggtaaatgaatgggcatagctgtgttccaataaagctttatttacaaaaacaggcagtgggccagattcgcccatccctggtacacagcataatacagtggcctttcaatttagcagtagccacgcagtttgtaaactcaatgaaacaggcaatgcctttgactgaaatgactcttggtactttaattttgcattttagacaacatctttcactgcattttcacatgctgaaatgggttcagatttctaaaatataagaaaaagttacagtaaaacaaaacaaaacaaaaaacacttaatatagggaaaagctaatccatggacctctttttccttctgtaaattgaaagagagggagcctgcttcctttgatttgagtatggaatgaccttggctagttcatgaaggcaggaacattccatgagacaggagttaggaaaccactgggtcactcatagcaaggataatttcccctcactggccctcaaagaactatttgttgataaataatgaatccaaaatctattggaaggagagtaatccactcattactgttagtccattcaatagggctcaatgactgggtgaagtttattcaaagcagcaaaatatcatctaatggcttgctcttttgtctttgtaggatcaagcctttcatcttagaaagtgctacccacgttatccaaaactagcaaaaataatttaattaatgtgtatataagccacaagtgcccaaattatagcttgtgcccaaaccctaggtaatgctagagttatacacataattttttaatttcgtattttcaagaaatgatagaccctataaattatatttttaaatgagccaggaagtaatggctaatgttaattcttaggcaacagaaacgtgctacgctaattattattagcaataatggctcaatgggtaaagaacttctgaactcacaaagcaatttttaaaaactgtattgcattgtttcatacctaaaagagtcccagggttaggtaatttttttcattttataggtgaataaagggagacgcagggtaggtacctgctcatagtcatagctaagtagccaggactcggttgctatccaaggcttcttctatctggaacacttcaagagaacaaggcaactcctctccaaatataattaatatgcaacctctcttcctattattctttgtgaagtttagcactatccaaaaaaatgtactaggctaattattcagatttttttttgcgaagggtgcaaatgttctttctattgaatgtgtgtgcatgtcatttattacaccatatttttaaagggagactaatgcccaataatgaccccagggcttagctttgaagaaaattccaaccaaaaacatcaccttactgtctgaatctgtctccatttcagcaactgaatctttgttgctggactcaataaaacacacttcagatttctaatgcttggatgggagatgagttggtccaagctagatcctcttgtctttgggcccacaccaaacaccaaacacgagtcaaccactcttgcaccaccacaggtatgcatgtattaatatcggcttcccttctgccacagctgtgacttgtgttgggattatttctactccgccagcttgtttaccttattagagtaaccttacagctcaatcattaggactccatggagaagccatggaaaatcaagactcagacatatatttcgatcttaggagaacatgcctgtgctttgtctgtcattattctttttatgggattctaaggcagtctaagataggagaatcactacaaggctcctgaaaaatccctgccaattaaggagtgacagactgcattttccaaagatgaccacagctatatttcctatcccatatgctcttctgcaaggtgactttgccacccccatcccttcaagaggtgggacttatttttcccgtccttagaatctggacaggccctgtgactgctttgagcaacagaatatggcaggagtgatgctgtgccagttttaagtgtagcccttaactttatggcagcttccaccttcctgcctgctggaggccagccaccacatcagaagtgacactaccctgaggccatccagctgtgagacaatcaagccacaggaagatgcttgatgctacctggagagaaacagacagaggggtcaaggaggaacaaagcaccagacagacggacgataaagtcttagaagtggatcctccagccccagtggacaacacatggagccgagacaaacctcccagcagagcccttcctaaggtcctgatccacaaaattaggaacaaaacaaaattaatgttttaagccactcagttttcagatagtttattatggaataccagagaactgttaacatttttttttcaagaccgagtctcactcaatcacccaggccagaatgcagtggtgcaatcttggctcactgcagccttgaactcctgggctgaagcaatgttcccacctaagccttccaagtagttaggtctacgtgtctggctagctttttttttgagacggagtcttgctttgtcacccaggctggagtgcaatggcatgatctccactcaccggaagctctgcctcccgggttcacgccattctcctgcctcagcctcccgagtagctgggactacagatgcccaccaccacacccggctaattttttgtatttttagtagagacggggtttcaccatgatgtctggctaactttttaatctttgtagaggtggggtctcgctctgtcacccaggctggaatgcagtaacatgatcatagatcactacagcctcaacctcctgggatcaagtcatcctcccaccttagcctcctgagtggctgcgactacaggtgtgtgccactatgcccagctaattttttaaaatttttcatagagatgaggttttactatgttgcccaagctggtctcaaacccctggactcaagtgatcctcccactttggtctctcaaagtgctaggattacaggtatgcaccactgtgcctggcccacaaattttactttattatttttttttggagacagagtcttactctgtcacccaggctggagtgcagtagtgcgatcttggctcactgcagcctccgcctcctgggttcaagcgattctcctgtcagcctcccaagtagctggcattaaaggcatgcaacaccacgcctaactaatttttgtatttttagtagagacggggtttcaccatgttggcaaggctggtctagaactcctgacctcctgacttcaggtgatccgcccacctcagcctcccaaagtactgggattacaggtgtgagtcaccatgcctggcctcacagatattttttattgaaacacaagttagatcttccttggggtcactgcaaatagttgtatgatttgtgtaccgcaaagtggcaaataggggctgaaatccaaccagtgctttgctcaccacgccctgcatcggtgagctctggtcttctgctaagaggctgacttttttagccctgcaaagtccccgtacagactagcagtacgtcgaagcacagtcatccaaatgtgggaccttcaataacgatgacttaagaatttgacggaacaatgtgattatcgttgccagaggaggtttttcttccctgctaatatcctggacacctcgctgggcttgccaactttatctggtcccttcttcctctgccccaagattccacccttaaactggagtaggtgctttcactgcccagtggggccgcccttctcggcaggcctccccagcagcgcctgatgtttcatctcatgtgaaattgccccaaaacacaggatcagctctgcactgggccatcactgccactcctcaggggcagctgagtctcctccctgtggccttccaacaatggctggcagtaaggctcattcagaacccattaaggcgattgttttttcctcaagggcacttccttgagggctgaataccaatcagcctgcgatacaaaggaggggccccctgtcatccttgggactgtgcagtggctctgtggggacaatcccacgtgctgtcctccctacaacctcactcccctgggcttttgtgcaggagtcaatattgattactgttatttctttcttttttctcttttttttttgagacagagtctcactctgtcaccaggctggagtgcattggtgcaatctcagtcttagctcactgcaacctctgcctcccaggttcaagcgattctcctgcttcagtctcctgagtggctgggactacaggtgcatgccaccatgcccagctaatttttgtatttttagtagagacggggttttaccatgttggccaggatggtctcgatcccttgacctggtgatctccctgcctcggcctcccaaaggattactgttatttcatgagatgactacaggctcatcatgccacagcagtggtgacccaggagcaattctcatagtataagcaagtcctatagcaaaatccatgggaacctataggaccgtggccaaagtcatctctgcctcccaagaaggggcaggaagtcctattggcctcatctaaccatttatgcctgttcttacaagctctcaatctgtccatccaacccaggagacactcggtcatcatccaccctttacttcttctgaaaagctgatgcaaataacttgggctttaaaacccaaaaagatctgtgtcccaatccagactctgccacttcttagctgtgtgatgttaagtgactgtctaaacttctctacttcctcacctgtcaaatgaaagcaaggacaccttctagcaaacctgagagaactgaacaagataaggccaagtaggctacaaatggcacccacaagttattccattcggttcatgaacaaacctttcattacaaattccaatacttatgtatttatgctgatgtatgagaagacgataggcttcatgaagaccatgattttatggacattatagcttaggttgagctaagtaaaaagtgagtggatgcaaagaaaaatatgaagtaaataaaccatgaccggggagtgttatgtggatgctgtagaaacaccaagaaaataagataggtggacacagccgggtgcggtggctcatgccgtgatcccagcactttgggaggccgaggcaggcggatcacgaggtcaggagttacagaccatcctggtcaacacggtgaaaccccgtctttactaaaaatacaaaaagtagctggctgtagtggtaggtgcctgtaatcccagctactcgggaggctgaggcaggagaattgcttgaacccgggaggcagaggttgcagtcagctgagattgcaccacggcactccagcctgggtgacagagcaagactccatctcaaaaaaaaaaaaaaaaaaaaaagatacgtggacacacaccccgacactgtaccacatggtaggtacagacatcaccaccacctggcacattttaggtgctgaatcagcatctgtttccctctcctgtaacctcctgtggcatcagcctccacccttgaacttggctccagcctcattagggtttggccaagccttagaagttggaggtggactccctgcagtcttggggacggttcccaacaccagggtggtaaggaggaatggtctttagctttgcaggtcatgatttcccttgaagcacctcgtaaacagcagggctggcccacctcaataaaattttactcagcgcttgcaattcccccaacttccttccgtagccagatgctgccctttgctgtgtgcttaactccccactgacaactgatggcatttagatgcattgtagggtgagacccagaaggctgctcattaacatcgtctatatattttaagagccaagaaaccatttttcttggacctaccaattatataggacaccatgcagctcccttccaaatgtcgacccactctagatagttgaggctaaatcaaccaagaaggtgtattagctttcaccagacccatggacaaataattcttcttacacttctaggtagcaatgtaacattttgcttcccagaaaccaaagctcacatttaaacacatggcacccaagcccatatttcaggaaaggccctttgttaattgttcataggaaagtaatccaatagggtctccaacttcctgctgctgttcattccacctgctgctacacctgggcttatttattccaccctgaatggttttctttcccccagcacacagccaggctggttcctgcctccgtgccttgcccaggctgttccctgagtcctgaatgcccttcctgctccttcctgcctaccaaataccttaaatacatccttcaaactcagctcagatggcgctccctccaagaagccacctgtaacttccagaaagttaatgtcccgccaccctgtgccacttcctacctcgtttagcacgtcatgtggtaccatgaccacttccatgtctatacgtgtattttgccacgagatctgttcccaatgttttgtaaggaacaaagtaagtgagcaatgcatgtctggagaatgaataaattcaggaatcccattaatgacagtatctatctgtttaacaaatattcatggagcacatactaagtgctagggactgaggataccacattaaagaagaagaaaggacagattcctgtcctcatggggtttatgttctagatacggggagaaaaagttacatacaaataaacaagattattttagatagtgataaatttatgacaacaataaaacaaggcaatagcattacggccgggcacggtggctcatacctgtaatcccaccactttgggaggccgaggcagatggatcacctgaggtcaggagttcaagaccagcctggccaacatggtgacaccctgactctactaaaaatacaaaaagtagccaggcgtggtggtccagctactcaggaggctgaggcatgagaactgcttgaacccgggaggcagaggttgcagtgagctgagatctcaccactgcactctagcctgggaaaaagtgtgagtgagactccatctcaaaaaataaataaataaacaaaacaaggcaatagcatagagcagagattagcaaactttgaccagtgagtcagatccagtctaccacctgtttctgtaaataaagttttattgacacatagacacgcccactaagttattgcctctgactgcttttgcccaacaatggcagagctgagtaggtttaacagagaccctatggcccataagcctacaatatttcctgtctggccctttacagaaaacattcacagacctctcatatgactaaggagagaggaaaaactttaagtagggtgaaaagggaaggccactgtaaaaagatgacatttgagtgaagaccagaatactaagaaggtgtcagccatgcaaaaatatagggtaaagcatcccagatagaagaaggaacaagtgcaagggccctgaggcaggatagagacagagaaaggagagtgtggcttgggagtaattaggtggtgaatgatacaaaatcaggcatcatggtaggcagagcccatgtgatggggaatctcacaagctgtggaaagggcttcctgctaacactcatgaataattctgaaaggcagcgaaggtatctgggatttgggcagcaagtggtgaaatcgtgtccacggaagagaagggacgatagcaccaccatcatgaatgaggaagtctaaaatgttgacgcttggctcaagacttctttgccaccacgaacaacatctccaagtcaagctctgccttttgttgttgtttggtttttctgagacagagtctggctctgccacctaggctggtgtgcagtggtgcgatctcgcctcacggcagcctcccaggcttaagcaatcttcccacctcagcctcctgagtagctgggactacaagtgtgcaccgccgcacctggctgatttcttattttttgtagagacagaccctcactgtgttctccttgctggtctcaaactcaagtgatcctcccatcttggcctcccaaagcgctgggattacaggcgtgaaccatcactcccagcttcaagttctgcttttcaaatgcgtcaccccacatccccaacacaaggttgcccaaatgtgcacagaagatgcttctacaacagctgaatcagcatccacatgtatcctacccacactcttttttgtatttaaaagactcactgtttcttctcttacattcgtgttttaaaaggaaccattagttcactttaaaatcacaggtttaataagccagctacatacatttcacttaaatacaaaaaggtttttttttttttaaaacgttcacctgtctaccacctcaaatcatctcagccacactctgggaaacaattgtttagagttcaaacctataggaacctcattaatttcaatccacacctaacttctgacagtactaccggagaggcgggggtttggaggacctttttattttttatttttttgagacagcgtctcactctgtcgcccaggctgaagtgcagtggtgtgatttcggctcactgcaacctctgcctcccaggttcaagcgattctcaccctcctgagtagctgggattacaggcacacaccatcacgcacagctagtttttgtatttttactagagccagaggttcgccatgttggccaggctggtcttgaactcctggcctcagatgatctgcccgcctcagcctcccaaagtgctgggattaaaggcatgagccactgcaccaggactggagtagcttttgaccaggacagtgaggacagaggacagcttgagggtgcagcacaagctctggcggcagagcttacacctgaccctgtcactttccagctgtgtgctcttgaccatgttaaatctgagagcctcagactcctgtctataaaatgagccaggctgaggggctgttgagagaattaagagatgcacctgacttggcccaggacctgacccatgctagatgctcaataaatggtcacagctctgattacaaatgcataattatttacagtcataatgatgatcatcaaaagtcctttggtctctccaaaagtgctaaaagcatctcttgtcatcaatgtgtctgagcttttgagacatctgtagccgcagcccactcaccaactgacatccccttgccgccaggggtttcgggaagctttcggccgtgtggtagttttccactgggttcaccaaactaggtctcttttttcttgctttccttttattttttgtttccaaaaggttcctgattaacaatctttcagagagggaggaggaaagaaattacagcaaatgttcctttactctggtccctgctgggctgggaggctgctatttcagactcaatcagctacctgcagggtcaatggatgaaatgcctccccatagggatcaggaggatgcagggccattgggaagcttccacagggacctgtggcctaaaaaccccaactgctcaaaagactcagggacctcaaacctaaaggggatgggagcccaatttctttaagaagcacccgtctttgaaaagcagcatttctcactctacctctgcagggggaaaggagcaacatacatcccctgaaagtaattaccttcaagttgtgaggatcaaacgccatccttaactggagataatccgaaattcactttgaaaccccctctgtccaagcaggcttaagtctctaactgcttaattcaagaaatcattaaaaatggtctttctttccttgccacaaacagagtaaggtaagagaaagacagccaagaaacctgttgaactgctgatgagaaatgcgacagcaataaaatcactggcccaaaataattctgccgcaggttaactcaacggcaagtatgttgctctcacctccaaggatggcgaattcttaagttcttttgttccaatcaccatcttccagaaatggctacattaagttgtagggcctcatgtcaaacaaaagtggcagcgaggatggttacttctgtgtgttaacttgattgggccacggggtgcccaaattaaacatgacttctgggtgcatctgtgaaggtgtttctggacgagattaacatttgaactggtgaactcagtaaagtacatggccctttccaatgtgggtggttatcagccagtagatggagggcccacaaagagggagagaaagaaatttatttttcttgcattactgcgtgagctgagacatccatctcaccttctccagctcagaccgggatttacattattggctcccttgattctcagacccttggcctgggactggatttcatgaccagctttcctgggtctccagcttgcagagagtagctgcagggacttcccaaactccataatcatgggagccaattcccataataattttttttttttttttttttttgagacagagtcttgctcggtcgcccaggctggagtgcagtggtgtgatcttggctcactgcaacctctgcctcccaggttcaagtgattctcctgcctcagccccccaagtagctgggattacaggtgcccaccaccgcgctcagctaatttttgtatttttagtagagactgggtttcaccatgttggccaggctggtcttgaactcctgacctcaagtgatctgcccacttcagcctcccaaagtgctgggattataatacacaggttgagcatccctaacccaatcatctgaaatgctccagaatctagaacgttttgagtaccaccatgatgctcaaatgaaacgctcactggaacattttggatttcagaatttcagattacgggtgctcaaccagtaagtataacacaaaatatcccaaatctgaaaagatccagaatgcacaaagattctggtcccaagcactttggttaagagacactcagcctgtacatggttctgtttccctggagaaccaaactaatacaggtgccttgttcaaaaattataaatttcaagatggcggcagcagaacattaaaccaagtgcaggcccattcctggaggggcccccagtcttgcctgcttccctttccagggtgcctctcatggctcctctccctgtattttcccaacctaaccagaccctatgatctgacaaaggaattctttttttccccaccctaatttgtgaatgtttacatatggtcttccagattcacaatccatgaacccccttgcttgcaaaaaataaaatgacataaaaacagagctaaccagccacctcagggatcctcaaaaccttttagtttgtagaccagaacctgaagcctgagcttcttttaattttcattatctcattctaagagatagtatctaaagtaaactggggctgaacagcactcataacttagctgaaaaaagaaatgtagaatgacccaaaatgtataataaatgcaaaatgagaaaagctaaacatgaaaaagctagtaatttaaaatatgtataagtaaataaaaataaaaccatctccagagcagaggtgggcaagcattttctgtaaagatccaggaatacacatttttggctctgcagcccataaagtctctgtggcagctactcagctctgcagtggaatgctgagtagccacaaaaaacaacacatacacgagtgggcgtggctgtgttccaataaagctttatttatataaacactgagctgactggatgtgtccttcaaggccttattttgctgacctatggcttagagcggcgcttctcaaacttcacgtgcacatctatcgcctgggaatcttgtgaaaatgcaaattctgactcagaaggtcgggagtggggcttgagattctgcattcctaacaagtccccaggggatgctgaggctgcgtgtccaaggaccccactttgagaagcaaaagagcacccccagaaaagaaaagaaggaaaacctactaaagaacccaaatttaagaagcacttagcagaacacagtatagaaaagtaatttattttctcatcaccaaggaacagagttatgcaatttaagtgtatcttcagaaggggaataccatgtcattggtgatcaaggatggagttaactatcattatcagaaagcaaaatgctacaccgtttttaaccaccgctgtgcattttctggtggcagttaacacggacatatagcgatcaatgcaggtaaacgaatccattcgaaggcaggccatggatggtaaatcacgttgtccaataaagttgctaaattagcaacagcgtgacacagagcattttttataaaagcgaatcctttttggaaggagatggactgcaggggtgtgtggctagcaagactggagggtggaagggagaagcagccatggctgcggatccttctggggtctggaagctctgaattttgctgggggatataatgtgaaaccggtgtggaggcttttcctgtgtgttatcaaggccccagtgagggtctgttgcccacaggcagataccaatggttgtatttcacacacagcggtatttaataaacctcttcaccatccagtttataagaagataaaaaaaaaatggctggttccactcaaacactgctggcaggaatgcagaatggcacagccactttggaagacacttcaacgatttcttaaaaagttaaatataaatttgccatgtgacccaggaatcctgctcccaggaatctacccaagagaaatgaaaacatatgtccacacccagacttctatgcaaatgctcatagcagcgttattcacaacagccccaaaagcagaaaaaacccagtgtccatcagccagtgaattagtaaataacatgccgtatatccttacagtggaatactattcagcaatatacgactacacatatagacctcaaaaacatcacgtgatagccagtgcaaaaaccacatactgcatgcttccatttatataaaatatccagaataggcagatctatagagacagcagattagcgggtgcctggaaatggactccgattggcataaggagtcttatcagggttatgaaaatgtcctaaaactagattatggtgttggttgcacagctcagtaagtttactaaaaattattgcatagaacccttgaaatgtgtaaattttacagtatgtaaatcacatctcaataaagttgtttaaaaaaatggttcccattatatctttccctttttcatcgctcacctctctagtccttaaataacatagagatcctgtagactgcaataaacccaaagacacgctggttgttctagaggaggctaaagcaagtcttccgacccaagcagatacgctggagatggcacatcaattgtcttgtcaaaagaggaaaaaaaaacacgcaagggccacgtatttgatttttacagtgaacgatgaattcatctgtggtcagagcatcactcgggcagagacgggcagtgccctcgaagatgcctccaaacccacagcctccaatcccaacccaatcccagcccaggagcttccaaagacctaagccctgaggagaatgggaatcaggagtgacggtaatgatgacaaaggctcagcccatcagctgtgttagaaaaaaaaaggaagagaaaacttgctaagtggagagccaaattcacctcgccccacatgcagccacgcccaaaactcccatgcccacccaacaagccatgtcttttgaaccatgctatcaccccgaaaagtgactcttttgaggtcacactctgatggcagaaaaaactcccatgtgcttggaaggaaatgaaaactctagtgatatacctttggcttgcctccagatggagaaagaaaatcttaagaaatgttgagctattgcaacatcccctttttgggaaaaacaatatttccagcagatgggagaatcataaaaagtaaggaagcacggtcgggaagggttgcctagaatgatccacagtgtctgcagtggccatcttcccccagcccacttcagaatccacaaacacgcatgatggtagcagccagctcagggtcaaagacagaacttggggctagaaactaggacttgggatggcccacaagtgggtccagccatgaccctggtcatctgggtgctgggtagttgagcctaccaggtacagaaggaaccccgccgaggaggctttggggtctgaagaatggaatttgggctccagcgagggacttaacagcatttcctctatagcctcaaaggtatttgaatcaggaacactagcttcacagccagaggcctgataatctccttctcccctttcattgaaaaagaaaatatctaagatactggagaatacagtaaaatccttaactctgttcccccacccccgcttttttttccttcattcctagcggcaaggctggataagcttatcaagagcaggcaaactacatcttagctctgatcctttcgagaaatccatttggcgcctttaacgtttcatttggcagattgaatttcgggcatgtatttatgggactgggtttgcccttaatagagtattgcataaatcccattacagtatccacttcagtgtgtttggggttttctaagccagggctttatctaagtggacagcatgggaatgacccactctggctcagaaactcccgcctctgccctggaaccaacctttgcagattgcctccatcatcatcaatgtcaaatgatgttttgggaaaagttctgggaagggtcagaatgaagcatgtcccatccacaaagaaggtggtgacaagcgtgtcatcacctgctagtaaattacaggatttccttccaggaaccacctcgctccacatccctcttccttctggcaacagccagagaaagtctgttatccacacaatgcctttctgtctttcgtaagtatgcaatgatgaagatgcattacttgtcatttctgaaaacaaaacaattattaagaaaagtgagctataaacaaaacagatcaggcttagcaaccctgaataagccagttctctgtaaccctcaagttaatcatttaaaaaaacaatggggccaggcacaatggctcatgcctgtaatcccaaaacttggggaggccaaggcagaaggatcacttgaggccaggagttcgagaccagcctgggtaacatagcaagaccccatttctacaaaaataatactgataattacaaaattagccaggtgtggtagcacacatctgtagccccagctacttgggaggctgatgtgggagggtctcttcagttcaggagttcagggctatagtgagctatgactgcaccactgcactctagcttgggcaacagagcgagaccctgtctctaagaaaaaaaaaaaaagaagaagaagaagaatggaattagcaatcccaacaacacaggtgtggagttttaatgcagatgaaagaagaaagcatgcttagctcacaggaggtgctcagtgacgcttggcccatgcactcatggcacacaccttagttcatctttcctagctggctctttcttggcagggctggacaggccacttacttcccaggcaacaaggcagagatgcctgtaagatgccttctgcgtacatggttcaggtccggcgtggcacgcaccatatgcaagagtcaggggttacaccaggctgaagtgtcagtacattaagaaccatttccttcctcctgggatctgtcctggaagcacgcacagaactctccattcactgacttttcacataaatagactccaaagcagaaatgcatggaaaggggctgacagcgggcctcagagccccacataaagctaaaggaaagccatttggccttctggaaccttcttttaccaaggcacactgtcccctcaccccctacaagaacccagcaatccattatctggtcactttcttctacgacacaagcaagtttttaaaaaaggcaacggcagctgcagtaaacgaagaagtgtacgtgatgagggccctttgggctatttcaggctctgtccctgcctgaaggtggctgtgggtttggttacatctaagttgggcctcagagcttgtgaaggtaaatgcttcctgatgagaaggaaaaaaaaaagtctaaggagtcttcattgattcaaccgacatctacaaagttcctactatgtgccaggctccagcaggtggccaaagggaacctggtatactaaagacctggtgccctctctccagggctgaatcctccaaggattctctcattgactttattttcatcttacatcacccgtgagcagctggggtagatgttgtgcagttactgaagaatttgtatgtactataggaggcatgaagaatgcatgactttatttacttccaactaaaggcaggaagtagtagtaatgtctccactgatatggtttggctgtgtccccacccaaatctcaccttgaattgtaataatccccacatgccaagggcggggccaggtggagataactgaatcatgggggccgtttcccccatcctgttctcatggtagggaataagtctcatgagatctgatggtttaataaatgggagttcccctgcacatgctctcttacctgccatcaagtaagacatgactttgctcctcgttcgccttctgccatgattgtgcggcctccccagccatgttagaacttcgagtcaattaaatctctttcctttataaattactcagtctcgggtatgtctttattagcagtgtgagaaaagacaattacacggtctaagagatgagcatgtcaaggcccagagagatgaagtgacttgcccaaggtcatacagacaggaaggggtaaagggatttgaaccaaggctgtctggctccagagtccccactcattgccatgatatcgccttgctttcaggagtttgctgtggtctgatctcagcactaccaccgtggctggcacatagtaggggcgtggatggcacatagtatgggcccaggcagcattggtgaaactgaatttgatcatcttatttaaagctactgcaatcacattcagcttttaagctacgggttgggaacgaggtcattctataaaaatggaaagcagaaatttaccctgaggaattttttagagttagggatagaagtccaaaagggaatctacttcaaatgaccagagagctaagacatgacctcaatacaatatgattaaatgagatgcagtggagaattacataacagttcagaaacacaatttacatctccactggtgctttcctttttattaaactagcatttctgttacgctgacaatacagaagagcaaggtcttctggaactgtttggcttacacaggcgtgagagaagtgaagacttattccattcactgggtaacatatgggtttcccagagagaaagtccacacagccatgcatgtgaaatgggtgatgataacaatagtaattgctgaccctcttgagtccttcctgggggccagacctgtgcgaaatgatccacctgcattagctcattgaatcctcatgagaaccttctgtggcaggtaaacagtatgggtcccattttacagatccgaaaactgagtgaagccgagctctaaactcaggccatctgtctgaggctctcagtccttagactacatttggaacactttactcaaagaacaccaattatgataaggaaaaaagaaaaaaaacgatgcttgccaaaatccagacatctcagacatgaaggcaagagatccggaaccatctgggcccgtgtagggtacaagctgccggcttcccactttaataccattcccttgggctaaactcccacatgtggccacagaaacccacttttcaaacccggcatcctccgcctccaatcgtatttggctccacagaagccaagaaggcatttggggacaagcaatctttatctgtaccaaatgtttattggagccactccaggaaatggtcccacgtgaagccaatgtgcacgatgtcacccacatctgcttggaatgcacttgtatctacattgcaatgctcagagttacatgtctcttgaaacgccaccctgcacagctatcacctggtccaacaagaataacagcctactgttcgtggagcggttgtttagataaagagaagagagggaaggaggaatcagatcgctccttcaaaatacctctccccatgcaccaattacagaaaattgttctgggaggcaggaggagctctccaaagtgtttaggaacacaaatctggcaagtttaaaaaatacagtgaagttcactttcctgaactccagcatcatgtcctcaaagctaaatcatactgagcagtatttgcagcaaagaggctgaatactggttgccgcacggtgcagtcagcctttctggacgggatcatacatacttaccaacagaattcttgaggtttgcagaggaaccaaaattacaaactatcagaagaagaaaaaccctcacatcaaatgcgaatggaacattcaggaagagagaaaggattaaagaaatggaaaagacgaaaacctttcccactgggtagaaggaaggagcactggtttccaaaaccactaaggggcccttaatggccagagagggagaatatttaaaaaggtctgcaattctagaatttccccacagatgagatcaggcatctgtgagacgaacctaatcgcagaggaaaacaggaagaagatgatgatgttaatagcgctctcccctaactttggtttggtggctgacccaacccatagcatttttatagccattatttcattcaatatggtaattgtgaaggtaagagatagcatgaatgaccactactcttgtacttcaccaaaaaagcctattgtatgggacactgatgtcctcattggggcaactatggccaaggtaaatgttaagtggaggccagattaaacatacgctacgtaagagtggaggactgtcagatacttgactatatgtaaggtagacactgatagcatgggtgcctgaatcagactaccagcgttcacatctgtatcagttcattcccgcatccctagaaagaacaacttgagactggataatttatgaagaaaagagatttaattgactcagttccacaggctgtacaggacgcatggctaggaggcttcagaagacttacaatcatggcagaaggtgaaggggaagcaagcatatggtggcaggagagagagagtgaagggggaggtgctacacacttcgaaaccatcagatctcatgagaactcactcattatcacgagaacagtaaggggaaagtccgcccccatgatccaatcacctcccaccaggcccctccctcaacactgggaattacaattcaacatgagatttgggtggggacacagagccaaaccatatcagcatccaagctcaacagctcacttactaggtgatcttgtatgagtcagtacacctccatgtctgttttctcatttataaattagatctgatcattgaaattaaagagttgtcataaggatgagtgcaatacagaaatattggtaaattctggtaaatacagaaatttaagctgttatcaaatcattgtcatcatcatagtggctaaaagttagtgaagcaatgatttagatcaagtatggcaggcacatggcatacgtggcacaatttcttcctcctgcatccatggtggacatggctagttgattgcagaactttgcctttaaactcagatgcagcctcagaattggtcacacagagttccagttatccccaaacaaagttgacggacagatgggtgaaagattttttgctaccctctagaacctcatcagaaaccagataaaaccagccgctcccagagaaacagtcacttcttgttggatagtggaaaagagcggctccctaaattacagtcatccttccaaagaccgacataattttgccatatctgcatgtattgtgtgctattatttatgcaatgtttatttgaatatatttaaaagagaaacttatacctgcatcccaaatgaaaaatgagttgacacaagccctaaacagaagataatgtgaaaagaaagaaaagaaaggaggaatggtactgttgtaatccggctagaaaacactgtagtagtaggttctgaatgtctgctttccattgttaaaaagggaaactgacaagttttagaaaggtgataaagatgtgctaacaacaaaccgagacttcctctttgactcaaccacttcctataagattcaatgtcatttaaattgtgccaaggtacctgtagtaggcagctcctaagatggccccaaggatacccactccagtatccccactcccacccaaatccatccggaatgtgagccagatttagtcactcacttctaataaacagaaaaaatacagaagtgatggtattccacattcaaggtttggttctaaaaagactgcagcgtattaggtgcatcttaggtgctgtctctcccatattctctcttagatccttggcttttggggaatccaactgtcatgttgtgagcttccctatggttaggacctgtaagaggcttccagctaacagccagcaaggaaggaactggggcccttggtgcaacagcccatgcaaaactgaggccagctaacaactacgtaagtgaatttggaagcaaatcctccccagtagaactttcagatgagaccaaagatctggccgtcaacatgaatgcagaatgaactgataaccttcataacattttctaattaacacatattcattgagaaagcaaagattcaagagatgcactgaaccagagcacgctgcttgctcacccatacaggcaaacaataagtggtaagtatcagaatgacttcctggatgagaattttcatgtacacatacacacataattacagtcagcacaactgcattcaatgtcagccatttctatcagctctttctcgttctttgatcttaattacatgaacaagtagcagaccatgagccttagaggcctgtggacctgagttccagtgccccctctgcccctaatgaactgtgtggccttgaaatagaaatggaatcttatccgttcatctgcagaatctggatactaagttccacttcacatgtcaatgaaaggaatagatgcatttgtatttgaatgtgattagcatggtttatggttgcctaaataaaatataagcttcctagtgtaatattctccatggactactgctctctgctacgatctataataacccaggctggagaagtccagtaggggtaagtttcacactttgggtcaggggagtcagcactgcatagaaatctaaagcaaaggtggctgaacgagaaaagctaagttccaacacttactaatggcgtggctgtgagcatggtaccgaccctcatctgtaaaacgggcataaccagtgcctacctatgttctgatggctgaatgagataatatagttaaggactcagagtagtgccaggcacacaataaaacaaacaaatgttacatattttgtcaaaattatcattaatttttttgagatgtattcttgctttgtcacccaggctggagtgcctcagctcatgcctccgcactccagcctgggcgacagaacgcctcccaggttcaagcgattctcctgcctcagcctctcgagtagctgggacgacaggaaaaattatcatttattgttattatcactatcataatttaattcataagtggttatatagagacctttatgataaatccagctcactgaaatgttttgtttggccacacagggtgttactgaaaaaaacacaaaactgaattagttgttaatatttattaaatattgcactaaaaaaaaggaaatttccggttgcttttaatacctgaaagaatggataaccctgggcctgattctcttacagtcacaggcagtggagccaagaagcaacagtccactgcctctgctcttctgtccaccaaagtcctcaccattccctatcgccctgcacctgtcctagagtaccaacttacttctcctggcctcaagggaattgggactttggactcttgttttaattccttaaagtcctgccttaaatttcaaattcttggatgatttttttaaatagcaggtactctaagtagcaatcgcaagaacagatcttgaataagattaagtctccctcaggaaatcctcagcaacactaagtgtcagataatggctgaggataaagataggatcattatcaaaaggaggataaagatccagctctctacaataaccctccacacgtgacccaaaaatgagcttccagagcttaaacgtcaaagcgttaaagttatttttgccatccccttctgtgatggttaatttaatgtatcaacttgatgtggccacagagtacccagatagtcagtcagacattcttctggggtgtctttgaggatatttctggttgagattaacatttgcactggtggctgatccacccccatgtatggtgagctcctctgcctggcttcttgagctgggaaacctgtcttttcctgcctttgagttcagatgaaaacattggcccttcccagatcttgagactgctggttttcagactggaacaacactctggccctcctgggacccagcttgccaccgcaggccttgggacttctcagccatcatacttgtatgagccaattccttataatgaaactgtatgcgtgtgtctcatatacatcccattggttgtttctctggagaaccctgactaaaaaagctgttatcaaattgatagtgcagagcttacaactcattgcagatcagaatcaaaagtgttaaagtgatttttgcccacctaccccccacctccatgatggttaattttaggtgtcaacttgactgggttatggggtgcccagatatttggtcattcttctggggtgtctgtgagggcggttctgaatgagattaacaccacatattgccccacatatttaagttgaggagcctcaactctctgcagacttatcactgccacaggctgcctggagcatttttagaccctggaggttccacagctctggattctcaatgagcccatggattcccccaccttgagagagggggcaaggaccaccccaggggatgctgggaagaactgcagagcatcctccaataagcctttgcagctctcttccctcttccccatctcctgagcccagctttctgcatcctcattcttttggaggaaagacaaaaacaagatcgccttattcctactcaaattagcaacttcatggcttaaccttcctccaaaactaaactgagagtggcaatataggggatttggattttcttcttcacatattcatctcctaaatgtttctcggtgaacgtgtgttactttaatcagcaaagatgatacaaattattgattcattctgcattcactctatgagaggcagagttagctcagcatttgaggactggacgcattggagcagaccgcttgggtgcaaatctcgactcaactctgtgacctcaggcaagggtcttaaatgcttttgtaaaataagtatgaaaattgtagttacctcacagggtggcagagattaaaagttaattgaagcaaaggaattggcatgtgcctgacaaatagtaaatgctcagtaagtacttgctacctatattatcatcattttatagtatgtatatatagtatgatataaaatataaacatacatgatatagtatctgatatggtttggctctgtgtccccacccaaatctcatctcgaactgtaatccccgtgtcgagggagggacctggtgggaagtgattggatcatgggagtgatttcccccatgctgttctcatgatagtgagcgagttctcacgagatctgatggtttaaaactgacagtttcccctgcattgtctctctctccagccaccatgtaagatgtgcctgccttcctctttgccttccaccatgattgtaagtttcctgaggcctctccagctatgcggaactgtgagtcaattaaacctcttttgtttataaattatccagcctcaggtggtacctttatagaagtgtgagaatggactaatacagcatatattaagttcctgctacatgacaggcattagaaacgtagtgatacaactaatcacctaaccccatgggtcttaacctatctagcaggagtgggacattatataaatacacacctctttctgttccaggatccaatccaaactgctttgcactttgtcatcatatctagactagagggttttctttttgaaagctcaaagctgatccttttcctgctttgagctcccaatacttttccatgacactctcaataaaatccaaactccttgctttggtctcaatctcaaagctccccatattttcacccactgacccctcttcctttcccccaccaggctcccctcactcaatgaccaccaggcacactggccgttcatcaactctttgaatcccaagcttcctccagccttcacattttctgtgcctcctggctggaaatctgtttcctcagaggtcctcataatgtttcctcttcatgtttaggtgtaagtgcgaatatcacctcctcaaggaggccttccctggtcatcccagccaaacaagtctcagcccaccatagtcaccgtctaatacacagtggtttttagaagaccactaattgctaaactaatcctatttatatgtttataatttacagtctaaccctcagtactggagtatagggaccttttctatcttgttcactactttttttgtctttttgagacaggttctcactctgtcacccaggttgcaatggtgatcacagctcactgtaacctcaaactcctgggcttcagtgatcttcctgcctcaacctcccaagaagttgggactacagacacatgccaccatgtccagctaacttcttcttcttttttttttttttaatagagacagagtctcactatgttgcccaggctggtctggaattcctggtctcaagtgatcctcccgccttggcctccaaagtgctgggactacaggcacaagacaccatgcccagctcaccattttattgtaggtgcctaggagagcatgctgcacatagtagatgctcaataaatatttgttaaaataaatactattggaaggaatgaatggatgaaggacaggcatatattttcaaatgttcacagatgtgtcgcaagaacctagtgcagtgcctggcacatagtaggtgctcaatgagtacttgtcaaaatacagactgagggaatgaatggataaagggcagacatgcactttcaaatgttcattgatgtgtccctagaacctagctatggcacctggagcatagtaggtgctcactaaatatttggtaaaataaaaatgggttagaagagtgaatggatgaagggaggacaccatttgtttttttagacagggtctcactctatcacccagactgaagtgcagtagcacgatctcagctcactacaacctttgcctccagggctcaaacaatcctctcacctcatcctcccaagtagctaggaccacaggcaccaacatgccaggctaattgtttgatttttggaaagacagggtttcactatgttacccaggctggtctcaaggagcctgagcttaagagatcttcctgcctcagcctcccaaagtgctgggattacaggcatcagccacacttgttcactgatacgtcccaagaacctagcccagtgcctggcacgtagaggctgctccataaatattaatatttgtcagatgaatggcatttgagtgagcaccatccattgttaaagaaagaggtgaccacatagagtgagtcggctggaggccactcttctgcccaagggcctctctcaagaagtcaccagaaaggaaggctgggagcccttcctggcagctgccagaacatctgtctagagaggccccgggctcacctgggctgcgtggaggcctgggctgggctcttttgagcgactctcactactggctcaggaagttccacccagtgccgccccagcatggaggctcctctgtggcctcaatgcaaactcgcctcagaaaaggcagctgattaacacgcgtggagggtctattgtctgaatcccgtcaccagcggagaaacagctgtttatagtttgtttattcctctccctttggagcccacgggaggaaacacaagcgcttgttctcaggggcaccattcagcagctgaagtgagtgaagaaaacggtgtttatttttaatgggataaagagggggaactcttacaaagtttggacactagcagggagaccgctcttcaggaggcaccaggccttgtggtgatgtgttgcaccctgcctctcgagggatgctcaagagtctattccaactcccagctggaaactcaggctcgggccacggtggtcggtcaaacagtagacttgggtgagcacctatagatatgagagatctagaaaagctcgtcaggcttgaaaatgagagagcaagatttctttggagagcaaccacctgctatttaatataggtgacatcctataaagggctgccaagcccagttgtgcaggctgggcactgcacaaaggtgtccagctgagggagaaatccagcctctgtgagctgctcatcaagccatgctccacagtttcaaaaataaatacatacataaataaagatgactaagtgagacaacagcagtctcacagatatatagatgtatttatgtacttcatctttaaatgctcacttattgactcttcacaataacctttcagattagggaccactgtcatcctcactttacagatggcacactgaggcagagagagggaacctgactgctccaagctcatccaattaggaaggagtgaatccaggattcaaacccaggctcttggtttccatcaacaggtgatgctgcctcttctaggaaaaaaaaatggctcaacaagccccagagtgtcatattcagaaaacacagtgcccctcccagtcttgggagtgagacctgctttcagaaacacccatgtcttccctcgattctgcaggtgatcaggctggaaggaggtaggcgaagaccccatcgtctgcattacaaggaactccttctaaagactcaaaagatttgctctgaactggtgaaagtctggggactcccactcagcctggagactcaaccaaccctcagcggggaacagcccaacccaaccagagctgaggccacccgctgctcccttctcagggcccagggtcagccaaggccattttcaagtgcgggggactgcagccaaactcgctgaaccagacccaggggagcccaagagggacctctggactcaagggaagaggacgctctcatccctgtctactctcccacccaccccctcctcccctccatccctccctccttcggagagcctccacattcgaatctccgaaaatggttttcacaactcagttagcagcaatcaattattcacgacctcgcttccccaccaactcatagactgtcactgttagcaagataatttctggactctgcccaacagccctgctctaaaccaagcggcctgctatttatttcctctcttccctaagaccctcccaatgcccaccaaccactatcactctcaacacaggacagagagacagatgggaagtcccctgggtgcctgtagcctgggagggacctgacagccaggggctgctcccagcccacgtgatacatttcaggcttggggcagaatgtctgaccttagtttaatccaactggaaaacaggactcaagcattctagaccctgtgccaggctctgggacaaatcccacattattttataaaacgctttaagctccgaaaacattgtgtcctgcacaaagcatgacttgggagggtctcccagacatgccgtcctgctgctgagttcatgggtcaaagacatttggaacttggcaggggctcatattttaagactaccactagcatttccatcctagaagcttgaagctgtctttaggaacatattcctacatcccagggagaaggagagaggtgcttatgggatgctcttggaaaaagagtttcagcctatgtcgtaagacccatggagggtggttggatagcagctctgctgtgtgaacaagcgaccttccacgaaagccacttttcaccctctaagcctcaatgtccacatttgtaaaatgggagaatatgagtactacttctggggctgcagtaagagttttaaaaaatgaggcatttaaaaaacacccagtaccttgcttggcacattgtggacattgtggcctctgtgcttcattgtaagaccctgtcgcttgtgacatgcatcattgattgaataacaatttggggcaaaagggtgtgtgctgaaacattaaggaaacatacacatcaattgtaaaattcatcccagatttcagaaaggctatttactaaatattaaaaatgtgtatctttggccagatgtggtggctcacacctgtaatcccaccactctgggaggccaaggcgggtggatcacttgaggtcaggagttcaagaccagcctggccaacatagtgaaaccccatctctactaaaaatacaaaaattagccaggcgtgatggcacatgcctaaaatcccagctacttgggaggctgaggcagaattgcttgaacccgggaggcggaggttgcagtgagccgagattgcgccactgcactccagcctgggcgcagacagagcaagactctgtctcaaaaataaaataaaataaaatggctgtgagcctgggcgacacagtaaaaaatgtgcatcttaaaatgaagcatattatcattattatcattattacaattgctgtattcattttaggtgggaaaatgcatacagagaagctatgtgactgaccgcaggccacacagccagcaacacaatctagtccccacacagctccagaggaaggagggagaggaagaggcagagttgaccaggcaaatctccctcatccaattcctcctcctcctacaagaatcaacagtaataataataatggaagatgagggtgaggggaggtggaggggggaggaggaagaggggggaggaggaagagggggaaggggaggagggtggaggaggaggagggcagaggaagaggaagaggaggaggaagcagcagcagcagcatgttatggtgcttaatacaggcccagacactgtgctaaatgaggtgcatgtattaactcatttatttctcctgacaaccctttgaagtgggttcatcatcatccccattttacagatgaaggagctgaggcacaaagacttcagtcacacagctgctgggtggcagagccaggctgcgaactccggcaccttggcgccaagtccccgtgcttctctactgcattgcacttcattccaccaactgagacaaagagggacgttttggtggagaaggaagtggcatataagtgtcatgccatgcctggtctcacccacacgcccaaggaagttcctctgaacccacagagcatgccctgggctccctctgatgaaagcaagttcatgcctctcttccactctctcctgctgccccaggccagctgagcaggccaaaggagggctggggccaaatctgcagccccatcctggggaaaggctctgacgacagtagccagcttctcactgctgtctgcaggatctcagcaattccacgggcatggagaacagcagcccctggagagggtaggagaagattgggtgtctgccaggcctgcagctgtggacacttcccctatgggctgcggggacggggcaggcccagcacctggaagagggcgcctcccctgtctggctggtcttcagtcccatcaacgggacttagcatcaagtgacgtggtggttatgcacacgggcttgtggggagctgtgcaaccttgcgagagttacttcccctctctgtgcctcacttcctctgtccataaaacagtgactctgacaatgctgacaacactaggtgttggaagcattaaatataaaacgcctaacatgtagtatgtgcttaataaatggtagctgctaattactattatttatcatcatcaacaggactatgcatcaactactaagaacacaggtggaccttaaggtgccatcagtatgggtgaggagctgacaagaacccatggaacaaggcatgattccttgttctagaatatctttggcctttggatcttaaaatgtcatcttaaagtggggttccatagctctcacttttaagacatctcatctgatctttcaggcaatttctgaaggaaacaaaaatatttactgagcacctattgtgtgccattcactgtttccaccactgggaataacctgatggagttaatgaatccaagaccagctatgatggtgatggcagttactaataaaaggtgagaaggaccgggagtggtggctcacacctgtaatccagcactttgggaggtggaggcaggcagatcacttgaggtcaggagttcaagaccagcctggccaacatggtgaaaccccacctctactaaaaatacaaaaattagccaggcatggtggcaggcgcctgtaatcccagctactcaggaggctgaggcaggagaatcgcttgaacccaggaggcagaggttgcagtgagctgagattgcgccactgcactccaatctgggcaacagagcgagactccgtctcaaaacaaacaaacaaacaaacaaacaaaaaaaaaaaggtgagaaggattctagagtttattgttaggtagaagtgggaggtactgggaggaaaggactcttttctgcagacaatcacaccaaaacagccacgtacacatggaagtgggaaaggacacgtgggtcacacacacggctggaagaagagacatgtgcaatcagggcacaggtaaccacaagagacctaaaagttcagagcacaagggacccagaatccctcagaccattttaaagacggggaaacagagaacctgaaaggcaggcagcccaaagccacaccaagcaagacacagaacaggttctggaatccaggtatcctgactcctgaaagtcgagatcactttgtcttgcgtcgtaaacagactaagacattccagcacagcacagcccgccatcacagacagacactgctgccaggtcaggcagcccccatctgccatctctctagatcagtgttaccaagctgaggggagtgtaagacaccaccaccctcaaaatcaaacaccttaggacaggaccaaagacaggtaagttttgacatggagatgagggagagaagttccgagttggggacatcatcattctgcaggggcaggtggggaatcgaaaaagccgttgcatgcaaaggacaaatgttctttcattggaggtggagtgataataactgcagagggactctgggaaggttgttggacagagtgatttttgtcttcaaagaacgtgatcaactttttgcaagtgttcaagttccacctccaaatcttgcaatttctaaaccagtcaacttttctaggtttttaataaaacagagatgatgaacccattagcagggctgttgggaacctcaccccagaaaacagttgatggtggcctggaagcccctgcaggctcttgttcctgtccttcttcccaaatgactttcatgtccttgtcataatgaccacattgtttacctcctctccccgcaatccatgccggactatcttctctttgtttcatcttaaatgtcaccttgttggaaaagccttcccagatgaccctccccttctccctgactcactgtcccctccatcggaacctgagctgcaggaagtcagggaacgcgttctgtccactgctccaaccccagctcccgtgcagtgactggcacctagtaggctcttggtaaaatctgttgagtgaatgaataagtgtctgcaaacatcctgggtacatctgtaaagcatgcactcatagaaaacttctactatgtgacacacagtagattatcaatggctgttgctgagaggacatcaaagtcaattccaaaccaacaaggtcggcttcccatttccgctgtggagtagccttgagcttagtgagatagaagactcttgcccatcaccccagggacctgctccccagagctcaaggcactcagtaatgaggaaaaccctggctttacaagacacagtaaggcatgaaaactggggagaaagttcactgggaacctgcaggacactacaggtattctacaaaatgataagctactctgccattcttaactattcttaaaaatgagaggaaattgatcagcagaaaaaaggtacatgaagtgtgctgtgttttgatgtgggcaggctaagtgataacttcccctaacccgcccatcctaataacatgaaaccagtggtgcctcctgctactgacaggttcccttactcaattgctataagagaagcattgagcaagcattgagaattaaggaacctacagcctattcatagattctaaccctaagaggaacgaaattagcactttgtatggttgggtcattaaaggatctcatgaattaatactatcgtgtttgcattctgttttgtgaatttctgcctttatttttcttaatgtccctttcctactttcttttgtttgattctcagtttttttctttttttttttttttttgttagtaacagggtctcaggcctggcaccatggctcacacctataatcccaaaactttgagaggccaaggcaggagggtggcttcagaccaaggagttcgagaccatcccagcctcaattatttttttaatggacttttattttaattattttactctttcatatttaatgtcaaaacctaaagtgcttttaaaatagactaccagttttcctctgggcacagttttaaccttatctcaagttttgatatgaagtattttcattttcgctaatcaatatataatctgaaatgtcaaatttaatctattcattgatctaagaattacttagaagagtttcgattgtttaaatttctatgcgattgtcttttagaggctaattttcaatatatcttattgttttatgaaggaagcctggaagttttctacttttgaaatctattaagattctttttagaccaagttaattatcagttgtaattagcacgttagaacatctagaaagtagtctttaaaaagagaagttcttcccctagaatacacacacacacacatacacacacacacctttgtaaagagtttcaatgaatacttacaattctagtcttaccttaacaaaagtaaatattccaacagaaaaagacaacctattaagctaaagggaaaggaggcaaactaccagaatttaagggttaagtttctcacatctgggaattccactctggaatcataaccacaatagcattgcagctttgcagccctattttaaagacgaaaactgaggcttccagatcctgagtcacatagaaaggattttagctgagcccaagggtttcaagtccacaaatcctttctgcactaaattcaaatttcattccaaaagtaatactaaaacagcagctgaccttcttctcttgtgccattccttaagtttgttcatcgcaccaggcagaatcagaagacaggctcctacaacagctagggctttactcctggtaaagtgggttggcttaggagaagaacggacaggactctttgacaagccccagaaagaatattaagtcatttttcagccagcaccaagcaaacctgaaagatgggtggatcctagggtatcctaattttactcttccaaccctgtcagtgctagtgtccaaaaagtggagcagcaaatgggaagtgactggcattcagaaactgacacaggatcctgcatttctaaacaatgctgacaacgcacactgaggcagcacctccggggaagtctccgtgctccgatgctgtggccatgtacagcatatgcagtccccaaagggatatttcagcacagagtttcaatgtaaaatgacacacgctactgcaggctagagatcttattggggacacagggctatattcatctgcttcccagcaagaaaaccagaaagccagagataaacagaagtcaatcaaagcagaaagtgacatctagaaaaaaaacacctaattctgccaaacctgttttgctgaataaagataagagcgctgtggacaatatggctttggtataagaaattaaatgatggcaccattcccaaaagcaactaaagcagttgacatcgggcttgttcccaacagcctagaagggactaagaatggaagaacaatggacaattaagaaactgtttctacggactctgaattttgcaagactaattatgaaaataagccttgttacagagtttcagcatttgaaagtattactgtgctttacttcctactctgaaaggtaagacttccaaattaaaatataattgtcaaatcaattggtaaaaaaaaagtagttaaattaattccgctcctaggtatatactcaacagaaatgtttgcatatgtttgccgaaagagatgtccaagaatgttcacagcagcactatttataatggccccaaactgggaacttcccaaatgcccataaacagaatggatatgtaaattgtggtatattccacaatgaaataatgcaaatgaacaattacaactctgtgaaccaatatagacatagggttagcaaactttttggtaacaggccagatagtaaatgttttaggcttagggcccatacagtctttgttgcaactactcaattgtgctgtcatagcacaaaagcggccatagctgatatataaatgaaatggacatggctgtgttccaataaagctttatttatgatcgcaattttttttttttttttgagatacagtgttactctgtcatccaggctgaagtacagtggcacaatcttggctcagtgcaatctctgcctcccgggttcaagtgattctcctgcctcagccacctgagtagctgggattacaggcatcaaccaccacacccagctatttttttgtaccttttagtagagatggggtttcaaccatgttggtcaggctggtagcaaacttctggccccaagtgacccacccacctcggccccacaaagtgctgggattacaggcatgagccaccatgcccagtcaatttgtggacacaaatttgaatttcatataattttcacgcgtcacaaaatatcattctttcctcccccccccgcccccccccgcaactatttaaaaacataaaatccatccttagctcacaggccatatgaaaacaggcaaaggaccagatttggcttgtaagctggggttcgccaaccctggacagagataaaactcccagacgcaatgttaaccaaaacaaaccaggcacaaaagagtacagactgtatgattccatttctaaaaagaggcaaaagtacctggtggggttagaagtcacgatagagaccctatccttgcaggcatggggtcagagtggacgtggccgggatcccgggggctggtgggctctgaattcgggtgctggttagttgggcgtgatccctttctggagctgtttattcatgatttctgcattctttctcatgcatgttctacttcaagagaagtttagcaagtttttataataaagtagcttacaattcaatcagcttcaaaaacagaagtataaagagaacgagagcaatcaaattaaattagttatgacttcttcatgatggccaggtacctgccaatgctagagtacttaagaatatttaataataatggctgggcacagcagctcacacctgtaatcccagcactctgggaggcctaggtgggcgaatcacttgaggtcagaagtccgagaccagcctaggcaacagtgagactccatctctaaataaataaataaataaataaataaataaataaataaataaaaggtagatttaaattgttttcctctattattgtgtttacttccagggtggagtttgtttcatggtttaagggatggtgctaccatcagaatccggccaggctattttctgcggcgtctgcgcataaagatgatgttcacccaattaccagcgactcctcgcatggaaatctaccatcaatactattaacataaacagcatctggcaaaatacatggccttcaacctacagcaaaacctgcgctggactctcacaaaggaaaaaggccaggtctggcttccatttgatttccagagaatacgcaattaattattttttctcaccgtcagcagctgagtctcagtgaaatccgtgcttgtaattatcgctgtaattattattttaatacaaatcagcaacttatcaaaatattacgtgtcaggtgctacctctctgctgcaagactatggatggaaggtggaggccgtcaccccagcttcactctgtgcacacagaggatgggaatcagggtgagggtacttctaccagagccagactttcagcttcctagatgtccacgtccacagtcagtttcacactcgaccttttttttacaggcaataagtcactctgtacattctatgtggtggtttgatcttgggcaattcagttcactcactgctaggtctcagtggtaccatctttgcagcaggcaaacagtacaaaccttttttttttttttttttttttggagacaggatcttgctcggtcacccaggctggagtgcagtggtgcgatcacggctcacagcagcctcaacctcccagggtcaagtgatcctcccacctcagcctcccaagtagctggaactacaggcatgctaccatgcccagctgattgattgttttatgtttttgtaaagacgaggtcccactatgttgcccaggctggtcttgaactcctgggctccagcgatcttcccacctaggcctcccaaagcgctgggattacaggcatgtgccaccacgcccggcaacagtaccaactttctggcagtgtccttctgaagaaaacctaatgggagttgttacatctttctgtgcggcacatgcatggcatttgacacacaggctcctgagtcacgctggctgagttgaaattccaagtcttctctgtgactgcaggtgatttcttaccctctctatgcctcaatttcctcatctgtagatgggaatactatcagcagccacatcataaggctgatataatgattaaaatgataatctaggagacgctgctcagtacagcacagtgcctgccacgtagtgacatctaatagataatagcaattattattattatcattctgaaagttgcaaactcaaaccccaacagccatcttgtgggtaacacagacaagtaaagtgacctggtgggcccgtgtacacgaggcagccacatcccccctcactcaaatggttacctctgggaatgaagaccagaatttcgaatttcttaataggcactctaaatttgatttggattggaaatcattgattttggctactaattcaagttttgatttttaaaatttaccttttctttaagaaaggaggaagaggaccctatgctgtcattattccatctggagcccacacctgactcacaaagctctaggtttccttctggcttacgtatttcccatcgctgctttctagcacccaccttcattggagggctgtatctgcctgctcactccaataaacagtcagtttcctccaaatgttgctgttgtgcgttttttgtttgctttaattctaaaagaaagccaaacagcagtcagcctccaggccaaagaagaatgaataacctaacttctacccatttctaaaccacccagtctttcactgaacatccttccttaggagacgtttagcttaacatctctccctgctttctgtctttaactcaccttctaaacaagagaaaatcagacgtcacaatttgaaaactatccctcaatagggttacaagaaaaagcaggcaataagagcattttacatccacaacagaatcatctgcaatacttgatgacaagcaaacggggttctcagtgtctttcataacagctgccccttttgagctaggataaaagaaagtgcaaaagagagacaatgaataggcttttatttcaaagagaacatctgcaaagcatagtcctccattaaaaaataaacagaaaacagccactagtctggggaaaaaaataagatttcccattacatctctaattaataaagccccatttcaaaaggaaaaaagaagaagaaaaaaaagaataactttttcacatccccaaagaaaggatgcttaatgaggtaactgttgtattacttgatccatctagtctggttttaatactatccttaaataatgtatacattagctttccattaccaaaaacatttgtttattttatgaacgtgagtctggttgagagctgagactctgcaaaattatcatgccgtccttgggctcccggcttttattgcttctcccctcgctcattatgaaatgattagttgtctccgatgcccttttgaattgctgctaacgttgtactgcggttctgttaccctggttctgaataggagagtcttggttcagggttaagttaatgtagtcattactggcccatttggggacccattcatcatgctaatttcatgtccaacacttgggggaatagagtacaaatactcaacgtgaagcaaatgcacagtgaatccaaaagacgcacatgaaatgtccagaactcagtcacagaagacaggcatggggagctctggggccattactttccataactgtgggagcaatgcagacatcagagagggcctccaatggggaattcctttccaagggacccagagcacagttcctcctaacatctaactttaatcctttccacttgaacttcagaacaaaacagcacagctgtttaccagaggagcaaagactcttcaaactggttaagttgacattgaccaaaccttggccatctcagcacttccttgatcgtcattaaccaaccaagctgcaatcaggatttgaaatccagttagagtttgcttatgtgttttcattttgttaacccacttcttcttacttaaatgccactttacctgcatgttaaacgagaagagtgttgaagctgccgttttgattggctggttatatttctgtattttccataatatacatttaaagaaatatacagcgattaataatttctttaaatattcacccaagaagaagagagtgcatctgggatgttgtcagtgctatgattcctggtctaggatactcggatgtgttcagtttgtgagaattcatcaagttgtatatttagagtaatgtttgtatcatatggttttgttgggaaaaaagcaactaaaagaacgcaggcaatatttaagaagtgagccagacgtggtggctcacgcctgtaatcccagcagtttgggaggctgaggtgggaggatcacttgatcccaggagttccagaccagcctgggcaacatagcaaaaccccacctcttcaaaaaatacaaaaattagccgggcatggtggcacgcacctgtagtcccacctactcagggggctgaggtgggaggactgcttgagcctgcgaggtcaaggttgcagtgagctgagatcaaaccactgcattctagccggggtgacgtaaggagtccctgtctcaataaattaacaaataaatttaagaagtgaataaatgttgtacagatacgaatagtaactttttataaagagtttttacagaatatctgcccttgtagcacctccaaccactggtgcatcacgattggtgtctataccatattttggattcctggggctcgtttaggactactatggcaaaaggcatgatccaaaataaatccttacccctgaataagtaaaataaatccacccatccaaaacaaatgcttatccacagctctttcttttcgttcagctccctaatggtttccttcgctgcatttgtaacaatctgattttttgcaatgttcttgtttgtttttattgggaggtcatcctgcccccaaaccataaagagcatgagggcagggtcacatctgtctttccccctgctgtgcataaggcctggcacacagcagaccccaaccagtatctgatgaatgaatggatgagtaggtgggaaatttccagtggatttcactcattcattctctccctgtcccccacgggttacaagacgctgtgaggaaggaacgcagacaaccccgtctgaacactcccacattgtgctgcttgaagacatgagccccgtcttccattcacatggggctttctgagcttcaaagcactttctcatctgtttatcaaatttaatcctcacaacccagggagggaggcaggcttattagcatcatctgatgaagtgccaaaaagacacagagatgaaagtcacggtccgtccctgacagcgctgggaccaagccaaggtgctcaggaatgttctacttttccacctcccccttgtctctaaagactcccaacttcccaatgcgtgttattgggggacaaggtcacgggaaacacagagtgaggggcagatgactcaaaggaggctgtcactcacactccctgcagaggggaaacaggtttatcaaattgcggaatgcatgattctatttctgtcggggacatttgccttcaggatggcctcatgcttataagaatttgcatattctgggtctccaccaccagctaggcggggagggagactccatcatgccagggcaaggcacaggcagtgagaggcaaataagtgcagtgaataagccacatgggaatagggtaaccacagatgctcatttttatgtcttcatagtgaacacggaggtcttccaaatgggctgcaaactcaacagccaagaggggccagccaggtgccacaggtgacaggagagatcttagggggactcttagggacccagtgggtctgcagtatcaccattcctcagcttggctgtttaacaccaagcaagcaccgtggaccctgtattgccggatcttatgacttttaaaagaattccaaaaatctacgctgtctcacggcatatcctaatctttaaattccagggcctatttattctaacacaccgtgtggacaaaatcaaacccacccacgggccatggatttgaaagtcctcctggctctagcaaacatctcctacgatgtggctgcatcaggtggcagagcagagcactgaccatgacccagagctgtgcctcaccatcaagccctgccaggtaggtgccatcatggcccctgtgcttcagacaaggagactgagctccagagaggcaaagtgccataccaccgatgatgtcagaccactgtcttcttcctcaacatcacacgacctgcctcccaggccccacagcatctgcccatctgctcccctggatcatttccagggttgtttcatgagctacaagaagaagagcttgggccccatgagcagagcagcccaggcctcatggacagttctgggatggcagagacctcagggctcccagggctctgaatcatactacttactccttgccctgaccttcccagaggacacctcccttgtgtgttcaagaggtcaccatgggaaagggtataggcaatgaaccaggctaggatgtgagagtgatctccctagagatcggccacttatcagcacgggctctaactcttgcctgctagactggtcctcctggagggcaggaggcacattggtcctgttcaccaaggtggttccagtgctggacacagggactggtaccttctaactgcaggagtggaggatgggtagataggtggatgaatggatcgatgggtaaatggatggacagatggatggatgaatggacagaggatggatgaatggacggatagatggatggatggatgcttagacaaatagatgaatggactgatggatggatggatggatggatgggtggacaaatgcatgcataaatagatggaggcagggggagaatgaggggctagagtcaacggacttactgactctgaactgggtagactgagaacacagcctttggagacaccacccaacttcaatttctagtttggacacttcacatctgcttaattttcatccaacttattgccttagttttcattatttcaatcagtaaaacagaaatgaaaataatagctcttaacttgccagatgttataagaattcaataaaagcatgtctttttagtccttccacagtgtttggtgcattcgataaatgcacctcatcatcaccatagttgcaatgtttgtgcctcctgggtagggaacatttgcatcaacctctctgccccacaaactcatcttaaactgaaaccacacatcttgtggccaaaaattatggcaaagcgtgccctgggaggagaaacaaatgcctcttaccacattacctcattagcatccactgacacattagcctggattagatgtccagataagcagtagtcacctggctgggacaaactaggcctgggacaggacaaatccattcattgcccctaggtggccctgaaagatgagacaccctcgtccacacacacaaagcttgagaatgggtcccaccccttcctcatctggcagggtgtctgggtttgcagttcctgacactaataatgccagtgtccaggttcagggctaaggtgacaccccaccccacacccatcttctttgtgatgcctctggcttccaatcgggaagggggcaaccgaacccagagagcacatgggcaccatctgatgagcatctgcgggcaaacgggtagtttctgttgcaggcggaaggaagtgtccgcaagatgatccgcactgcatgtttattgaggtaactctccagtgtgctgcagacccaggctctcaggtacaagtggcgggctcctcagtgggccaaccacagagcggtctgaaggaatggagcagcaggaagtctgttgtggttgaaagaaaggccattgtccccggccaaagaaccctgaacaatatcctcttgccccctcctccgcttctcccttggttagagagagctgaattcaagactcctctctctagccaatttcaacttccattcttgactgttgaaaatataatagtacacagcttgaaggattaaatgagttcatgcacaaagagggtttagaacagtgcctggcaaacagaatagagaacgcagaaataaacccacactttaatatcaactcatttttgacaaaggctggggaaaggaaagtcttcgataagtagtgctggaaaaacgggatagccattacctatggataaacttaagaatgaaactaggccccatcactcaccatacacaaaaaccaaatcaaaatagattaaagacttaaatctaagacccgagactatgagacgactagagaaaaaaacattggggagacacttcaggacgctgagcaagaattttttttgggtaagaccacaaaagcacaggcaacaaaagcaaaaatagacaaacgggatcacatcaagctacaaagcttctgcacggcaaacaatcaacaaattaaataatctacaaaatggaagaaaatatttgcaaactacccatctgacaagggattaataaccaaaatatataaagaactcaaacaactcaacagcaaaaaaacaagtagtccaattttttaaacaggcaaaagagctgaacagatatttctcaaaagaagacatacgaatggccaatggatatataaaaaaatgcacagcatcactaatcaccagggaactgtgagtcaaaagcacagtgagatatcatctcaccccacctgaaagggcttttatcaagaagacaaaaaataacagacgctggtgaggatgtgagaaaatggaacactcatacactgttggtgggaatgtaaattagtacagccactatggagaagagtatgaaggttcttcacaagctaaaaacagaactaccatatgatctggcaatcccactactgtgtctacacaggaaaggattaattatccaaaggaaaggaaatcaataaatccaagagctatctgcactcccatgcttactgcaacattcttcacaatagccaagatatgaaatcaagttaagtgcccatcggtggatgaatggataaagaaaatgtggtaaacacacacagtggaatattagccagctgttaaaaagtgaaatcctgtcatttgcagcaacatgaataaaccggaggccatcatactaactgaaataagccaggcacttagagacaaatatcacatgttctcactcctatgtaggagctaaaaaaagtagatgacaagaagatagagagtagataggtgattaggggagtagggaggaagatgttgattggaaggataaaaatccagttagatagaaggaataagctctagtgtttggtagtccagtagggtgattatcattaacaataatctattgtatatttcaaaatagctagaagacccgggcacagtggctcacatctataatcccagcactttgggaggccaaggcaggcagatcacctgaggccaggagtttaagaccagcctggccaacacggcaaaacctcatctctactaaaaatacaaacagaattagccaggtgtggtggcgggtgcctgtaatcccagctaatcaggaggctgaggcaggagaattgcttgaacctgagaggcggaggtagcagtgagtcaagattgtgccactgcactccaggccgggcaacagagcaaaactgtctcaaaaaaaaaaaaaaaaaaaggagctagaagagaagaatttcagtgtctctgacaaaaaagtaaagataaatgttggcggtaatgaatatcccaattactttaagttaatcattacacattatatgaacctatcaaaatatcacatgtaccccaaaatatgtcaaactattatatatccatttttaaaaccacctaacacatcataactgccatgcagtcattattattattattatcattattactacccttgtatttgcatcatgagttaggggtctgattcaatataaattgcatgtctgcttcttttctagggttggtaactttttaggaatctgcaacaagaagtgagaaaagtagaataaagatttttggggctgggcaaagtggctcaggcctgtagtcccagcattttgggaggccgaggcgggcggatcacgaggccaggagttcgagagcagcctggccaacatggtgaaaccctgtctctactaaaatacaaaaattagccaggcgtggtggtgcacgcctgtaatcccagctactcaggaggctgaggcacaagaattgcttgaacctaggaggcggaggttgcagtgagccgagatcacgccactgccctccagcctgggtgacagagcaagatgctgtctcaaaaaaaaaaaaaaaaaaaaaaaaaaaagatttttgggaatgcatggttgcatttagggtttttcaacaaaccatgcaaaaggaacgcaactcggaaaggtggcatctttggaaaggggcaggcctgggtttggatctcagttctgctactccccagctctgtgaacttcatgagcaagcagcttcacttctttgagcttcagtttcctcctggggacagcaaaagtcttatcccacaaagttgggagaaatcagtaagacagtaaggtaacatttacaaatccctccattattcctgccacataacaagccatcataagaccagcgatttctagttgggtgtccttagttttaactttttatcagttgtgtaataccgtcttccttcctggaaattttttgtgtttttttttggggggggggggggtgagcatttaataacctaacgtatgcaaaatacctaaatgacacctgacatacagcaggcactcaataaatgtcagtactccttcctctaccacattccgtcctgctcacacagaaacagctatattcattctactgccttggatttactcgcaccctacactgtacgggaaaatgaataactgcaagaaattccttattttcaaacataccaagaatttccttttaagaacagctcatttttgaacactgattaaggaacaggcccacatgagttcacatatattgctacatttcatcctcatacagccctatgaggtagctcagattcacagaggaccgaaattacagtgacttgcccaagattaggggcatgagaaagggccgagccaggaggtgaacccaggtatgtcaggcctgagggtactcaacagaggcctctttcattggtgccggggcctcgcacatacttgttgggacgttttctcctgttcccacaccccttccttagaatgcaggttttgttaagatcgagtttgttttttagttattttttattttccccaaggcattttctctttgtttctggtagatggggatctgggtccgcagaaatggggaaatgcaaaggaaaaggaaagagagagatcataagtggcagctcttaaggtagcactggtcaaaagatagagactctcaacctcacctgtgcagtccaacaggtgtgtgtgttaagttcttctgcactgaaacactcatatagatggatttatgaccttatggatcataaacagctctggagcggggtgtggggggcagactcttatgtcagagatatgcctaaggatatctttgctttctgaggatacacacacacatacacaatgacgcgatgatgtcaaatctctgctttaactcaagccaccaaatttcctcttctattaaaaccatgaatcaaacttgaacagtcaccagtaaataagaacttacgccatggctggcttcctaggtgaaaaatagcaagcctttgaccacccacccttctggaagatttttaaaaaatgaattgataaactgaagagaacgtctaaagtatgaaaagaccggaaggaaagtgaatacatagatatattagaattcatattacaaacatatctatacctacgtatattatttctacttttatttatctattttaacactttccatgataaacagatggcaacatttgcagtaagataaatattattcaatgatgcatatttctgtatacaaagtgtaatgcgtcgctcaaacaaaacaaaactccattgaaagtgtgaaaaaaaaaacgaaccatcaataacataccctgttttctgtggtctcagaacatctggataggaagaaaagctatacctccaaggctgttagaagcagaggtgatctaaagccagtgaaccgatctttcaaagtcactgctgatgtctaaaagagtcctgagttatctgagtaatgtgaagcatgaggaatttctgccgaaaaatcaacatttcaaaggcgtcggataatacagaaaccccattctactttgtgtgcttatgtagggcggcaggcggggggtgggaagggtaataaaaaattagatttcttaaatgaaacttactgagtaacagtttatctaagaacacgagcaataaatgtggggacttcaagaagagtcactaagggaaagaaaataaacattcattacattaacacacgcagctctctttcattttctccaaaatctattcagaacctgtaggctgatccttgtgacagttctcccaatatttttcctccctttataagggagtccatctgtttcttaaattctgagatgacagtaaaatccacagcttactggagacccagtgaaggaatcagtgtcagccacaaaacagctgcaatccacccaataattctaatatttaagagctttaaaagaggctgagaggaaaaggagagcttgcaaatcttttatggacatgccctctgactctgtctacttgagaaacggggtgtttcctcttggcttcttaagtgcaccaaaaatacaatcagggccttccaccgaagcgcagctccccaaacataaaaaggacaaatgctctgaggctgtgggcatcaggaaggaggaagatctggcttaggaaatgccctatacacaatgcctgcctgacactctctgcaacacacccaccagcaacccaggacacaggttccctctacatgcaagagccaaggctgtccacccaccccatccccacctgcaacagagcactgagctaaagcatcttcttctaagcatgtgtctaaccacctctctacaagagccatctggaaaatcacggggatttgtttctttaaatgtcccactcctgaatctccctccaaagcatcatcctggcagcctccgcagggtctggaaacaaactgcacatttcaacggcctctattgcttgcgaaaaggtctggtcctctccttgcctgcaacccaagctccagctataccagactttgggaacagcctgcccccttctggtctcctggagctccatggaagggcaggaactgggtgggcacagtcagagtaggacagaccccgggctccagccagcctgtctgtactgtgatttcaggatttagcaggtcatggagtaggtgtggggggagaggaaagaaaggagacaagcaaatgaaataaaatacaaagccccaagagacaacagtcaacagcatggtagacagccaccaagaagagaagagaaccaaaagaaaaaaaaaatacataaatgtccatcttggaaggtaaagaaattgagacattaggacatgcagatttggggagagtaactgaacttgcagttggaagcagagtttcagaaaagcaaagcacctccgctgctggaactgcaattccaaaaggaagtaaaaaggaaaatagtgtgttcccacctacctccccaaccgcagatctctcagaggctgagctgggtgtgagagagtaaaacactgagccgagcacacagagaggggctgggggtggatgctcacaatgccggggacctatgaagaaatcagctagccctgcctccttccttctcttcatttgtttcaacaggtgctacatgcatcctaaaggtacctcctgaacccactctgacccccagatgcaaatgatacagtaagccccaggcttcccccaccatgtctcccctacacgttcttacactggaccagcaggacacgacccacaaccctcccaccccacctcctgggctctggatgcacaaagaacttctaattgcatttctgcgggaacccatcactatcaactccaagagttcaaaggcagcgtttcagagtacccctctctgtaaagaagagatcgcaggacactaggaatgttctggttctccgtcaggcagctcacgccactattctccccgcaaatgagggaaagacttctccctgctacccacacagcaacgtgaaatgccatcacatcacgtcttgggactggctcagttctcaggcatgaagagctgcactccggcagaaagggtcgcacagactccgaagaagtttagcagctcagaaagcatcacgctgtgtactaaggcagtcttcagtgaggacttccaaagtgacaaatgatagaaatatgcattcagtcttcaggatcctgaaaccatccccctggtgtctaatatcctttaacggctaggcaaatccttgcagacaagtagtgtgatgaagaaacagacagacacacaacacattggctatgccctaaggcagaactcacgcccctggagaactgagaccttggctctgaaatggggactccggcctcctgccccatgtgctcctgctcctagctcagtaggctgggcaaggcagcccagagaaggtgggaaaggtatccctggagaagttagggacagggtaggaagacaagtcagttccccacccagccacccagatggccccagatctgcggaaaaaacagtttcagagccctgactgttcacacccacgaagggcaaagtaatcccataggagtggaagccctgacggtgtggtcggacacacagctggtgacctgaaccggccgcaacaagacagaaagacagagacaaccagctaggagaaggagccatgccctgaaactggagatggggaggagataaagtcacagagggcatgggagacggcaaggttagagacagagaaggtgaagacggaaggctcaaacatccagagaagagaaacagaagacccaaagtaagaccagacaccccggactgagtattgattcaggggcatggtcggggacttgggacgcccagctcagccctcatcgcaggccaggacgaacagagggctcaactgtctgcacccagctcggcaaaaaccagagagatgctgctgcgacaaccgcccaggaacagcggctgaggatccggggagatccactcactcaggcagggagcgagtcaccaagacctacacgcacggagcaagtcacctggggtccccagcaagagtgatggggaacaggaacccagccaggctccggtaacccccaaagcgcccccgctggagaaaacttcccccagaccccaaggggtccgtgctcagactctgaaaggggcagcccacgacccctgagccttggcagggaccccacccggcttcccggggcaagaggcgatgtggagtcggtaggcttgcagagtcccagtctgatgaccgagttcaagggctaggggggcgtggggtcgggctgccttcctccctccctcgccgcggggcgcgagccgaaagggcatcttaccagagcccgggcgggcagtgccccccggctggccggctgctgtccccgcggttctccggggccgcctccccgcgcccgcgcctggggcccccgtcctcctcctcctccgccgccgcctcctcctcctcctcgggctgcagccggctcggcgggcaggtcccggcgctcccggcgcggggccggggccgggggcggctgctccccgccgccgaccgctgcgcccccgcggcgctccccggccccggagtcgaggctgctgaaattccacacgaccagcgtctgcagcagcagcaccgtgagcgccgcgagcagcgccgagtgcgagcgccgggccagcctccgggcgcacggcgccgccaccatcttcggagcgcggccggcgagcgaggcgcggggaccccggcacgctccgggccgcccccgcgctccccgcagctcccgcggccgccggctgccgctcgggctcccgctcgggccgccgccgccgcccccctccccacacccctgtccccgctggaggggagggtgatggggaaggcgccggggggacgcgggccgaggcggagagggcggggcctgggggaggagccgagggaggaaaaggaggagggaaaggaagggggtgggggcgatcagagaagacagacacccctcaggacgtagtgggagtaggatggggggcgagggggacaattcccaaggcggaaaaagagaggcaggggccgcgaaacaggggacctttggttgagggtgggcccgctcagaatccaggggaggtcaggaagagagggggtcccgaggtcctgttttccctgtgggccgctggaaggaggcagtgcgtggaggaagctcctagccccggagttcgcggtccagggatcttctgtcggtaccagaccggttggcaggtggacacgtgagaaacatttcaggagtgtcagagccacagtctgatcccttcatcctgggcttgaaggggtggggaggaggctttgggtgagtttctggagttaatcagcacaagctctgtgagtgactcctgaatcacacacaatccccggtgccaacgatgtactaagtgttcactgagtcacttctctggtccctgaggactcacaagccaagagactccaaacccagttggcaagtggtatagcggcaaaagggagacccgtggagttactcaaccttcgcaggatgcaagccccaaaggctggccccgcagcctcccagcgtgtccttttccccatccatcctgaagtcccccttcctgtctgcacagggcccaggtcctggggaaacaggtcttgctcttgaaagtggagttctttcccatcctgactggtctgtcccggtgaccttgagccaggaggaggaggactcctccctgagcccaagctttctcctctgtcgtttaggcagaatgatcccaatggactcaaatttcatcccgagccttctctgactcagtctttctggtttttccctcccttgtcctcttgcccagggctttatacacagcagcgcagaacagtgagcatatgggatggcgttggtgtcccatacgggacctagcactctgggaatacaacagcagatcaaatcagtttgtgaattgaggacttggcgtgaatgcttcgcatcttgtctgctgtgctttttcacctcatcctaatttacaaagagaagaaagtggagtgtaatgaaggctcatcagacaatgaggcagggagtgggaagagattgtttcatccactccacaagcatccgtgaatacaaagcttgtgtcagacactgggccaggtgcacgcatccaaaggtgaatgaggtttaatctcatcttcagcaagcctgaggtctagagaagcctgatgtggatgttaatcattaaaatatagtgagataggcctgggcgcggtggctcatgcctgtaatcgcagcactttgggaggccaagacaggaggatcacctgaggtcagaagttcgagatcagccttgccaacatggtgaaaccccgtctctactaaaaatacaaaaattagccgggcatggtggcacacacccctgatcccagctactcaggaggctgaggcaggagaatctcttgaacccaggaggcagaggctgcagtgagccgagatcacaccactgcactccagcctgggttacagagcaagactccatctaaaaaacgtatatataaatatatatatattgtatatatatatattatatataatgtatataataaatatattatatataatatatttatatatatgtacatataatatatataatatataatatataacatatatataatatatatatttatatgtaaatatatataatattatatatatatatatggtgagataagcattgctgtagagatgtgcaaaaatgctaagggttcatgagggcaggacgggagtaagcgccaagaaaaaatgctttctgaacccatgtaattagccagtccacttgcctgaacaagaaaagtataaaatgtatgctagtgggggttgtaaactccaaaccaatcaaccttagttgtatctaaagcttagccaggcatgtagcctggcatagaggccttccctttgggcccagcacccctaaccaggagtaaaagaccagaggcaagtttctagggccaccagtcatctgtttatcagttggggatattttgtttacaagcaataacatctattactaacagtaataagacttaagtctatcttttaagtcttttttttttttttttttttgacacagtctcactccatcacccagcctggagtgcagtggtgtgatctcagctcactccaacctctgcctcttgggttcaagtaattctcatgcctcagcctcccgagtagctgggattacaggcatgtgccaccacgcccagctaattttttttttagtacagacgaggtttcaccatgttggccaggctgatctcaaactcctgacctcaggtgatctgcctgcctcagcctcccaaagtgctgggattacaggcatcagccactgtgcccagcccggtctgtcttaaaaatatactttactggatcatgtagctgaacattgcagaggaaaggcttcaggtgaggtttgatctagcaactcacaattatcacctgggattccttttctttccatctctcctctctgctttccatggagtctaccttattccctcttgatgtcacacgatgcctggcctcagctgctgcgactactttgtatcctgtgttcatttctagcccagggaaaggagggtcagtatttcccaggattttcctcaaaggttcggagattttttttctgattagaccagtcttaagttctgggtcactccgagaccaatcagtgtggccaggaagttagaaaatgccgatcaacttggccaagatcccatatttcacctccgccattggggtgaagccagcctccctgtaacaacttggatgccctatagagatcagggtctgatgggaaagaagtaggtgcagggaacagattccatcatttattccacgcagcctcccgaggttatatgaccttggccaagccacctcccctcccaggacttagatttctttagtgccaaatgaggggttggaggagacagcccccaagatttcacatgttgccagaacgctctcttagtgtctcagcagagcttctcaacccagcagaggctgctctggagcctcttggcaaccctgccctctggctcatctttgcttcaaggtctctggccgcatttttcccgttagcagcaatgatgttatctgcttcctccacatctcacatttaaccacagtcctttggggcccaccctctggctccactccctcaggggccaggggcttaaggagtgaggttaaggatctgggctccaagtccctggagagagagttgtttgtttatctcagacttataaaaagccatgcaagaaagaggtttaaaggctccaggcgggttatggacgccataaacagcttatgtgatggttttaggatgaaaaatcacccgagatcgaagaataggaaggcaagcttctggggtcactggagctgtcttcctgcacctcaagaatctttgggtaaggaggtgagacaaagatgagatcagaacagcgggtggcttggagtgggagaagggcgtgaattttgacgaatctgcagtgcacatgtatctcagtaccagggggcgcagttggtttgggcagtgccagaacccctgggagcaggggccgggcatcatgtcttctaagccaaaccaagcaaaagcagccactttgcattcgaaggggccccggctttggcttccactgtggtgtaaaagcgagacaggcagagcttgatgtataagacagagccgaaagcaccgcctgagactccagcggcagccctagcaacagcagtgagagtccttagaatttttaaagctcattcagtcattcaacaaagatgtattggaccctattatgtgccggacgtcatgctgggaaagcaaactataggcgtgtagaagatttcctaaggaactctgctcttaaaatatcgttcctaatctcacttgaccaagagccagagctctgaagaagccccagactgatctgtgggattccctccccacctccaccccaaatcttgtttcatcgccattttccagtgaaggggggagtaaatcagttaatcagtagttttcagctcctaggtgtgcccagcactgagctcggggctgtgagagaaagtggaaggccagggggaaagggttcttctctctcaaggagctgtcagaagaggtcatgggacaagacaggcgcgggatggggtcagaggagggggcagccacagcggagtcagtgtgcaaaatggttaagagtcagatttcccaggtttactcagctctgctactttttgactcggatttctaagtatcagttgtttacctcgaggcctcagttttctcatctgtaaaatgaggctgataaaagggccattctcataagtttcttataaggattcaatgagataatccataagaaaggctttttcctatagtgactgacacatagtaagtgctccgtaaatgttagatgatatgtgtcttatttatttttcttcatttatttgagacaggttctcactctgttgatcagactggagtgcaggggcacaatcatggctcactgcagcctcaaactcccaggctcaagcaattgtttggcctcagcctctcaagtagctgggactacaggtgcacgtcaccacacccactaattttttattattaatttttattttatttattaatttttatttattttgttattagtttttattagtaacagtagggcactgccaattatgagtgtccaaaggtatccagggctgcctggagaaagtagcactaaaacctcatcctcgactttgatagaagattgcacatacccccaagggttaggaccaagtctcattcatctctactttttctggtgctttgcacagtgcagggcactgaatacattttgggggtggaatgaacactgatctatggggcaggtaggaatgagcctgggatgctggcaggttggaaccccatgcttagaagttcaaggaacccaagttcaaacaccatctcggcaacttgttagttgtgtgatgttaagcaggttagttaatgtcaccaaacctcgatactctcaactgtaagtagtgaagaaaaataatacgtatgttttaaggctggggggttggaggcagggaaatggggcagtgtatatagcagagtgtcatacagtttatacaaaatgatagcaccggccaatagcagtgttgaaggaatattagcctggttgcattggcagggtggtctgtaaagcaatgttctccccttgcctcaatgctcctgccccaggtgccagagagctagggctggatatgccttctgcatttaaataaacttcagcctaagagttaaatttagccaaatacattcttttttaaaatttcgatcatgcatttatttctttttggtttattagagcctgttttcacccagactctacaaattttgctcttgaaaaattaaaaaattccccctacgtttcacttctgcgttgagacagaaatcatgaacaggtgggtcacctgtttctgagtgtcagtgagtggtacgctgaacaccctcccagcccactaggaatcccagagtctctccaataagcatttgcaagtgcaaggattccacgtggaggtcagaggagccaggaccttgaacgtccctggagccccacccacagcatgcgaggtcacagacagacaggcatcacctgtacctctttccccagtgcaagagaaagaaacagcctctgatcagaccacaggcataggcaggtgacaaaccccgccaggagcccagctgtgcttctgctgaaatccgcaggcttccaggctaatcatctacccaatgcatcagcagagggagctctaggtagtaaataacattcctctgactgcagagtttcctgtaaaaaaaatctggagacagcaaaggaaagcgaggtcctatgtggagagggcacctaccatgtgtgcagaagaaaatcacaccaatttgcaagagtagggtgttggggcaggagtgggagatgggaaagagagaagaaaatcagaaagcaccacattgcttaagagatgatctgaatttgttttgtctcagcactttgaccttctaaggactcacagcctctatgctacccttgcaaggctctgatgtttgaaaaggggacgcagtccaagtctcagactacactggcagacattttttttctttaaatgttgattgtgggctgggcgtggtggctcatgccttgtaatttcagcagtttgggaggccgaggcaggtggatcgcttgaggccaggagtttgagaccagcctggccaacatgacgaaaccccatctctactaaaatgacaaaaattagccggggatgatggtgcatgcctgtagtcccagatacttggaaggtggtggtcacaatgagccaagattgtgccactgcactccagcctgggcgacaaagcaagactccatcttaaaaaaaaaaaaaaaaaaaaagttgattatatgtgttatgggtgcctaatctaacccctggggccataggcttatttatgactgtggcaatgacaaggatgacaatgatgacgatgacggcaataagagcgaacatttattgagcacttactaggtgccaagccgtatattgaggacttcaacaaatcatattcaccaaatatttgttgagaattgattcaatacttaggacagtgttcatgccagggattcatgggaattcatccacggataagacacagaaagtccctcctgtcatcaagcttgcattctaaggaggcagacaggtcaagacaaacaaatatataaacaagtaatatcagagagtgataagtgctatgaaaaaaataaaaagaggctgagcatggtggctcacgcctataatcccagcactttgggaggctgaggcgaggcgggaggattgcttgagtccaggactttgagaccagcttgggcaacatagccagacctcttttctacaaagaaaaataatttaaaaattagggttggtagtgctcacctgtagtcctagctacttgattctttgtgcccagaagttcaagactacagtgagctagattgcaccactgcactccagcctgggtgtcagataaagaccctgtctcaaaaaaaaaaaaaaaaaaaaaaaaagaaagaaagaaaaagaaaaggaagctgacttgctagagtgactaaaataggacaaggggaaacaggctggtcagggcagaccttacccagacaatgacactggagtgttgataaccttctcaagaaatgtgactgtttaacaactcttactccatttatgcatcaagcatcatctactgactgaacaaataactgtagatccatttttcaaatgtgtgatatataaatgatgctaaattcattgtcattctttgggcattttggattttcttaaagtgattagtaataactatttgcatggtcatgatgggagctatggaatgggttaggaaaaagttcaccaaaaaagaaaagagttaaaaatatccatctcaccaaagaagaattgagagcaactaatgtattagatctcaaatatttttggtccaaatacttttttaatttcttaactttaccctcctcacccctctcaaaggttctgtatgccacagatgtttctatttagcccctgtatctttaagtcggcaggctgagccccgtagtccccaaatcacctctcccatcttgtttgtagcttcttctctgcaccccaatgtcaacccatcctgcacctattgctatttctctctgtgtctctcaaatctcttttacctgaacccctaagaattctattccacaagggctaagtgtacggtgttgggggcgggagtgggagatggggaggagggaagaaaatcagaaagcaccacattgcttaagagatgatctgactttgttttgtcccagcactttgaccttctgaggactcacagcctctgtgcttcccttacaaggctctccttgcacctgccctctaagaactctattccacaaggaaaacagaagttcactggaagcctgtttgatatgccagagtctgttagctgcttctcaaatacccattcttcctttcctgtttggtcaagaattctgattttagttggggtgacaatgagcccaaaccaaaagcaacggttcttagccttcctgtaagttaggagtgatcggaaagaagacagcagatacaattggtagagctcccaagaaatcctttggggtgggagggaagatcctaaataagttgggattgagttccctttgtgccttgccattcccattgttttttttctattcttaacttcagacagggtctcactctgtcaccccagctggagtgcagtggtgcaatctcggctcactgcagcctcgacctcccaagcccaagcaattctcctgcctcagccccccaagtagctgggacacaggcacctgataccacatctagtttttgtatttttagtagagatgggggtctcgccctgttgctcagtctgatctctaacttctgagctcaagcaatctgcccacctcaacttcccaaactgttaggattacaggcatgaaccatggtgcccagccatcattcccattcttttggactggaatgtagaaaggatagctggagctccagcagccatcttgtgaccatgaggacagaggccagtactacaggtggtgagccagaaagaaagaaacagcttgggttcctggtgctctgctgtctccggcccatccttagacttttcttcacacccaagaatgagccccatattagttggagccactcaggctgggtttctgtctctatagctggtacgatgacgtgtctgatagaatgaaacagtctaactgaaagaagctcagggatagaggtgggatttgggaagagctggaaccagggacccaaacacagaagtcacccgctttatctcttgctctgcttccttctgcctgcttgattaattctccctcctggcagaacaatgctgtccacatggtaagaagcataactgccacagctcctgagtgccacactgtacagcctccataaagggacaggttctccctctaaggccatgagccgcaagcgggtcctcaatgctgtctcattcgctgcattttgctggtcttgtcactctcccaggcatgaagccaccagctctctctcccctcctgcctctgactttcctccttccccacttgcctgaggaccttgcttcccaggttgacaagggagggggaaggaagcttcccaccaagctcctgccatttaatttccccacttttctacatcggtgtcgcggactgtttttgtgaatgaactttctaggctccaggtcgagacccactcctccatctgccaaagagaccccaccttgtcttacctatctgcggacatcactccaacacttccattttctccttcctttatcatcagttcttcctcccgagagcagcatttcctctagcatttgaattccctggtatttctctggttaaaaacaaaagttctgaccaggcgtggtggctcatgcctgtaatcacgcactttgggaggctgaggcgggcggatcacctgaggtcaggaatttgacaccagcctgatcaacgtggtgaaaccctgtctctactaaaaatacaaaattagctgggcatggtggcacatgcctgtaatcccagctacttgggaggctgaggcaggagaactgcttgaacctaggaggcggaggttgcggtgagctgagattcggctgagctgagattgcaccattgcactccagcctgggcaacaaaagcgaaactccatctcaaaaaccataaaataaaaaatgttctctcctggccccacagccctctatagcttcgatctcgtgtttctctttcttttgcaggaaaactcctcaaaagcattgtctagctcaccgtatctccaattcttccctttccatcttctcctaagcccttctaacacacacacacacacacacacacacacacacacacacacacacgctactcttaagctcatcagtgacctcattaccagattcaatagttacttagcctaatgcaacaaaggtcacagttgtcccttccttcctccttatttatttctttggcttccaggatgctgctctctgggttcgctcctatctcacagctgttccttctcagcctctttggttaatcccttctcttccagctgtcctctccccttccttaccccaattttctgtgctggcttttcccaggctttaattccatagcttttcttctccaccatccagatgcatggctataaagaaatcctctaattcacatgtttatatttccagcctgtactcctccccaaactccaagttcatgcactcagttgctcacccagcatcgccacttggatgtctaatagacatctctgtcaagaactgaaaaaggggctggggatttgaccctacttgcaaactaacaaggtattctgccatagcttcatgaattccagcagaagacatgagactcctggatcagagacaaaagatcctattacccacctcatagcaggcagcatgagcttcatgtttgcatcagttccctccctgcatcccccaccaagtctctggggtggtacagagggggtcaaggcagatgctctacacatgactgagaaacctggagttttgaaaaactctgtattttataatgagctgcaagcaaatctgctcaacctttgccccagagggagacattatctttattagcctgaatagcaaacaaatctgccctctgcccagaagggagacactatctctgcctactaaggctgttcacaatacaaatatgaagtttatatgccttttgatgtcttgaaaaggtcatccggaggccaggcatggtggctcatgcctgtaatgccagcactttaggaggccaaggcaggccgatcacttgagcccaggagttcaacatcagcctaagcaacatggagaaaccccatctctacaataaatacaaaaattagctgtggccagacatggtggctcacacctgtaatcccagcactttgggaggccgaggtggatggatcacctgaggccaagagttcaagaccagcctggtcaacatggcaaaaccccgtctctagaaaaaaatacaaaaaaagtagtcaggcttggtggcggatgcctgtaatcccagctacctgggaagctgaggcaggagaatcacctgaacccaggagttggaggttgtagtgagccgagattgccccactgcactccagcctgggcaacagagagagactccatctcaaaaaaaaaaaaaaaaaaaaattaactggaagtggtggctgtgcccgtagtcctaaatactcaggaggctgaggtgagaggatggcttgagcccggaaggcggaggttacagtgagccaagattgcaccactgcattccagccaaggtgacagagtcagaccctgtctccaaaaaaaaaaaaaaaaaaaaaagtcatccagaatagaaagccacaatgtgcagaaatataaacagcccatggagaattatttcctaacagtattaaacttatcatatccaaaatggaattcttgaacttccttcccagctcatgccaccaaaagcttttccatatcaagagctttcagtcatcacagctcctgtcttttgctcgtaatacgcacccaattcatcagcaaatcctgttggcttcatgttcaaaatatttcccaaatcagattacatctcactgtccccatggccatcacttaggtccaagccacattgtctctcccttgattccgcagtcacctcctaattcacagccctgcctccaaccttgctctgttctctccacagcagccagagaaaacctgattaaacttagctgcagtgttgtcattcattagttaacagcaacatcaaggggatcctcatttctcttagaaataaagccagtgttcctataagagcctgcatggcccccaccatccagcccccagcatctctctcacctgcacaagctattttcctgccctttcctcacacccttccatcaccctggtttcctttcagtttcttaaatacgccaggcaggtgctcacctggcggcattgccctggtttttcattatgtctggaatgctgtgcacccagatatctgcctgtctccctcccttaccttgtctccctgcctttttcaagcttctgaagaaggtgtcatcttctagttacagtagttagctagtcagacatgaacagggcaggagagggctcctcccccaccactaggaatgtcaggcaaccatggtcaggcagctgttaactgtctctctaaaataataattggttgcagtcagcaccagggaaaggcagtttcccaatgaacagaaatacctgaaactggtgatcagcagcttcccgataagatctcaagagttgggcaagtaggttcaagcatgcacactaagaggcaaaatggcagagtttaactggtatatgacctcctggggacatctgactggtaagggaagaacgctttaactgagcatgcgtacaactccaggaagcacactcagcatgcttctctccaggccactgctccaggtaacatcctgccccaagggaagaatcaggggagaagggacgcaagaccccagaagcatgccagtgtatgaccccaagtcaaaggtcaaacagcgcactttatctctcaagtcgcctgcttggtcctcttccaagtataccattttttgtttcattcctgctctaacgcttttttttttttttttttgagttggagtctcgctctgttgtcgcccaggctggagtgcagtggcttgatcttggctcactgcaaccttcccttcctgggttctaagtgattctcctgcttcagcctcccaagtagctagaattacaggcatgcaccaccacactcagctaattttgtatttttagtagagacggggtttcaccatgttggccaggctggtctcaaactcctgacctcaggtgatccacctgctttggcctcccaaagtgcggggattacaggcgtgagacaccacgcccagccattcctgctctaacaccttttttttttttttttttttggagactgagtctctctgtcaccaggttggagtgcagtggcatgatctcagctcactgcaacctctgcctcccaggttcaagcgattctcctgtctcagcctcccgagtagctaaaattacaggcacccgccactacgcccagctaatattttgtatttttagtagagatggcgtttcaccatgttggccaggctggtctcaaactcctgacctcatgatttgcccgcctcagcctcccaaagtgctatgattacaggcatgagccaccgtacccggcctctaacactttttaataaactttcactgctgctctgaaacttgcctcagtctctccttctgccttatgcccctcagttgaatcctttcttccgtggaggcaagaattgaggttgctgcagacccgtatgaattcatcgccagtaacattctcatttaagcctttcccaactatcgcagtggaatcacagtgcctcagccagcacccccaattgccttgactttgttttattggtctccgagcactgaccaccttgttcacttattctatttattgttgtctgtctgtctgaccccattagattataaagcccatgagggcaaggttttgtctgctttgcttactgcttagtgcttggcacatggtaagagcttgattaatgtttgttgatgaattgaagttgaagtcagagtccaaagacattgcagaaaacagcattgattatcctgcctcacctggggcgcaatgactggagttacaggaaaggggtcacataagaagacagagaaggatccggtgtggtggctcacgcctgtaatcccagcacaacaggaggctgaggtggaagtatggcttgagcccaggggttcaagaccagcctgggcaacatagaaagaccctgtctctacaaaaaatttttatttttttatttttttaaaaactttaagtcctgggatacatgtgctgaacatgcaggtttgttacataggtatacatgtgccatggtggtttgatgtacctatcaacgcagcatctaggtttcaagccccgcatgcattatgtatttgtcctaatgctctgcctcccctttccctccaccccccgataagcccgggtgtgtgatgttcccctccctgtgtccatgtgttctcgttgttcaactcccacttatgagtgataacatgtggtgcttggttttctgttcctacattagtttgctgaggatgatggtttccaacttcattcatgtccctgcaaagaacgtgaactcattctagctgggtgtggtggctgtgcacctgcaatcctgctactccaggaggctaaagtgggaggactgcttgagcctgggaggtcgaggctgcagtgagacatgatcatgccactgaactccagcctgggcaacagagggtctctaaaacaaaaaacaaaaaacaaaacaaaacaaaaaaagcaaaaaagaggaagaagaagaaatgagaacctatgttaaccatgtaatgaaaaagccactggcaagaaggggagacaccaactgtgctgttgatgtcggaggcagggcaacagtgggggaacaagaccctggacccaaaccacttgggtttgaatctcccatgtacttcttactaactctggtgtgttggagagattgtttcattttctcctttctttttcatctgcaaaactgggggaacacggtactctcctcctgcgattgtcagggggcttaaatatatgaattaatgttaaaaagcactcgaagtagcactcagcacatagtaacatcaaatacaagatctgaaaactgttagaaaaacaatgagaacttgataaaagaaatacatatatatttgaagaaatcaatatgcttcttttccatagcaggtagataaatagaaagaaaaatcagtaaggacatagagaaattgcacactgcaacctacaaactcaatttaatagatacatagagaaacacttaccttaacagaaagtaaatattatcttctaatatccacggaatctgtcatatacctaaacataaagtaaacctcaacaaataaaataaaaaagatttttctcaagccagattctccctaatcataatccaatattataaatattttattttatttgttttaataacttaaaaagtgagaaacaccaccctagataatggaatttaatcttttttagaagagcaataaataagagaatatcacaaaatcaacagaatacaacaaaagctatagtcagaggaaaattaatagactgcaaaaccttcattataaagaatgactaataagacaatgaagaaatgtatgagcccagaggttacaataagaaaataaaagaaattctccataaaaaataataatgacagaaactgaatgtaatgaaatggaaagcacaaacaacagcagaaagtaaaaaatcaactcaaaaactcattttttgaaacaccagattaaacccctggcaagtctgatttagaaaaaaaataaataaataaaaataaaagtatagctatgtaaaaaagaaaacttagccaaaatcacagaagtaaaggaaaattgaagagaatatcacgtgcaattctatgccaatacatttgataacctggattaagtggctaatttcttgggaaaaaaataaacattaaaaatggcccaagacaaggcagaaaacttggagaaaccgatgaccagaaagagatggaaaatttaccagatcagagaggttcaaagctgagttgtatataaccttatgtgtaataaaaaggattgctccaatgttacttattccaagttgtacacagttgttctcagacttgactgcatggtggagtcacccagtgagatttttaaaactaatgatgtccaaatcccaccccaagaaatatctattcaactggtgtgggctgtgccagctatcagcatcttgaaacagttctccaggtgatacaaatgtgcaagccaaatgttaaatcaagtgtagcctaaagctgtcttcttatgtattcaagtttggcctaaaggtttttctgtatctgctgaactatagcaagtggaggtgtaaacagaccatagcctccgcttgtgacaatcactgagttttggccaatcaaatgtagccaactgtttgaaccatgttcaaataaggcaaacacgagctgtaaccaatccagctgtttctgtacctcacttccatcttctgtacatcacttgtctttttctgtccacaaaccttcttccatcccctggctgtgctggagtctctgagcctaccctggctgggaaggctgcccaattcaccagtcgttcatggatcaattaaactcctttaaatttaatttgcctgaagtttttcctttatcacaaggttgctagcccctgccatagaaaggaatgcagagcttttcaattaaaaaacaaaaacaaaaaacaaaacaaaaaaacccctcagttctggtaaagatagcaccaggaaagaaaactataagttaactttacttatgaaaaaaaatgaatcttttgaataaactaccagcatcaaaggaataatgtgttatgaccaagcagtttattccaggaatttaagtctgggttgaatcaggtaaggtatcaacataatccaccagttccattactctgttaaagatgaagctgagaaaccatttgattacacttgggagtcattcttaagaaatcaccaagtaaaccattaatagaaggaaattaagtataatgcaggctaacgaacaaaaaattactcaaaatggcaaaaattaaatcttaatgcatttaaaagttcttgtaaatgcattaagataagaaaacaaaataatctgtaagtattgcaaaagaaaaactaaaactctctttttgctgttggtttgcttgtatactatattagagttctacatagataccaaaccaataggatataaatatagatagatatggatacagatatatgagatggggctttattagcggcattagctccgatgataatggaggctaagtctcaggacaggctgtctgtaggccggaaagcctaggatgccagtagcctggctccattcaagtccaaagcctcagtgtcagaaaagccagtggtgtaactcagtccaaggtcaaaggcctgaaatgaaaggggcattgagtaagtcatgaagtcccaaggccagacaccctggagttctgatgttgaagggcaggaggaaagtggcccacctccatgagagagagagaggagaggaggtatattagtctgttctcatgctgctaataatgacatacctgagactgagtaatttataaaggaaagaaaggaaaggggtttaatggattcacagttccacatggccggggaggcctcactatcatggtgaaggcaaggaagggcaaatcacgtcttacacagcagcaggcaagaaagagcttgtgcaggggaactccaatttataaaagcatcatatttcatggacttattcactaccatgagaacagtatgggggacaccacccccatgattcaattatctccacctggccccacccttgacacatctggattattacaattctaggtgagatttggttggggacacagccaaaccatatcagaaggagaggaggagagtgttaccttctccaggagagactgtccgtttctccaataaaaggagaggaaattctttcctttctcatattttgttccacctgtgctccccactgattggatggtgcctgcacacttggagggtagatcctccccaatgaatctactgactcacatgccagcctcctctggaagcaccttcatagacattccaaaagcaatgctttatcagttctctaggccttccttaatccattcaagggtaacctaaaatttatcatgacatatactaaagaaacctaatagactctagtaaaaaacaaacgaacaaacaaaaaccctactacaatcaataagaatttgtaaaggaactggaaacagtagaattatacaaatattaataacctttctctataccagcagtaagaaccttgaaatagatatggcaggaaattagatggaaaaatattctagttacaatagcatgaactataaaataacttgggaccacttaagaaaaaagacttgggaattataggaaaactatttgtaaagtaatgcccaaaaatctcattgaatttcataaaacacgatccacacaaacgaaaataaatgctaagtcttgcatgggcaagttgatataaaatataaatcttacaaaaatcaataaaattaacttcaagttccaatatcaataaaatatcaacagcttgcttttaatggtgggtggaggggaaaagggagattggattaaacgaatggaggaaggaatacacttgaatgaccaaatggaaataaatacaaacatacactcatatatgtatacaaggcagacatatacttgccttaacatatatcagaatataccataaagtcaactataaacaaataaatatgctgctagtttagaaataaatagatcaatataacagaactcaaagacaatatttgaatctggtagggaaatatggtttatttgaagtatgttgctagcccaactgattttccactggaagaaaataatgtcggactcctataatataccatatattaaaaaaacaaatccaggctgggcatggtggctcacgtctgtaatcccagcactttgggaggctgaggtgggtggatcgcctgaggtcaggagttccagaccatcctggacaccatgatgaaaccccgtctctactaaaaacacgacaaaattagctgggcatggtggtacatgcctgtaatcccagctacttgggaagctgaggcaagagaattgcttgaacccaggaggtggaggttgcggtgagctgagattgcaccactgcactccagcatgggcaatagagtgagactcggtctcaaaaaaaaaaaaaaatttaaaaacattaaaaaaaatttgtgttaatctagatggagtaaaatcttaatgtaaataaaacaacaatggggttttttattttaaaaaataaaaatatttggtttaatcaacaaatgaataaagaaaatgtggcatagacatagacacacacacacacacacacacacacacacacacacacacacacactccccagggaatactactctgtgataaaaaggaacaaaataaaggcatttgcagcaatctggatggaattggagaccattattctaagtgaagtaactcaagaatagaaaaccgaacgttatatgctctcactcttaagtgggagctaagctctgaggacgcaaaggcataagaatgatacattggattttggggactccagggaaatggtgggggcagagtgagggataaaagactacactttggggccaggcacattggctcatgcctgtaatcccagcactttggaaggctgacacgggcggatcacctgaggtcaggagttcaagacaagcctggccaacatggtgaaaccctgtctctactaaaaatacaaaaattagctgggcatggtggcatgtgcttgtaatcccagctactcgggaggctgaggcaggacaatttcttgaacccagaaggcagaggttgcagtgagctgagatcacaccattgcactccagcctgcatgacaagagcgagactttgtctcaaaaaaaaaaaaaaaaaaaaaaaaagaaaaagaaaaagactacacattgggtacagggtactctgctcaggtgatgggtgcaacaaaatctcagaaatcaccactagagaacttattcatgtaattgaaaaaaaacaatgaagaattcagaggtgatagaaaacaaaaagcagcacttttggaatatactatgaaaggaggtagtggaggttatgagaggcgtcagaaagaagacaattttgaacaacgtgagccctatcaactgaggaagcatgagaaagatgtgtagcatagtggacctgtgctaagatgtatagcatagtgtagtgtagcacagtggagactggactaccattcagcaaagtaaaggaatgaagtactgattcacaccactatgtggcaagtctttaaaacatcattatgctcaggagagaagccagacacaaaaggaccacatgctgtatgattttatttatatgaaatgtccggaaaaggcaaacctattgaggcagaaagtagattaatggttgccatgggtacgttgtttgttttgggggtgatggaaatgacctaaataaaattaggttgtggtaatggttgcataactctataaatacactaaagcaggtgagttttatggtatgtaaattatatctcaataaagccatgaaaatattaatgccactacagttacatttattaactatgcaaagcataggatgtcctattccaccaagagtatcaagtacagattttgtgtgtttgtgtgtgaatgggtacataccatttcaaataggtcaattgtcaaaaattgaaatgcgagatcagtaaactgccatcacctaaaacttcaaaggggcatgtgactagcttagcaaaggtacacatggcgatgaaacatgccagctctgggggcagaccacgctgggttcaaatctcagttccaaaacttactccttgtgtggcacatggcctcagtttccctatctgtaaaatggagagagggttgttgtgagaatgaagtgaagtgatgtgtgtcaataacagataatccttagaacagagtaggacctcaacaaaactgatggtggtagtggtggtggtagtgattaggattagagtagagaaaggatcagaggagtcttatgagatgtatttatttgtattcattattaccttttatttatatggatatatttgcatatatggacattttactttaaaattcacagtattatccatggtaagttgtcatgtaaaagttccaaaattgttagagagacagaaaattgctggctattgccaaagtcatttatatactgggaggaaaataggtgctatctttaaactttctcatcagtatacctaggatgcggcgggggaagaggactccattccatttgtggtgttggaatcgcaccgccccccacccacaacggttccttttacaggcagtggaaacagctctgaaaagcttgctttgggagggacacccagcatgctgagatgtcacagtggtgctcaaggaagctatcattcatactgctataatctaacacagtgatggggttctgggtcagataagacactgctaattttttaggccaaagaaagagatgtatttttctgtaggctgttatgtgtttgtttaaaaatcatgtcattccagcctgggcaacctaacaagacccagtctctccaaaaaaaaaaaaaaaaatagctgagctaacaagtacatctgttgccccatctgttcaggaggctgaggcaggaggattgctagagcctaggaggttgaggctgtagtgagccatgattgcaccactgtactccagcctgggcaacagaaagaaaccctgtctcaatcaatcaatcaataaaacatagaaagaactgtttgggggtactggaaatgatatataaccttggtttgggtggtggtacactggtgtatacatgtgtaaaaatcagctgagctctatacttaagttgcatatactttatatattttatatttcagaaacagagaaagatcagaatctaattcaaggaaacattcctgtacacacaaaaatagtcatcatatcttatatgcaaagatagtcatcatagcatctttgcaatagcaaaacatctgaaacaatctaactttcaacaatattgtctaatggttaagtaaattatggcatatccactaattagaatatttatataactaaaatgttcatgaagagtttgcaaaaacatggagaaatgccatgtcatcaagttaaacaaaaaaaatcaggagctaaactccttatatgtgatatgtaaacataattatattaaaatatgcataaaaatgatgacagaaatgccccaggctttaatactgaccatttttcagtggtgaaactatggaggattttcctttcttctttcaaattttctgcacttataataaataaatttggttttcataattgcataaacataactaatacttttaagtttacaatagcaaaaagcaaacattggaccaggaatcaatcttgcagtgattaacagcatgggatgcttgcagctgcagacttggtgtcagatgctggtctttttgctttaaaagggcagtcattactatggctaaaaccaatttcgtaaggagatcaccatcaggcttggcattacagctctgttgaagcctcctgacatacagttttgagatgcgcctcctggtcagaaaatagtcggctatgtcctaccaattaaggatttctccttcatcaccagaataagctcttcggataacttatacttccaagcagtttctgtgcagccagcactggataaaaatgctatcaccaatggagtttgaatctcccaagatgacaatatatccatatatagtcatcctcggtgtctgtgggggattggttccagccccctccctccaatactaaaatctacaggtgctcacaccccttatataaaatgccatagtatctgcatgtaacttaggtacatctgccagtatactttaaatcatctctagattacttatgatacttaatacaatattaatgctatgtaaatagttgttatactgtattttttcacttgcattattttttgttatattgttatatatttttcctgaatatttttgatttgtggttggttgaatctacggatgtagaacccaaggatagttctagagaaggctcctttgtacctaaatttggagcattccaagtatcctccaaagccttctactactaaaggaagatacacatttttgggaggaggaacttggaggaatttgggcttgatctttgaacaagattgtctgatgaagacacagatgatagcagcattaaatatcctcactgcatttatcctttagtcagccatttattaaatatttattgagaagcagagcttgcactaaactccattatttttaagcttacactaggggttggcaaataactttcatcctgtatgcctaatttgatgggttgatagtggtgctctcaaatgctctcctggaaaagattctgggacagggtccaaactcaagtgaaaagagcaatgatcgattagtaatgtctcccattcttgcagaaagggaaatggtggtatatatgctatgctggccggatatttttctgccaggttaatgactgtcacttaagccttgacacacactctctttccttacaagttaaaggaaccaaacttctatccaagttaacatcactggagaagcactaacagagggggaaatagagacatgtttgttagcaatctactacattctagaccttgcagagttctctttacatatactgagtcatgtcatttttaggatatcccttcaaggtaagcatccttatctcctttttacagataaggacctaggcgaagagaagcaaaataactttttgaagtctcacaatcagacacagcagaatcactcttccatccaatgagaaacccaggcttgatatggaaccaagtaagataagacagtgtccccttcttttcagaaggttataaaattaattctacaaatttttgataattacctgagttaaataggtccctttggagaagtattcaatccagtttgttcatcaagacaaaaggaggcacagtcatttccactttctcttattttttctttttttctgagacagagtcttgctctgtcgcccaggctggagtgcagtggcatgatctcggctcactgcaacctccgcctcccgggtttaagcaattctcctgcctcagcctctggagtagctgggattacaggtgtgtgccaccatgcctggctacttttttattttttatttttagtagagacgggatctcaccatgttggccaggttggtctcgaactcctgacctcgtgatctgcccgcctcagcttcccaaagtgctgggattacaggcgtgagccactgcgcccaacccattttcactttctgcccactcccatacaggcaagcactagtgtccttcaaagagggtggtactcatatcatccaagcagcaacatcagagcattttgatcctggatacaactgcacactctatggatgagctccagcaaattcaactgaccctgtttttcagtgtggttcaaatgtctgtgattatttggtggagcagtcatgatctcataaaattacatataattacaaatttactaagtgccaattcctctgctaagggctccagctgcactatggtgttgcatcctcacactatctctgtgacagaggtaacatcattatcctgattagacacatgaaaaatatgaaactttacagccaagaaacttagtcaaagtcacagagctagtaaggtagggctgaaacttcagcccaggccatcagacctcaaagtctatggcttaacttcaatttaaactgtttaatcaacttccagttctggctagtttccagtaggtcttccctagaggaaaggacacatatttcaggacaataatttcagtggaagttatatatttgagtagagatctcaggaagcaccagaagaggactggagagtgagacagggaagagaagggaatttatctcatcaagcaacttactctatgggaaactggagtccaatatttcttggagaactctgggtaacaatgtactaaatgtaaccccaaaacaagggagctgaagtatttatacaccctttcttagtagttattggttgagatctgctctcacagaacatgaattccttggcacttcaagtccgccacacatgtggagagagtggatgctggtggccagaaagtacccttaggcaaagaaccctaggactggaggccaaagccagtgagcctatgtagaaacatgagggcctaggaaatgtgggcagcaacaactgccaaagtctaccttcactttctttttaatttcaattttcaatttttgtttattttttgtaaacaggatcttgctcagttgcccaggcagaggtgtggtagtgcaatctcagctcacagtaacctcgacctcttgggatcaagcgatcctcccagctcagcctcccaagaagctgggactgcaggtgcatgctgccaagcccagctaatttttaaaattttttttatagagatgggatcgcactatgttgcccagccgggtatcacctcctgggttcaagtgatcttcccactcagcctcccaaagtgctgggattacaggcatgagccaccacacctggcgcttctctcttttaaataaacaacttgatgagttgatgggtgcagcaaaccaacatggcacatgtatacctatgtatcaaaactgcatgttgtgtacatgtatcctagaacttaaagtataattaaaaaaattgaattacttactttaaattggtgaatggtatggaatgtgaattatatctcaataaatgtgtcaaaaaaaaaaacaacttgactgaggtgcaaattatagatcataacatttaccaattttaagtgtataatttaacaactcttggcaaatttacagagttgtgtaaccatccaacatcatctatttttaggacattttcatcacccagtaggatcccacatacccatttacagttacttcacattttcactcccagccccaggaaaccactaatctactttgtctctatggttttgccttttctggacattttatataaatggaatcatacaatatgtggtcttctgtgtaaataagaaagtccctctccaaatggataacactgtagaaatgaaaaaaaaaaaaaaaggagggggataggcaagtaacttctagcaagagacttctccatatgggaggtgggaatgttctagatgaaacaaacaatgactataacgcaactggcaatgaagagacaccccctgatcactgtggaatctcatcttccccaggatgcatttgcatatacaagcttttgagtgaatgtattttgaaggaatcttttgcatacaaaggactagcaggcagcaagctgtgggttaagaggctttgaagcccattaaaccatcaacctcaacatggaaatgaatgggatcaaatagtttctgatggtttcaggagctgaaaagggtcagtctttgggagtgactgatgtacaaagggatctcggtttcttctcaggcttgccaatccctttatactttccccaaaccttgtacatgttaatgaaattgacacaacattaatggaaggcaactagagcagaagagctggtcaacggtcaaccaccttgtgtctccaggacagccatcttccaggaaactgaagcctcctgtcacacagactttgtgtctgttggataaagtggttaaaattccccatgcacaaggcataattggctcatgactaaccgtctgcagaaacaaccactgataaatgcaaataagatgtgggatgtgggatgtggtccacatcatctcacacaaaacagacttcagcctcctgctgaaggtcaatttctccaagctgtttctgctccttgattctggaccaacccatagagtagaattttgactattgtccctctggggatccctgtcacgtgctactcaggagcacccattttttttttcttttgcattgtgaacaaatcgaggaataagcataacaacaaatgactggccaaaataccagctttattgttggtaatgccaggccagaaggtaaggcttatacccacaaccacagtgtgtttccctgatacatacccctgagcctggatcctcaaatccgttaaagggaaacagcagaagagcagctgcaaaggagctagtctgggccccaggagtagagacagaaagaagtgcacgtctgctcctctctctacaaggccagcaccaagccctgacccaggcatgctgatgccacgtatgacaccctcatccagggacaagcccagagctccaaaagaaagtccaagggactgatgccctccaccctgagatttcatctttccaatcttttcttatcagatacgtgatttctccactcttgtagaaaagacagggacaaggtgaagggaaggatagaagcttccttttgaataattccaggaggtagagggtgtggtgatgaaaaatttatattctttggactaataaaaatattagattagaaaacaagggccaggagtagtggctcatgactgtaatcccagcactttgggaggcagaggcgggtagatcccttgagcccaggagtccaagaccagcctgggcaatatggcgtgacccccatctctataaaaaataaaaaaattagccaggtgtggtggcatgcacctgtggtcccagctgctcagcaggctgaggcaggagaactgattgagcctgggcagtcaaggccatgatcacaccactgcactccagcctgggtgacagaacaagactctgtctcaaaaaaagaaaaaaataggctgaggtgggcagagcacttgagctcagtagttcgagaccagccggggcaacatggtaaaaccctatctctacacaaaatacaaaaattagctgggtgggatggcatgtgcctataatcccaactactcaggagcctgaggtaggaggatggcttgaccccaggatgttgaggctgcagtgaaccttgattgtgtcactgcactccagcctaggggacagaccaagaccctgcctccaaaaaaaagaaaagaaagaaaaaaaagaaaaatttgcctgtaagagaaaaaataactttctctcttatctctgtctccctgccgatacacacatgtgcacatgcatgcacatatgcacaaacacacacacgaggagttgaagaacttggattcttgccctgcaaagtattctttcagccctactttcccatgatttcagaatctataagagccttatcttagaatctaccagctgcagagtatgctgtttgtagatgccctgtctatctctgctggtgcttccagtaaatgtgtagccaggacttgcccactcaagcctccagggttccagcaggtaaccaaagctaatggaaggggccagctataggagaaaaggcagcactggggactttggtgacctggagagcacaggctgccccactccagcttattactgtcctgcgggaatgcaggctcactgttgcccaatctctctgagtctcaagagaaggaagccattagcatttatttttgtgtgcaaaatccttagctgtttaacagctggctctgtttttaaaaacattgcttgtttgggccaaatgaaatgcatctgccaactccatttaacccatggtcagctgcttgtgattctggtgtagaatggccacatgggcaatgacatccatccttctgacatcctgggccagccatggaaggaaaagtagaaatttgctgtgagggcattggttaggattagtagtccccagggatgctcactattgcctgtggtagtgtctcaaactccaccattagaagtgtattccctcaaggccgggctcaatggctcctgcctgtaatacccagcaccttgggaggctgaggcaggcggatcacctgaggtcaggagtttgagaccagcctggccaacatggcgaaaccctgtctctcctaaaaaatacaaaaaattagccaggcatggtggcgggcacctgcagtcccagctacttgggagactgaggcagaggaatagcttgaacccaggagatggaagttacagtgagctgagattgtgccattgcactctagcctgggcaacagagcgagactgcccccccaaaaaaaaaagtttattccctcgaatcctcagggattatctatgtccaaagtccccagaggactgcaagtgtccctgagtcatgtcccacactttgggaggcagaggcaggtgaatcccttgagcccagaggtccagtccacttccagaggactgcacacataaaactgtgacatcagcttctgggggctgttcttgtggtcatcccgtgcccaccttggagactgtaacagcatccccctaccctcaacactcagactcacccttaaaagcattgataaatggcagattttagtacagttttcttgagagatggagcagaggctgacagggtcctgtggacataaaacttcctcctaatcccctctgaatattccccatttagaatgccacatgcaggatttaaaaaaaagtctcccttctttttccttcttagggaaaatgctccctctgaccaataccttccaagaaataaaaacacaagtaaaatccccccagccagtggcttctccagccaaattggtcccgtcaaccttcatataccttcaggaaagcaaacatctgctaatttcatactgacagccaatatctatggagcacttaatgagacgggcactgttagtagcacttctcaggtacctacctatatatgtatgtataattattatttccaatatacagatgagaaaatgaaggcacggagaagttaagtaccttgttcagatcacagccaggaaacagagaaatggggattggaagtcaggcagtcttactccagagtctgtgctcttgagacaaggttggcaaatgtgttctgtaaaggcccccatagtaaatatgtgtaggccataccatctctgctgcaactactcatctctgctgttgtggaataaaagcagccatagacaatatgtaagtgaaaagccgtgtttcagtgaaacgtattcacaaacataggcagccaatccctgttcttgagacagcatgctgtacagggggacaaacctcagactggctgggccctgaccccctattcttccttctaccactcaccttcctctaccaccaatagtaatagcaacagccacagcatttgtagaatgccggcttgagatggtcatacatgataatcatatgtcagggtaggattaagggaccatgatttatctcaccacccattagcaggtatgatggttaatttcaggcatcaactggaagaacgcttctggatgagatgaacgtttacattgaggaaagaggattgttcgtcatattgtggctgggcctcatctaatcagttgaaggcctgaatagagcaaaagtctgggcctctacaagcaagaaagaattctccagcaggccgcctgcaacttcacctgtaccatcctctcctgaatcccccacctgccagcccacagatttggactcagccgcctccatcatcatgcgagtcaatggctcatcataaatttccttccgtatgtatgcgtatcctattggtctggttctctggagagccctaatacagcaggtaaggtcgtagctagatggttgaggatacaaaactgcttgggagtggggaaaagggtgacaagtgctagaaacacatagctgagcaccagcaaagaagttggatgactccagatgtcctctccctggtttccctaaggtttggctcaggtcactgcagtcatctctccatggagcagtctatcaccccagaccactgctgggctgaagcaagcccaggacagcatttgctgtctgactggccctgggtccctggtttgttccatccaaaggggtatggatgatagggtagtataaatgcctcctgttgccataatctcttccttcatacgcatttttaaaaactatttaaaaaagaaaaagaaaagtaaagagaatccactccctggcctttttcagttttacctttttttttccttttttttttctttttgagacagtgtctcactctattatgcaggctggagttttttttttttctttttctttttctttttgagacaaaacctcactctattacgcaggctggagtgcagtggcatgatcttggctcactgcaacgtccacctcgggcttaagcaatactcctgtctccacctcccgagtagctgggaccataggtgtgtgtaccaccacgtccagctaattttttttagagacagggttttcctatgtggcccaggctggtctcaatttcctatgctcaagtgatccacccatctcagcctccccaagtgctgagattacaggcatgagccaccgtgcccggcccctccacacaccttttaaagtagtatttctaaagccagcttgtctgtagttgctgcattccattactccacacttacaggcaaaataccccaaaatggcctgtaatcccaacagtttgggaggctgaggcaggcggatcacttgaggtcaggagttggagaccagcctggccaacatggttaaaccctgtctctaccaaacatacaaaaattagcgggatatggtggcacatgcctgtaatcccagctacttgggaggctgaggcaggagaatcgcttgaacacgggaggtggaggtttcagtgacctgagatcatgccattgcactccagcctgggcgacagagtggaactccgtctcaaaaacaagcaaacaaacaaaaaacaaaaatagagaaagaagaaagatgccagggagagagataagaaagagagagaccaggggaaagttgaagacagacctgagatggggagataaaaaaaaaaaaaagaaaagaaaagggaagagaaccagagctaaggaaaggagaaagggaataaaaaacagaaagcaggaacaccagagagattcataaagagagacagagagagaaagggagaggaaaggaggcaagggaacaagagacacagagaggacatgaaaggtagggagagaagcctgcagagaatcacaaaaaaaagaaaagaaaagaaagaagaatcagaggatagagacaaagatgagagaatgaacaacctactcaaacaacaaaggcttttgagtacctctaggatttctcaacttcagcctattgatatttagagctggatacttttgttgtttttttttttagacagaattttgccctgttgctcaggctggagtgcagtggtgcgatctcagctcactgcaacctctgctgcctcctggattcaagcaattctcatgcctcagcttcctgggtagctgggattacaggtgcataccatcacactcggctaatttttgtgtttttagtagagacaaggttttgccatgttggtcaggctggtctccaaatcctcacctcaagtgatctgcccgtcttgacctcccaaagtgctaagattaggatcatgagccactgcgcccagcctggatactttttttgcgctggggactgtccaatgtcttgaagggtgtttagcaacatctctggcctctacccactagatgcctgtagcaccacctcccacagttgtgacaaccaaaaatgtcttcagatattttgtaaatgtcccctgtggcaaaatcaccctttgttgagagccactgagttaaagggatgcaatttttcatgcttttcagagcttaaattatatataaccaagggaatgatgggcccatggcagacagagaatacttaaagcccattttcctggagcactaattgtccttgatggtattttaaagcattatttttacatgaaaacaaatgtgggtatattacagagtagaatctcaaatttaaggcttggaagaaattttatgtctgaggtggggtgattttggctatactcccagaatccttggcaggtacacatttacatttctctgccttggaggaagctaataatagctaccatttattgagtgcttacaggggccaggagctttagaaattatttcccatttgatcctcactgggtgtttattattaatcccattttacagatgaggagactgaggcccagggaggtcgtgaaaccccattcaagtactgacagtgactaaatgatggagctcgcattggaatcaaacaaagtctgtctcactaagtatctgccaaaaagcttatgggaaggaaaaggtgaacagtgataaaccaccaaagtcaatatcctagtgctaatcaacaggatggcttaagaaaaagaaaggctctgttgaaactggcaaactcttaacttgtcttgggtggagagggagaaaaggggataggggttgaaaatgaagggattcccgaggtaggcaccacccctcaagtaggaaatagttaatcaacttgacagcatcaacttgaaactccaggctgggcatgctggctcataacctctaatcccaactttttgggaggcataggtgggaggatcgcttgaggccaggagtttgagaccagccttgacacaaagtaagaccctgcctcgacaaaaagttaaaaaattagccgggtgtggtggctcccacctgtagtcccagctacttggggagctaacgcaggaagatcacttgtggccaggagttcgcggatacagtgagctatggttggaccactgctctccagcctgagcagcagagcaagaccatgtctcaaaaaacaaacaaacaaagaaaacaaaacaaaacaaaacacctaaatcttagcctgagatccctcatgcaatccccagctgggacatccctcaggaagtttcttttcttattttattttatttatattttttatttatttatttatttattttattttattttattttttttattgatcattcttgggtgtttctcacagagggggatttggcagggtcataggacaatagtggagggaaggtcagcagataaacaagtgaacaaaggtctctggttttcctaggcagaggaacctacggccttccgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgattcagagagcacagggttgggggtaaggtcacagatcaacaggatcccaaggccgaagaatttttcttagtacagaacaaaatgtaaagtttcccatgtctacttctttctacacagacacggcaaccatccgatttctcaatcttttcctcacctttcccccctttctattccacaaaaccgccattgtcatcgtggcccgttctcaatgagctgttgggtacacctcccagacggggtggcggctgggcagaggggctcctcacttcccagtaggggcggccgggcagaggcgcccctcacctcccggatggggcggctggccgggtggggggctgacccccccacctgcctcccggtcggggcggctggccgggtgggggggctcctcacttcccagtaggggcggctgggcagaggcgcccctcacctcccggacggggcggctggccgggcggggggctgacccccccacctccctcccggactgggcggctggccgggcggggggttgaccccccccacctccttccctgacggggtggctggccgggcagaggggctcctcacttcccagtaggggcggctgggcagaggcgcccctcacctcccggacggggcggctggccgggcaggggactgacccccacctccctcccagacggggtggcttccgggcggagacgctcctcacttcccagacggggcggctgccaggcggaggggctcctcacttctcagatggggcggttgccaggcggagggtctcctcacctcccagacggggtcttggctgggcagaggcactcctcacatcccagacggggcggcggggcagaggcgctccccacatctcagacgatgggcggccaggcagagacgctcctcacttcctagatgggatggcggctgggcagagacgctcctcacttcctagatgggatggcggccgggcagagacgctcctcacttcctagatgggatggcggctgggcagagacgctcctcactttccagactgggcagccaggcagaggggctcctcacgtcccagacgatgggtggccaggcagagacgctcctcacttcccagacggggtggcggccgggcagaggctgcactctcggcactttgggaggccaaggcaggtggctgggaggtggaggttgtagcaagccgagatcacgccactgcactccagcctgggcaccattgagcactgagtgaaccagactccgtctgcaatcccggcacctcgggaggccgaggctggcggatcactcgcggttaggagctggagaccagcccagccaacacagcgaagccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagctttggctcggcatcagagggagaccgtggaaagagagggagagggagaccgtggggagagggagaggagggagggggagagggagagggagaggtagagggagagctatattttttattatactttaagttttacggtacatgtgcacaatgtgcaggtttgttacatatgtatacatgtgccatgttggtgtgctgtacccattaactcgtcatttactttaggtatatctcctaatgctatccctcccccctccccccaccccacaacaggccccggtgtgtgatgtcccctttcctgtgtccaagtgttctcattgtttagttcccacctatgagtgagaacatgcggtgtttggttttttgtccttgcaaggaattttctcttcagcctctgacctatggattcctcgtttcagcagtgcctatggctgcagtatctccccacctcccatcatcgtaggaccatcgacccaggctgtcacatccatggactgctctctctgatttgctcactacttttgctgctttaatgaactcagtcttttacaaaacatatttatttaaacgaaaaggttgcttttccttaccctgaccagatcactagaaaaataaatgcagccatgcacagtggctcacgcctgtaatcccagcactttgggaggccgagggggggtggatcatttgaggtcagaaattcaagaccagactggccaacatggtgaaaccccatctctactaaaaatacaaaaattacccgggcatggtggcgcatgcctgtaatcccagctacttgggaggctaaggcaagagagtcgcttgaaccctggaagcagaggttgcagtgagctgacatcatgtcacttcactccagcctagcaagagaggagactccgtctcaataaataaataaaagggaaactttatatcagtatctgaaatgaaaagtctgcttttccataccctgactagatcactagaaaaataaatgcagctgggcacagtgactcacacctgcaatcccagcactttggaaggccgaggcgggtggatcacttgaggtcaggagttcgagagcagcctgacaacatggcaaaactctgtctctactaaaaacacgaaaattagctgggcatggtggtgggcacctgtagtcagctactcaggaggctgaggcaggagaatcactagaacccgggagcccaaggctgcagtgagcagagatcgtgccattgcactccagcctgggcaacaaaggcagactctatctccaaaaaaaaaaaaaaaaaaaaaaaaagaaagaaagaaagaaaaaaatgcaataaaaataaacaaggctaaaacaacaacaacaaaaacaaacaaccaaggctattaaatttagttagttagctagacagctgtctttgttcaaaggggagacttgttagctttggagaagtgttaaaagtccttagcaccgagccaagatgttcttggtgcagtcagagtaactgaaagaggtttgaaaagggaatcactttatctggatataagtcatcgctgttagtgtcaggttatacctggcgccatcatgcttcaacgatggtatgtgtctcatacctgaggaaataccggtatggggctcgttatgggttgaattgtgtttcccagaaagtcataccttcaagtccttgcctaattgagggttctcagtatctcagatcatgactgtatttggagagatgacgttcaaagaggtaattaggttaaaatgcggccattagggtgggtcttcagtcttcattcagtccaactggtgtccttctaagcagaaatgtggacatgcgccagcagggacacacacagaggaaaagcatgtgagaacatggtgagaagggggccaactgcaagctaggaagagaggcctcgggtgaaaccaaccctgctctcaccaccatcttggacttttagcctccaaaactgtgagaaagtcaatttccattgtttaagtctgtggaagttatggaagccctagtcaactaatacaggggttccctgagcccccacatgcattccaacagaggcaggagaatagggtttggagaccaggaacataaggacttcctagaactaaatcaaatggaaacacttcagctgtgatgggaaatatcttctccatttacacagggcgtaagccaaataaatgactttgtaagtttcctccatcctcttcatttacataaggcatacaccaagtaaccaatggaaattttggggggtatttaagcctccaaaaattctgtaatggggctcttgagttcctgtgctctggcccacccccactctgtggagtgtactttagtcttcgataaattctgcttttgttgcttcattctttccttgctttgtttgtgcatttcatccaattatttgatcaagacaccaagaacctggacactctccactggtaacacaaccatctggatttgagtcctgcctctgctacttccgagttgtgagacgctgagcaagttactctacctgtctaagcctaggtttccttatctctaagttaacattccagtctgcattctgtgtgaaagttggtcttagaattgggtcgttcttgttacagccaactaaaacagagtcaagaggccaggaggaggaaaaagcagtcagaccacattacatggcttccagaaagtaattcttggaaagcctggctgctggaactgcctgctggaacctgaagccagttttatctaacagctactggaaaaacctgctgtgaccttaagacaagttttgcccactgccatcactcaccaaacagagtttgccagctcccacagccttacccttgccgatgaactttctcaaaaaacaatatgtaacatttctccttttctaaaatgcctctaaacttctctttgttctttggatgtactaaagaccacctggtctgcatatatgctctgaattgcaatcctttcctcccaaataaaacattttaattttagagattcatctaatatttgacttccacatatgaaattgttaacaatatacacaacatatccaaggtggttaacaaagtttctggcacagagtagggctcaaaacaacaacaagaccgggcatggtggctcacacctgtaatcctagcactttgggaggccaaggtgggtggatcactcgagaccagcctggccaacatagcaaaaccccgtctctactaaaagtacaaaaattagtgggctgtggtggtgggcgcctgtaatcccagttacttggaaggctgaggcaggagaactgcttgaacccaggaggtggaggatgagtgagcagagattgcagtactgcactccagcctgagtgacagagcgagaccctgtctcaaaaacaaacaacaaacaacaacaacaaactactatgataacaaatgttggcatacttcctggcccctgtaggtttgaagatggttttatctccaacaaggtaagaggtaaggatcttggtacagtatcttggatgctgtacttggtactagggactaagggctccatcttcaacactaaccaactatggaggcacatagcaaacaaaataatcaaagctctagcttcttcaccaaagtaacccagatattttaaaaccacccagcttgtgtctcctgtactctttccccatttattcctctctcatcaggactggcctgtttcactgtccccttggaaagcttttcagcaactttttgaccctccgtttaacacctctacctctcagactcctaaagcatcttacccaggtctcactgcctgtaaatccgcaaagccaggctttgaacccaggcttctgtgattcatcacacatcccacaagtgacagagagatgcagagagctttcatttgccaataataataattagtcacccattacatataatttataatcattaattatagtgattcatataatgattaagtataatgtgaagttcttgccttccacactaagggtggttatggcttcagttagtggaacacttgctctgcgcctgccgttcccatgtgtcatcccatggattcctctcaccacttctttacagaaattattttataactcccatttgatacacaaggacactgaaatgtagggagccccatgtcaccaccagcacatccactgcttaagagactctgggagagatcagagggtagacagggaaaagatgaagatgatgttagaaggcagcaggggaccagacacggtggctcatgcctagaattccagcactttgggaggccgaggcaggcagatcacttgagcccaggagtttgagaccagcctggccaatatggtgaaaccctggttgtctctactaaaaacacaaaaattaggtgggtgtggtggcgtgtacctgtagtcccagctaccagggagactgaggcaggagaatacttgaacttgggaggtagatgttgcagtgaactgagattgtaccactgcactccagcctgggcaacagagcgagactctgtctcaaaaaaaaagaaaacaaacaaaaaaaaagaaaacaaaacaagaaagaaggcaggagagggaatgttttcctcacctcctcttgagtctcctcagcagggctatggcctccagatttctctgctttaggagagtcagctaatcctccaccctggagggaggacagttcataaggatcacttagtcttctcctgatctaatccagctgggttagtttgctacaactgctgtaacaaagtcccacaagctgggtggcttatgcaacagaaattcattatctcacagttctggagaccagatgtccaaatcaaggcatcagcaggattggtctcctctgagggctataagggaagaatctatttccaggcttctctcctcatcatgtagattgctgttttagtctgtttgggctgctataaccaaatactgtagcctggatagcttataaacaaagcaattatttcttgtggttctggaggcggagaagtccaagattgagccatgggcagattcattgtctaatgagggcttgcttcctggcttgaagacagccaccttcttgctgtgtctttggacatggcctttccttcatgggtgcttgtggagggaaagaaatacctctctcccttgtcctcttcgtataacggcacgaatcccatcatgagggattcactttcatgacctcatctaaacctaattatctcaaagacctcaccttctaataccatcaaactggggatgcaggcatccaactgtgtccacatctgaatttgtgggaggaggcacaaacattcagctcataacaatggccatattctccttgtctcttcacactgtcttccctctctgcaagtctgtttctgttcagatttcccctttttataaggacaccagtcttattggtttaggttccaccctgatgaccttgctttaacttgattacctctttaaagacctgtctgcaaataaggacacattctgaggtgccaggggttagaactttatataaatttgaacacagttcaacctgtaacaccagtcacatgggcatgcatctcaagtttaatgatttttcctaatagtccagctccacctgcatctgacatctttctccaacaggaaaatattcctcaatcaaacacaacccttctcctgttacagtttaagctaatcttccattctcctgaaataataatatcccctgcctttatttatttattttgaaccttaagtttttgactctcctcatagcagaacaaccactcctcctcctccaattaaagtatacaaagtaaggaaattgagaagataaatggggaggggaggatatccacatcattctttttagttcagaatgagagccagttgctgtcaaggactggaaaaggaaggtatgctcatggttgtggttcagaagcctgagagctttggtttaaaaataggtgaactgaaataaacacagagctactcagatggcactgaaatagagtggtaattgatctaatgcaacttttgcctcggataacatcattatttgtgaaattatgtcagtgttgctactgccaagtcagcaagcacttacaggacgtgacttctaatttaggaattggactatttgtggcacatcttagaagacagcaggaactcagtggacacccggtagccagccttctgagagccttggtttgagcttgaaattcacaacgttgaagtgcccaggagtgccctgtcttgatgacccttcaaggaaaagacttgctgcccagctctagaaaatgtggtttgcaggtggctgtcggctgtcagttccttcatggtctttctcagctgcaaagatttgctgccccaggtcacgcctttcttggggcaacctcagcctgtgacttagtgaaacaggggtataaactaaggcctgggtactttggccccacttgggtcattctgatataatccagtacttgctccagagctccctgccaggtttcacgaggtttttcctgttataaaatacagttacagtctctctttccccagattttctgtctttttctagaaaggaggcaacaacaccttacatgacttacttattcccaaactgctttatccttttttcctaggtattattcccaaataaacacttgtacccagattctaattcaatgtcttccagaggacccaatctgggacagatgtctaggtagtttacaaagtcactgcacacttcctttctacctgtcatgctcctgaaagacagggggtgacattgtctcttcatgccctcattgagctggctgtagaattcttttgtggaatttcaagtggaagaatattttacattatttaagaatataataccagattttcatttatttcaccttcatgaaatgaggtacatgtgtaaaaattatggttagaaagaacagctcttttatttatttatttatttattttatttatttatttatttatttatttatttgagatggagtctcgctctgttgccaggctgcagtgcagtggtgcgatcttggctcactgcaacctctgcctcctgggttcaagtgattctcctgcctcagcctcccaagtagctgggactacaggcacctgccaccacacccggctaatttttgtatttttagtagagatggggtttcaccatgttggccaggatggtctcaatctcttgacctcgtgatccacctcctcggcctcccaaagtgctaggattacgggtgtgagctaccacgcctggcctcagccatttctttattcactttttttttgcccaattgcagtgtcccagacactgttcaaggtattgtgaatattatgatgaaggagacaaagattctcagagcttacattttatgggagcagactgacaatacacaagtaaataaatacattggtgaggaagtacagatgtaactgtagtaggttcattggctgatgcatgcaacaagtcaatatgctgagacactgggttgccgcagagaaagaggtttaatcatagggtcactgaatgaggagatgggaggaaaccttaaatccatttccctgagaagtttgggcttagggtttttaagggttttggagtgggctgatgtgtggagatcactgattagtggaaaagtgcaggatgaagtcatggtacaaggagatgaagaagctgtattctggccgagcatggtggctcatggctgtaatcccagcactgtgaggggtggaggcaggtggatcctttgagcccaggaggtccaggctgcagtgagctgtgatggcaccactgcaccccagcctgggcaacagagggagaccctgtttcaaaaaagcaaaacagaaaaggagccatattcccttgctgatccctttcctctgtggggggtcttctaacaagttgctggaattcagggtctgaaaaacatctttaaccaaagccttatgattctaatgtcagagatcttatctatatgaatgaaggggatgcaaatctattctttttttttttttttttttttttttttttgagacggagtctcgctctgtcgcccaggctggagtgcagtggcgggatcttggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgcaaatctattcttaaacaatctcatgacgctaatgtcagaaatccctctgtaggaacaatgggaatgcaaatggttagtatccagtgctacatgacttttaacaaaaacaaattgagtcaaagtccagcctgattaatgcttaattatagctacatttatgtacagaacctggcatgcaatgcttgtcaaccctggggggacagtttcagatactaaaacccgtgaagaaaataaagtagagaggatagtagctgttgactggggtatgcgaagattcgtttgatcaaatggttaggagagacgtttggagaaggtgacagtagtgttgaaacctgacaaagaagatccagccttctgcagatacaatgttacctgttggaatcgaaaagacccgcaagttctagtcaaagttgaattgaaccaatggcatcatctaatggatggagataacaacttgttcaggcatgtttggagtacctgctgtcacgccaagctctgtgcagggccatggaaacctagctaagccaggaacatccaagagtctgagccattcacaggctaaagacagagcagagtggagcacctcaccccggcaccttgacttaaaccgtgtggttcatgcatctgttcagagctgtcgatcaaaaaatgttcagagttctctgtccagatgagaccatttatgtctgtgtacccctagaggggagaggcaaaagcattagttattgtctctattttcccagacttcctgtctttttccaggtaggaggcaacaacctcttaaatgacttgcccgttggaaatgagtggtgttgctgaaggcccagctcaaattctcagactatgtatgtgtgcaaggaatgctcattacgccccatgagctggtatttccgagtcaagatacaatgcatctggatagctttttttttttttttttttttttgagacagggtcttgttcagttgcccaggctggagcacagtgactcaatcatagctcactgcagcctagaatgccagactcccgagtagctgggactacaggcacacaaccaccatgcttggctaatttaaaaaaatttttttttttacagacagggtcttgctatgttgcacaggctggtctcaaattcctgggctcaaattatcctctcattttggccttccaaagtgctgggattaaggtgtgagccactgcacccagctggtgtgacatttcctatccagccacatatctcatcctatttattcactcctcataccttcatcctttgcacctgctgttccctctctgtggtgcctctgtttacctgatgtactcttcatcattcataatctggattaagtgccccttcttctgtatatgcccccacccccaaaacacaaagagcattgatcactctcacctctaacctgtgctacagatggtacctcatgcgcctccttttctctcaaatggagatattgataatacttacctcctatggttgatctaagagttaaatgatatatatcaagattttggacccacacctggtcaactgtaagcacttaagaaatgtatgccaatagaattacatctctcagtcttggtgcttgaaatacttactaataatatctaacacttactgatcagttattatgtgtagccactgtgcttcattttaacatggatttgtaaaaaggcaacccttagcaaacctgatgaagtaggtactattactatcactatattaaaattgagaagccaggtgcagtggctcacatccgtaatcccagcacttcggaaggctgaggcaggtggtttgcttgaggccaagagtttgagacaagcctcgccaacatggcaaaaccccgtctctactaaaaatatgaaaattagccaggcatggtggtgggcgcctgtaatcccagctactcgggaggctgaggcaggagaatcacttgaacctgggaggcagaggttgcagtgagccgagatcgcaccattgctctcctgtctgcgcgacacagcaagactccgtctcaaaaaaaaaaaaaaaaaaaaaaaaaaaaattgagaaaactgcagtatgcagtgtttacagatgtttccatctttttcttctctgttaggctgtcaccgtttcgagggaaaaactcacaattcatttaactctctacctccagttgttagcatagcgtttttgggtcaataaatatttggtaagtgagtgaaggaataaataaagtaatgaagcagagaaagtatcattgtttaggaggtgaagaaatgaggacgacccagggaagaaatagactgaggataaaggtgcagctttttccaatccagagtccacatggttctctattaaaccagggcttcccatacctggacatgcataggaatcacctgggaaccatgtgaaaatgctgattctgagccaggcacggtggctcatgcctatagtcccagcactgtgggaggctgagatgggcagatcacttgaggtcacgaggttgagaccagcctggccaacatggtgaaacctcgtctctactaaaaatacaaaaagtagctgggcatggtggtgcatgccgatagtcccagctacttgggaggctgaggcatgagaattgcttgaacccaggagccggaagttgcagtgagctgagatggactccagcctgagtgacagagtaagactctgcctccaaaaaaaaaaaaaaaaaaaaaaaagcagattctgatctagtagatctagggtgaaacccaagatactgcatttgtcataatctctcatgtgacacaattagtctgtgatcacaccttgagtagcaaagcactaagctacttgtgtcagttggttctatgcttgccaacatcagaggccaactcaggctcacttaagtaaaaaaaaaaaattgaacttactagggtatgcatggggaagcacccagaatccaaggagaagtacagaacccagccccagcaaggacaggaactaaagcactttgggttttgggtttttttttttttttttgactttatgaacatttattataattattttttatttacataggttattggggaacaggtggtatttggttacatgagtaagtttagtggtggtttgtgagatttttgtgcacccatcacccaagcagtatacactgcacccaatttgtagtcttttatccctcaccctcttcccaccctttccccaagtccccgaagtccactgtgtcattcttataccgttgcatcctcatagcttagctcctacttatgagggagaacatacgatgtttggttttccattcctgagttacttcacttagaataatagtctccaatctcatctaggttgctgcaaatgccattaattcatttatttttacggctgagcagtaaggaattaaagcactttgaacccaaacagggaggagggggtcccttgctgcgaatcccactgtcaggagaaatcagctccaactatgtactgcccttaaatcactccatccaaagtttacatttctgtgcgatggtatctaattgactcagtatgaatcacttaccatccaaggcaaaggaagggcagaatgttttgattgacattctcattaagaccatgtgcaatgaagaatgggcattttcttggagaaaaatgttggggtttttatactaaaagaaaggagacattaagttaccctgcccaaagtcagagccaccagctctggggcagatttaaagatgaatgtgagacttttggacacccctccaccaccgaccccagccttcctgagatggtcagctggaccactgagcatccccagtgactttggcagagactgattctaaggttggatgggccacagagattgggctcagaatggaaactgatcatcaaagtgatccttaattctcgcattagatttttatccagacgtggtgagcaaagtggctggcctactcctctggtttatgtggtaggtcataggtggcacagtgcctgcttagcagggatttaaacaatcccttatcatcttctgggctttcttgtttgatttttttttttttaactttgttcaattctcagcaactcgattttaaaggtcattatattaactgcaaagatgaatcaagggatgaggtcatttctcatccagggaaacgctttagtcttggatgctgtcatcttcatgctccatagatgctgatctgggctttaaaaagacaattctatttcaacatagtattctttggggggaaaaagactgccttcctttccaaaactcagctttgccaactcatcaaaggaagcctttgtatccacatttgtgtccctcatatctgggacagcagctgcacactcaaaagtcctactccagctgaagggagtcgtggactttatcgtaatcaccttgttgaaatatgtggaattgtatagcaacagccaggttctatgttgccataatttatgacaaaggctcaaataaatccccagacatggattttctataaaatccttcattgtgaaagtttgttgcactgcaaaaatgaaaagaagacggaaagaagagaaaggaggaaatgaaaaagtccgcaagacgtatataaacctctgaggatgccgtttccattcatcacctttactgtaaagacagggattttatttggatggaaaaggaatgaatcatagggttttagaatctaatgcgaagtttgctggaagcattttcctctgatctttctgcttcctcaagatcatctgaatatggagagagaatgagtgcaaagaattctatcagccatagaaggttctgtgctgggatgggtatcagaggatggagagagatctctttttttgtgacttttacctgggacgttcattggcctgtgaaggtttagggatacaatatagtgacatcagaagcatgtgttagtgatttaaattatacaatatgaggtgagcagatgcaagaacaagagaaagagagagtggggagagagggaggggatgaagatggagaaggaggcaggggaaggtgaggacgaaagtttccaatcatatagtttatttcatccaccctcccactcatagcctgagaaaatctgattctagagatcccttcctttgctcttttgtccctcatactatgagcatctactcttgctaggtgccagacagctgtttttattcagtatgatcccttaaacacaaatcaacctcttcatcagatgctcttcccaaaacacagtggtttgttcaagatagacggaaaatggactgtgttggacacattgagagactatctgcttcttcaaagcatgggtgacttaagaggacttttaaggaaaattctgactatgcgattgtttctttatgtgatacctctagaatctaattgcctcttaaagttactctctactggggtcccttctgagcagttaggggatgaaggttatggttaggtctaaatttattcattcattattcaccagatacacacggagaacctcctttgtgccaggcatagtgctgagctagggcgagattacatggtgcttcaaagagaagtttctcactgatctttgcatgcaatcacaaagtttaaagctggaagaaccctcagaggatatcatttatcaagaacaatgttgagcaaccttttatatgcaagcactgctttggggaaaataaacatgttttactcgccacattcttttggctcattcatagtgaaaacagttttattgagttccttggctgggagggaggacattctcaaaacccagctcccctatttgatggaatagaaggccattgattaaaaacttagcattgcttgtgggccactaaaatgcaaatattggggtatctttgggaagtagttccatggaggtagttttcagattgttcaatctaaaattaggtggtggtctgtgtcccaaagtttaggcagaacacacgtggctcccaggctgctggtgttcatggtggaggtagtgagtgggaagctgtgcttggtttcattctagatcctctacagcacagtacaaaataatccttttctggcttaggtatctgttttatttagagcccttgtggttgcaaactctgaaagaaaaataaaattgaaggtacaaagtctcacaagaattcaaaagctgaggtgttagcattaggcatggcagaattcagatgtttaagccatgtcattggtaccctacttttccatttactccattctgctttcctctctggtggcttcactcccaagccaggtgtgctctgtgtgtgtgcatccaccacccagccagcagagccaggcttacaccctcccaaatttaagtccagtaggaaagagttgcttccctctaggccatgcttgctccagatttggaattagagctgatgggctctgcctaaccatgaatccatctcaatggtctgattggccacgatgggtccactggtcaaggatagggccagactaatgtaagacatatggatagagagtgaggcttactgaatgaagccaggtgatcctgaaaatgcaaagactcttcatcatcttttctatctggccattcatccatctgtgtgttcgtccatccatctgtgtgtttgtccatccatccatcccctgacctatctacctatctatccattcatccaatcatccatccatacattcacctatctagatatctatccatccacccaaccacctagccactcagataactagctagctagtgactgcccctttgttgtagaaagcaattatatgttcagagcatggcatatcttaggagttctaaaactcctttgttaaaagtaaatgaataaatgaatttagccttattctcaatttatacacattgtgaaaaggtgaatcacaacagctaatgccagagctggactctgcacccagtccccacaactaaaggtttctcaggaagatgttgcttcaacaggtggggaataggagattgctggcaaggcagatgtatgtgaattattgcctaaatgcaatggcattttatgcaagggtatacttatctgtggtttcattaaccagtattcattttcatctcagtatcatatctatcttttcaggaaataagtttactttcactataaagctacatctcagaaatgaatgcaaataacaattttaatgtcaaagccaggtccattttttatggctctgtgccctaatccataaagttattacccaaactattgaaatatgccccaaggatcggcgtcttaataaggctttagaaattaccacaatatttgtggagagaatggggatgcagggcgtctgaaacagttgccatgaaaaatgcttaagtagaggtcaacaaagtttgaaggtgtgggaatgggcgggggagtggtcaaacgtgtcttcacctccatctttagtaatttctacatatatgtgatttttttgggtcacgtatagctgttttttgtttgttttttgttttgtttgttttttgttttgtttttgtttttgtttttgagagggagtctcgctctgttgcccaggctggagtgcagtggcgcaatctcagctcactgaaagctctgcctcccgggttcacgccattctcctgcctcagcctcccgattagctgagactataggcgccaagtttagatgtcttataagcccaagactatatgataaatgccttatttgaattatagctgtgttattgtagtgttttgtgcccaccagttctaagatgtaggttcagcctaaaatttctgattgactatttccttacattgtaaaataatgggagttgggactcttgggttcattcatttgctcaacaaatattaattaagcatatactatgtgccaggcactgctctgagatacaacagtgagcaaaccagataccaatcttctcccttatgaagcttagacagtgcagtgccaggttctgccatgaaggaacggttagtgctttgcatgccatttgccttctgtgggcatctgttttcctgtttgtaatataagaggcaaggggactcaacaccaaccaaacgaaaggaacaacttaaaaaactaagcttggcaaaaggaaaagttacacaggacaggtaacctatgtgcaaacactgagaaaggtgtttggtttaagagcaaggatactacttgacactagttgatctgtgtggctcccaaagacaggatgaggactgctagacactgagatcaaccatgtataagatgctgaggagggccgggcacggtggctcacgcctgtaatcccagcactttgcgaggcagaggcaggcggatcacttgaggtcaggagtttgaaaccagcctggccaacatggtgaacccccgtctctcctaaaaaatacaaaaattagccaggtttggtggcacacacctgtaatcctagctactggggaggctgaggcatgagaattgcttgaacccgggaggcggacgttgcagtgagccgagatcgtgccactgcactccagccagggaaacaaagcgagaccctgtctcaaaaaaataaatttaaacaaaaataaataaataaaaattaaaaatttaaaaataagacgctgaggaggtggcaagtttcttatcactaagagtgtgcaagaagaggctggaagagaacttggcaggatattggagaagatgcaagtatcagccttctaaaaactctttaacatatgagtgcaattaacattactatcttccatctcagtactgcaccatgacgaccttgtggcctgcatgtttgtggcaataggataagagaaagaagggggagacctcttaactaccttggccagaaagtgacacctatcatttctgcttacagtccattcaccagaatgagtctcatggccccagactaatatccaggaaggccaggaaacataagtgagaacatgaatataaggtaagcaccatctctaagattttgaaaatatggagagacataataacacctatttcagagagttacttttagaattaaataagctaatccattgtgtcatctagtaacttttcttttttttaaacgagcctttctttcatcctcttcctcttttatttgacttcaaagatcaccatattatctggctggacccattgaaaagatgctctatggagcccctaggagaagtcactgatgaaagggattgatcttatatggacatatccccacacactgatgcctaaaattccaccattagaggcaccttcctgccacgtttcacgtctctaggcttggggtaggcaagggatgtggagggtggacatggaaattccaggtgggaagctgtcagtgacaatttcagccaggctggccctaaggaggatggaggttgcatagctcagaaacccaccacccacgggttgctgttatatatgcagttagaaaggctgtttccccccagtggagcaacctaggggcaggctgtccatctgaatctgaaatgaattcaatttagcttcatgtaattgcttatttgattcctgacgatgacatgcagttaggaggtaaattgacattctgtcatttctgttccaatgaactgaactccaacaagttccctcctaggtactttgtggcagccaggccacctgctcttcttctgaagagaaattagcgagcacagggagcttggaaatacagcatcccgagcctggtgcctttttttgttgttgttacggttgtgagatgaatcacatagtcagacaggggtacgcctgaacttccttttcccctggtgaacacaatagacgtcctttcagaaagctctcaggatgactttctgctttagaaacatgaattttctcgcttgtcatccaaagtttatttctgttcaaggtcaattttgcaaaaaaaaatcaaacaatataggagtccgttttgaaaaaagatttcaaacaatttaggagacatctccagcaagtcataaaagacctcacccgttccaagcacaggaataggtgtttgttttgtcgtggctacccagtgccctctttggccaagcctttatataaccacagcattctgaatggtgcccacaaggctatgggaaaaggcagtcccttcaaacaaaggggaggccagccaggcagacaggacagggctcgacaggatgctcagaatgtgattgaagggtgagcaagaaccttgaattttattgattaaagacacaaattctcaagggcataaatagagggcccagatgtcaatatccacagacaccaagccttctgtgtatactggacagatgtcatttacatgatcatggtaagaagaatatggtattgtaagtgatatggtaagaaacaatatgaatattaaaccatgcagcagtgcttctcaacaggggcaatttggcaatacaaagacatttctgaggctgggagcagtggctcacgcctataatcccagcaatttgggaggccgaggcaggcggatcacaaggtcaagagattgagaccatcctggccaacatggtgaaaccccgtctctactaaaaataccaaaaaaattaggtgggcgtggtggcgtgcgcctgtagtctcagttacttgggaggctgacgcaggagaattgcttgaacccgggaggtggaggttgcagtgagctgagatcgtgccactgcactccaccctggagacagagtgagactttgcctcacaaagaaaaaaacaacaacatttttggttgtcacagtgagagggatactactggcatttaatgcgcgcaggccagggacgccgctaagcctcctgcagcgcacaggatggcttgccacatgatggaatgaacaggtccagactgtcaatagtgctgagcttgaaaaacctggtagagagcaaggggccaagcacgtgacagtgtccacttaggagaagtgatgtcggctgtgttaggaaagacagtttccgctggacttgggggaaagttcatgctgagttgagaaaggtgaaatattctcatttagaatcacaaatgtgatcacatttcttctctgtttaaaataattccacactgtatgaaaaaatcaggccaagcacagtggctcacatctgtgatcccagcaattttggaggccgagatgggaggattgcttgaggccaggagttcaaggtcagcctgggcaacacagtgagaccctatctctacaaaaaaaaaaaaaaaaaaaaaaaattagccaggcatggtgttgcatgcctgtagtgccagctccttgggaggctgaggcagaaggatgggttgagcgcaggagtttgaggctgcagtgagctatgaatgtgccactgcactccagccttgggggcagaccgagacactgtctctaaacaaaacaaaacaaaaaaaaaaccataaaaacccacaacaccaccttgtaccctataaatatatgcacctataatttctcaatatataataaaaatgtataaaaaaagaaacatgtttttatttaacatttaaaaaccctgggtcaggcgcagtggctcacacctgtaatcccagcacttggggaggccgaggcggggggaccacttgagatcaggagtttgagaccagtctggccaacatggcgaaaccctgtctctactaaaaatacaaaaattggccgggcatggtggtgtgtgcctgtgatccctgctacttgggaggctgaggcaggagaattgcttgaacccaggaggcggaggttgcagtgagccgagatcacgcccctgcactccagccagggcaacaagagcgaaacttcttctcgaaataaaataaaataaaaatacaaacctgtattggttttctattgtttttaagaaaaagtccaatctgtataacacagtcgccaaggccctgtgtatatagttccctcatcttctgcaggaaggagaggaaaaccagaacttagggaagggacattggtctgagcaccctgccttcaatgtcaagttaatgagaaaggttagaaaagaacacttaaaaataatctgtcactgctatagttgcaaacaatggggaaaagaggaagtggtgagaaatgaatctgtcatgcagactccatgagggttattagcagattgatcctgaaagagcaagaaaggtctgatttgttggtaaaatactcagctataatgaaaacaaaaaagaggagaatcatgcagacatccttcctcctccatcctccatttacagtcaaagccttgtttcctccacagcagctcttaggactctgggaaagaaatggctgatgaagaaattttggagatttgactgctgagtccctagtctggtattgttaagagtcatccaggaaagacacatgtcacccctcctagctctgctctgggttttgtttctctctggcacaatgtcctatgaagactggactataggtggcctggtcttattcgggttacacaccgctccactctgctcactgggcccccactgcactagacttctctcaggaccttcagtatcacactgcagcttcccacaagttcttcccacagcttggattccagcctctgcccatgtgtctccccttctacatccacacaacccacattatttactcctgttcatctttctgattgttgcgcaaacattatttctagagagattttcctgatgctgcccaacctggctcagtttcctttatctatacagtcccatgccctccttatcatacttataaaatgacatattcagtaggcttgtgtatttttccaccttttgatggagctccatgagaatagggaccaaggctgcccttatatgcactgtgtgaagggatctagcaaaggggcagttggggcttaaaactagccttcgatttgctgacctggcaaggcttggctgtcatacaacctggggtatccccagcacctagcacagtgcctgactcagagcaggtccccaggaattgtggattgattgacactgtctggctaggtcccagcaccatccatcatgagacagaaaaaaaaaaatccgcttcccaggcagagcagcctccaaggcccacatggcccacggcacctcctcatcagcacgcacttcatgctggccagccatcagccaagctgcaatctcaataaatcaagaggctggggcaccatttcccagggacctgccagagtgcccctgggcgcccaatgaggctgagagttctgctgccggtcgtggatcttgaactctcaaaagcaattggtgaaaaacaccaatggattgtgaaagaagtgatcactcctcctttcctctgtaggtagaggttgacagtcaaatctagtttcaaggtctctgtctctttgcggtcctaggtaaatacgatcatctctcgaaactttcattcctccatctgtaaaataggtatgatactcatccctaccatccaatgtgtggagatccacataatgctctaatatactaggttggtgtgaaagtaattgcatttttttctcataaaagtggcaaaactgcaattacttttgtgccaacctaatagtacacggcacagtatatacaatgtgtaatatagtacatagtacatagcagattatatatataaattatatatatacatataaaaataaacatacacacacacagacacacacacgcacatatatataatgaagcctcttcctttaatggcccaagattgagccaaaaggaaatacagggaattaaaccatgaggacagaaatctccatctaggctgtcttggttgttctgctcacattcccctacccaggcttgcaacctcccgtgaggctgtctgagcctggacacacccctagaatcttcattgccaacaaaagaagagaaagggaataaggggtatttgtgtggaatctgaaagagacaaacacactccttgttcttctcaatacaggtgtttccaaagctgccagagagacccagagcttagagttgtgatgacacaagggtaggtgatgtggacaatgaccggggcccccagccaaaaccatccctgtttatctgttccacagaatggtgttcaacatcagttcttgtctggtggagggggaagagattgtgctaatgaataaacatacaaagtagacaaatgtttatcactccttactagcataagattccatgcgtacaaaaccatataagctgtctatatgtgtgagtacagctctagaaagacagaaatgattgtattggatgccagcttaaagttgggaaataccattagaagaaatcgcaacttgagaatcttgcattttattgccaagtgtttggttttaacgagagtctaaatgtgctcacccattcactcatccctcccataaatattccctgtggcccattatgagtttgacactctgctaggctctggaagacaggcagaatgatggaaagaatcattttctagaaatgactaaatcctagttaaaaaggggaaatatttaaactattagtgacaatataatttatgcattccgctagtacatgcggaacaactcctgcatttcaagaattattctagacacgagggatacagtagcaagcaaaatataaagatttctcttttcatggaacttgtgttctagcggggggaaagtgcccaataaaaaaataagcgaataaatgcataattcatactagctagtgataaatgcttttatagtaaagcaggtaaaagatgaagagtgatgagaaggggctactgttttagatcaagcagctgggaaaagtcatttggaagaggtgacatttgggcaaagagctgaatcaaatgaggcagtaagtcatagcaggtggaagggaggtgtattccaggcagaagggagcaagtgagcgacagccctgatgagcagggtacctggaatattccagaagcagtgggagaaatgagtgcggctgaagcccagggagcagtggagagatactggggagagtggtgaggccacatcatgtaacacagcctgcgttgctgagcagccttcaacaggatgcaagccctgacaacgaaagaatagttaactcagaaaaaaacaaaaccaaaactaaaacccagctgctacggtaatggaattgggcaagcaaaaccgatagttcatgaaacacaggagcaagacacctgagacctggctcacccagcaaggtggctgcagagctgcttagacttggagaagcaggggattccctgttatttccaactaataggaggagtcagagtgcagaatgaagatgtgctctgctagccacctctagagaacatctctcctcatttttgactgcccagaacctacctatgctgagggaatcctcctggtctctgttcccacctttctctgcagaagctgataccagttttcccagcttcccttgcagctagggtaaaagcacgtgacctcatttccaccaatcagcttgcttgctccagccttcaccatggaagctggcatttccctcaatggtggctttccctctggaggctctaggggagaattccttctttgcttcttcatctgctggtggctgctggcattccttgaattctggctgcatcactctcattgctacctgcatggtcaggcttccttctcttctctatgtcttctcttctgatggtattaagactctttctgtttcactttttaaaaaatctcatttttatttattttttaaaatatttacttttatttcaatagttttggggaaacgtgtagtgtttggttgcatggaaaagttctttagtggtgggctgggtgtggtggctcacgcctgtaatctcagcacttcgggaggctgaggtgggcagatcacttgaggggaagagttcaagaccagcctggccaacatggtgaaaccctatctctactaaaaatacaaaaaaaaaaaaaaaatatccaggcgtggttgcatgcacctgtaatcgcagctactcaggaggctgaggcactagaatcacttgaaacccaggaggcagaggttgcagtaagctgaaattgggccagtgcaccctagcctgggtgacagagcaagactctgtctccaaaaaaaaaaaaaagagagagagaaagagaaagaaaagttcttaagtagtgatttctgagatttttgtgcacctgagtagtgtaactgtaaccagtgtgtagtcttttatccctcacccccctccccatgtacccccaagtccccaaagtctactgtatcatttctatgcttttgcatcctcatagcttagctcccacttatgagtaagaacatacaatatttggttttccattcgcgagttacttcatttaaaataatggtctctaactccatccagattgtcgtgagtgccattattttgtccctctttatggctgagtagtattccacagtatctatatataccacattttctttatccacttgttggttgatgggcatttaggctggttttatatttttgcaattgtgaactgtgctgctataaacatgcatgtgcaagtgtctatttcatataatgacttctgcttcgctcttaggacacttgtcattggattcagggttcacgtggataatccagaatgatttcctcatctcagggcctttaaattatttccatctgtaaagaccccatttgccaaataaagccacatttacagatttcagggattaggacatggtcatatctttttggaggccaccgtcccatcccctatgccacctcctagagatcttatgaactaactaatacctttttttttttttttgagctggagtcttgctctgtcacccaggctggagtgcagtggtgtgatcttggctcactgcaacctcggcctcccaggttcaagtgattctcctgcctctgcctcccaagtatctaggactacaggcacctgccaccatgcccggctaagtttttgtatttttagtagagatggggtttcactgtgttagccaggatggtcttgatctcctgacttcatgatccacccgtctcggcctcccaaagtgctgggattataggcataagccaccgctcctggccactaataacttctaatactttttttttccttttcgttgataccagcctgaattggtttgttttttgtcaaacagaagcttgacatggaccccaccctatctctctattcctggccaccaaagaggacaagatgtctggaatgcagccctgcttgggggcataagtgtgagactttggttccagctgatatgcacaactctctgccttcccgtctgctcactttgactcctgcctcgtagtaaaggaacggacctcccatgtcagaagctctgtggttgagacattttctttcaggttaaaacatgtcttctggccctaagagattgggatgtgaaacccaccacaaagagtggagggaagctggctgggtggtcagcctcaccacatcaactatttatggctttgttaaaaaataaaaaccagagcaaactcacccatagaaacctacagaacatgcatgagcctttaggagacttcaggagggacagtgttgtctcctaagctgtcttgcaccagtggtgtcggtgcgtgggggtgagaaaggaaatctcacgggaaactttccatgaatacttggagcctattatgagcaagaaaacgacaatatgacaaacacaagaagcaatatctcacggtggttacacccatgtgcttcagagccagagagatatgggtagaagcctgaaaactgataccactgcttaccatctgtgtgattttgaggattttttaaaaacctgagcctcagtttcctcatctttgaagggtattaatgcctgccttgtttttttgtctgttttgtgaggattaaatagattcagtaaagctcttagcttagtattggtgtatgtgaatatgtgaagacatcttatattcctttgccactattgtcatccctcttatctaaatagcatcatcttgaattcagttaaatctgtggacgtattgtctcttagtgcatgtgctgtactccacagtgtctggcacgtgataggtgctacatgaatttttggtttataaagctgtattgttttgatgggtgtgtaatcagagtttaacggaccagaaggtgacaaaattcaactgatcctcctagacatggtgccatatttctctggctccattctaactataatgccagtaatttcaatctccacctaaataaagctcatcactatcactcccccaccatgtctgggagtccctaggacaatgtctcacctgttcttgcatttctggtttgtttgggcatcagtgacacctgccattctctttctgctctgcactgcccactatggatgaggataccataggtgaagggttatgagatgaggttgaatgactgtgatattccaaaaatttccagttgaatcaaatatcactgagctctgcgaccctggctggctaagtcacagaatctttttttactttttgtgtgtgtgtgatggagtctcactccattgcccaggctggagtgcagtggtgcaatctcggctcactgcaacctccgcctctggggttcaagtggttcttctgcctcagcctcctgagtagctgggattacaggtgcgtgccaccacgcctggctaatttttatatttttagtagagatggggtttcaccatgttggtcaggctggtctcaaacttctgacctcgtgagctgctgcccttggcctcccaaactgctgagattacaggcatgagccaccatgcccagccatcacacaatctttttaagtctgagttttatcatctgcaaaatgggggagatctatcttcctcatagggatgatgattaaatgaaataatgaacacaaaaggaatagcctggtatgcattaggtactaaataaatgccaactatcatttttatctccttgatgaattattttcctagtggctataccaccccacatgccaataatgacttttggtagatatgccatatctagtcagatatttgggggtggtgggagagtgagctggtggcagagaaggtggggacagagactttctattatggcatctcggaggaataaaatagtaactgtcagaaacgtgatgctatagaaatcagctacagaaccagctatatggattgtgaattttttttttttttttttttgagacagaatctcgctctgtctcgcaggctgaagtgcagtggggcaatctcggctcactgcaagctccacctcctgggttcacgccattctcctgcctcagcctcccgagtagctgggactacaggcacctgccaccacaccaggctaattttttgtgtttttagtagaggtggggtttcaccatgttagccaggatggtctcgatcccctgacttcgtgatccgcccgcctcggcctcccaaagtgctgggattacaggcatgagccaccacgcacagcctggattgtgaagttttaactccagtgctgtcatttgctagcaaatgcccttgggtaagttctttaatcttgcaatgtctcagtttttaaatctgcaaatagggataataatacctatttcacaggactgtaaggataattgaataagttcattcatgtcaagcactcaacatgacttctaacatgtaataattaatcaataaatattgactattattagtttcccagtgaatcaatcaagaacgtacgtttttaaaaaaatccttaagtgccactttgtggatagatctgcccttaccgtgtccaagggatctatgtgccttcaaatgttcgagtcacatttcacctagatgctcagatatgcagaaattctaaggataaaccacctaaactactgctatgtgtacagacctgtgtacaaagggctaacatattgagctgggctttcttctttattggaatgcacccatgtttgctgatgagaattttctacctgaaagggttcatgaaagtggaagattgtacagaccatttgtgaaattttgtgtccaccacccagacctgggaagttcaacaatgtaatggctcctgtcttgacatgtcatggaatggtcaaggaaatgaacgggtttctcaggggtgtttggttgtaagcccaagaaactgactcaaatcagtccaagctttattggaagtattcaagcgtacttcctggagcacacagacagatagtatagttgggctcacagggtctagaatcagaaactggacctattagggtccaaggcaactcttccctctctctgctctggtgctttcagctagttcgcttcgtttcttcctttgcagagtgaccttttctgcctctcttgcccacaacccaaagacccaaaggtggccaccccatttttatgtcctctcagtactagtgcccccaaaaaactggcaagaacaaccaagtccaactccaaattcccaggggaaatgattggccaggaaaagaggccaaaaacatgtggtgactcacgaagactcaatctatggaaggaccacttgacaaagatccaagtcagaatcctctggggcattcagctggccattggctatttcaggtcggtacactgtcttctgcttcttgatgtctaggtctcggggaaggaccacgtggcctgctggctcatggggctccatgtacccttctgcacttctccaaagggccagccttttttgctgcaccagaggctctgctcatacccttccctctactttgaacacttttccctgcaccctctcgtcctacacttttgcatacctagctcctcctcctccctcaggtctcatgttaatttcacctccatggagagactgctctccacgccctacatttgtaactttctctggcgctctacatcccctatatgttccctttatggaactaacacagtctgaattaaatgcttataatagtagctaacacccacatgatatttcctacgtgctggatattttcataagagctttgtacatgtgaatttttttaatccatcaacaaatggggcaggcatagtgactcacacctgtaatcccagcacttaagtgatcaagaggatcacttgagctcaggagatcgagaccagcctggccaacatagtgaaaccccttctctaccaaaaaatacgaaaaattagctgggtgtaatggtgcatgcctatggtcccagctactggggaggctgaggtggaagaatcacttgaacccggaggtggagatggcagtgagctgagatcgtgccactgccttccagcctgggtgacagagtgagaccctgtctcaaaaaaacaaaacaaaacaaagctatggaataggcattcttagtctctcttgttccacaaatgagaaaactggggcacagagaggctagctaacttgcccaagatcactctgcaaagggtctagttccgtagtctgcactgtaagcctctgctgcctcttgaccccaacaacattctacagcttatgggattgattagttattttatgtctgcctcttctactggagtttaggctctgtgtagtcagggactgcactgatcaggcccactgtgtatcttcattgcttatcggaatacctggcccttagaaaatatttgccagatgaatgaacacatgaaaataagaatatattaactggcttaaaaaagaacaacccagattcctgcctgaatgagaagagggagccaggtaagtctcccaggactttaagggggtgtatgtgggattcaagagaggaagcttttccaaaaatagcagcaggagaggactgggagaagagatccttctcatggaatagcttgctttctgctgttgctgctgctgctgtcatttctgtcctgtggtccccttccacccagtctcaggttgccaatctgagcttaatggacctgctttcatgccctgagaggtgggagcagctggcattaataaatggagagcacttcaagaaacaactgagtagaggctcctgagatgtcctgagcttaggcatgagacactgatggtggctccctcttgacctggattgtttgtggcaggaagaacaaagaggttgggggtggaggaaatgtggaggggtctcgggagggggttccacctccaaatgtatccagaatcctattctttctcattttctccacctctatcacctgggccccagccatgtgggactacaacggcctcctaactgctcccccaggtttcaagcacccccccaccactctgctatcttctcaactcagccaccagagccaccctgttagaacccagagacccccagttcatgttgcttctctgctcagagccctccagggcaccacggaattcaaggcaaaagccaaagtcctggctggatgcagtggctcacgcctgtaatcccagcactttaggaggctgaggtgggcggatcacaaggtcaggagattgagaccatcctggccaacatggtgaaaccccgtctctactaaaaatacaaaaattatctgggcatggtggcgcacctgtagtcacagctactcaggaggctgaggcaggagaatcgcttgaacccaggaggcagaggttgccatgagccaagatcgcaccaccgcactccagcctggcgatagagcgagactccatctaaaaaaaaaaaaaagaaagaaagaaaagccaaagtccctgcaatggagcaaagtccctacatgatcctaggtgatctggttcccacccctcctcccacctcattctctcccttacccagctctcacctcccacctgccttgatgttccttgaatgttcactaaatgcaccagtcatggccctaccaccaggccctcactccagctattccctctccatgcaatactcttctccagaaagctgcttctccaaattcctcaccttcttcaagcctttgttctgaatgaagcctaatcgtcccatgaacgggacttactgtcactgcttgcacctgcatgaaaacaaccttatgcatggagagtgatggagatgagcgtattctagctgggcaaaggcagggtggcagaaaagccactctataccactgtggtcagagccagaggacccctgccgctgctggggtgagaacatgagtaatgaggtcaaagggaaattaagtgacttttttttccccattttccaagaatcactaactttttctttttctttgagatagagtctccctctgtcacccaggctggagtgcagtggcactatcttggctcactgcaacctccacctcccggcttcaggcgattctcttgcctcagcctccctagtagctgagactacaggcacacaccaccagacctggctaattgttgtatttttagtagagacggggtttcaccatgttggccaggctggtctcgaactcctgacttcaagtgatctgcccacctcggcctcccaaagtgctgggattaaagacagaaccgctgtgcctggccccaaatcactaactttcattgttagtgatgcaatttatatatatttttattttcatggaaaaaggctctaacaggaaatatataaagaatataaatacataaagaaaatgtgggaatcttgatcccattcacactagttcctcccaggaggtaatcactggtcttgcttggcatagatcctttatcagcgcatttgcaggcacaggtattttttctaccataaataaatggaatcagactctatgcattgttctgcaatttgctttttttattttaacttgagcatttctgggagatttctgtggcactccatagaggtctatctcatttttataatagcttcccattattccacgatgtggatgaagtgtaatttatttaacttttccactattaatggacatttatatccatttgaatttttacctccttctgtgattcataggctccaatagctccactaatgtcaagctttacaacgctgcggtataaatgaccacatttttctctcactgaatttgtaaacgtcttatcaacaacagcacgggggtagacgtgtgagttggttgcagatgccacgtgtgtgggccacggccgttccttctggaggcggatgctggctgcagtttgtctgcagtgtttcagtggggaagagaaagctcccagaagagggccccttctccatctcaaactccccccgttccccggccattcctctccttctcaggcatagtaaggaggccagcacagttcctaggattccaggtcaaagtgcatcttgccttttgacccaagaaccctatcccattacaaatggaatctcaattaattttacacttgtgggccgggtacggtggctcacgcctgtaatcccagcactttgggaggccgaggtgggcggatcacaaagtcaggaggtcgacaccattctggctagcacggtgaaaccccgtctctactaaaaatacaaaaaaaagttagccaggcgtggtggcgggcgcctgtagtcccagctactcgggaggctgaggcaggagaatggcgtgaacccgggtggcggagcttgcagtgagcggagatcctgccaatgcactccagcctgggcgacagagcgagaccccgtctcaaaaaaaaaataataataataatttgcacttgtgtttgagtatttcccttaactattttgtaagcctactctgtatgaatttgtggtttcctgccctctctagttacatgtctctgtcaatccctgtttctatctgtctgtttcccttttctctcctccaccgcaagatacagaatcccatcctctgtaggcaatcaatatatccttattaatgattattagaaacaatgctgggactgaggaagtggtagatagcaactctgggaaaatcagatgagaattcattactcaacatttcccaggtgcctcatccaagacctcatgcccgagagagcactcagtaccatcttattgattctaagatgctgcccttatcatgggacatttctaaaaccagcgtgggttctatgataaaagtttacatttaatacaatattttttaaataaccaagggcattttatagtgcttctttataatgcctcttaaattcctctaagaatgactcagtagaccctgaccataggaacggagtaaagaatggctacaaaggaaatgttgaagggtaccaagaagccagctgtagggctcccctctctccaattccctcatgcccatgatgtctgaaaagtccaccattcagactctttctgaggagcctaagatgccttgggctccagaggtggtcccctggtctggtgaaacttagcattagctcctgctggctggaatgattgatccagggataggcacagccagtgggaatccttcttagaaagaccttagaacaattagaaaagaccctcctccctttagttggtaataagccaataaaagatcagagacggtgggggtcatctttgccttcatatgaaaagacctcatcgtgcctgtaatcccagcactatgggaggctgaggctggaggacaacttgagcccaggagtttgacaccagcctagaaaacatagcaagactcccatctctacaaaaatttaaaaaatcagctgttcataggacacatttctgtagtcctggctactctgaaggctgagacaggaggattgcttgagcccaggaggttgaggctgcagtgagctatgattgtgccactgtattctagccctggcaacacagcgaaagaccctgccttaaaacaaaaaaaaaagaacagaagtcactggagatgagccaacctgggaaggtagagtccgaagacggagagagggaattctcaaggcccctgtggatcacctgaatccagcccctcacaccctggacccctcctttcagatgccccaaacatcctattgaccccctcccttagggtattttcaaatgttttccttcatttctggaatgttccagcaatactagctaacatgctccactgttagctaataatgccatgagccctgagctcaaagtcctgagctcgaagatctagggaggccttcccaacaccatcccaggcagatcctcctgcctgctggccattcttagcactctctgtatccctttcctatagcattgtccccatttgtaaggacacttgtatgtgtgtatgtgatggtctggttaatgtccttcttccctactagactataagctccccaagggtaaagtctctgtctctgttcatcattctctccccagtgcctctcaaaggcctggcattttgtaggtaaatatttgcaaataaaggaatcagggtctcattttggttgaggtcaactgatcaaagctcagactctaactcagactcctggtttctaagactgactagctgagatcttgggaaagtcacccacacttgtgagcctcagtttcctcatctgtgaaatgggactaataatggtacatcccagggatgctgtaaggattgaatgagctgctatgtgtaaagtactgagaatgagacacagcataaagtcaacatggagcaacagtgagctgtgcttcttataagggcccctttagctgtggctgctactgttgacagtgaaagatccaaccaacgactgatgttttactctgggctttagatttgtcaggatggtgtgttgtctcttgtccccaagccaggtattgaaatgtggggtggggggaacaaaacaactgccaaaactctggagggatgctgggtggttttgtctaggtttggagcccatcacagcccaagaacccctggaccagctatgttcactgaaacatcacatggtatctagagggtccttgaatggcacacttgtcacaactttttgtgctcaaaaacagtcactggaggatcttttaaaagtgcaaattatagatctagagtggggctaatattttgcattgctaacgggtccccaggagatgcctgtgctggtccatggaccacactttgagtaaccaggcagatgtacactgaaaagcaactcccatcgtgccgagaaagctggctggctccagtgacctgaactatttgaaagagtgggtaactgaagaggaaagaaaacagcctgaaatggaaataaatactgtgtaccacaatctcattaatgtctaaaattagattaacataattaaaaatttaaaagctagattaaagcatgtcagcctgaaatccagtggtgaattatgccacagctatctttgctttttccttaacggtttgtgctaatgggtatttcaaagactactgggttacacgttgttctttgtgatttttgattatcaccaaacacatgcaattgacccgatttccaaggagatggctctcccaggacatggctaccatgacactccaaaaatgtaaaatcatgctcaaccttgggccctctcctctgactgccaagtaggcttctttggggaaagaaaagaggcttagttactctccagatggtaggcatgcaccttacatgtgtcatgccagtcatggtgagtggcacaaatattattgaggttcccatttttaatgtattattattattattattcgagatggattttcgctctgtcgcccaggctggagtgcagtggtgtgatctcagcttactgtaacttctcgggtttaagcgattctcctacctcagcctcccgagtagctgggattacatgtgtgtccaccatgcccggctaatttttgtattttcagtagacacgggaatttcaccatgttggccaggctggtctcaaactcctgaccttaaatgatcctcccacctcagcctcccaaagtgctgagattacaggtatgagccaccatgcctggcctgaggttcccattttataagtaaagaaactgaggttcctagaggtacagtaagctgcttgaggtcacatagctaattagtggaagagagctgggatcctaacgcagttccgtttgatttcaaagcatccatattcttttcatggcctctctgaagaataaaccatcacatggttccatttaaggagtgaatgcatatgcacatgtgtgcaggcagaagagtggtgctgccaagagaaatggagacagagtaaacatctaatcataaaatgtctatctctttgtttctgctcaagttgtcatactgaacccattaccactgatataacttactacatatttgaacataattggactaagtgatctgttccctcgccagattcacaaagcacttattagctcaggcttctggtcctggagttattaagtctgttctcatccaccaggagattaggttcctgagggtgaatatcaccttggagacatttcagattgccatgactttaaccctaaaatgggtacggtcgtcttttcctggaataggtggacaaaagaaggcaaagtggggcggggactccgtggagctaggcacgggtcatcatggccatgcgttcatgggatatgtccacacccccgccaagcttctctcttgagtccccagacttgcagtttggccaaaacatctccctataaatctgatttccttccaggaagtgagatattttgaaagagtcttgggagtgaactttgcctaacctaagttacactgggaggatattgttgcaggtaaaggctgcttgctaaagggctgttgctttgaactgcagactgctattctcgtttagttatataagccggagagttatgtctactttggttgttgttgttgagacggagtttcgctcttggtgcccaggctggagtgcagtggcgtgatatcggctcaccacaacctccacctcccaggttcaagcgattctcctgcctcagcctccctagtagctgggattacaggcatgcgccaccacgcccggctaattttgtatttttttagtaaagactgggtttcttcatgttggtcaggctggtttcgaactctcgaactcaggtgatccgcctgcctcggcctcctgaagtgctgggattacaggcatgagccactgcgcctggccctatgtctactactatttttgttttagaagtatttactgaggaccaaatgggtgctggctagtcttctggatgctgagactagagcagtaaacaaaatttggatgctagaggggaatatattaaaaatacagccaaaatgtaaaatggttcagcctctgtggaaaacatatctgtggtttcttaaaaagttaaaccaaattactatatgacccagcaactccattcttcaaagtactgaaaacagatactcaaacaaatggtatacacatgttcacagtggcattattcacaatagcccacaaggtggaaagaattcaaatgtccatcagtagatgaacagatgagcaaaatgctgtatatccctacaatggaatattatttggccatgaacaggaacggcattctgacacatgctacaagatgcatgaaccttgaaaacatcatgctaagtgaaagaagttggatgtaaaaggtcatgtactatataattccatttgtatgaaaatattcagaataggtaaatccgtagagtcagaaagcagattggtggttgctgggagctgatggaggggggatgaggagagaccgtgtcatgggtatggggttttcttctgtaatgatgaaagtgtcttgtaactagatagcagtggtgcgtgtgcaaaattgtgaatggactcaatgccactgaattgtacactgaaaatagttatttttggtaatatgaatatcacttcaatttacaaaaatggagattaataagattatttctgataataagagttaataggaaaattataaagagtaatgaggtgaagggtcaacaggcattgttggtgaaatggtcaaagaggaactccaccagggggcgacactgaggagatattgatgacccatgagagaaaaccttgcaaggactggggcagagctttgcgggcaggaggaagaacaagaacaaaggttgggaggcaggcatgtggtgggccagttggatgccagcatggtgattaaaggtggatgcgacaagagcccataatgtgaggtagacaggagctggatcctggaaacttccctgacaggtcagaaactcgtacaaatatttgaactcagatatcaggggaagccactggagagttacaaccagggaacatatactgatttgcatttttaaaaatcgatgtagggctgggtatggtggctcacgcctataataccagcacttttggaggctgaggcaggggaatcacttgcggtcagaagttctagaccagcctggccaatacggcaaaaccccatctctactaaaaatacaaaaaaattagctgagcatggttgtgggcgcctgtaattccagctactcaggaggctgatgcaggataatcacttgaatctgggaggtggaagttgcaatgagctgaaattgtgccattgcactccagcctgggcaacagagtgagactctatctaaaaaaaacaaaaaacaaaaaaacccaacaaaaacaaattgatgtaaaattcacataacataaaattaaccgtgctgaagtagacaattcagtgggctttagctcattcccagtgttgtgcagctaccccctctcttgttccaggatattttcatcagcccaaaaggagacactgtattcatagtcagtcacctcccattccctgtgccccaaccgacaactaatctgctttccttctctatggatttccatatttggggtgcttttaaagttaattatttatttttgagacagggtctcattccgttgcccaggctggagtgcagtggcatgatgttggcttactgcaacctctgcctcccagcatgcaccaccatgtctggttaatttttttgtagagatgggttttgccatgttgcccaggctagtcttgaactcctgagctcaagtgacccacccacctcgacctcccaaagtgctgggattacaggcgtgcaccaccaggcccagctaattttgtatgataatggaaattttattactctataaaacataccaacaattgagcaaagactgtccaaaaaattgttcccatccccaggactcaaatctccccactatctttcacttcaaaatcagaccacagctgtctttgtacaatttttttccaacatttagaattttaccacatctagaagttctcaggtcaggtgattctttaaacaatcgtgcatctatctgcttgcattgacattcccccgtctacttctgcagatgaagtctcaaccattgtcacctcctccccaggcaatggcagtatgtaggaatgtaaaacggagcagccagtgtggaaaatagttcagcggtttcccaaaaagttaaagaatgatcacagagcctagcaattctgctcccaagtagatgcccaaaggaattgaaaacaagtgttcaaacaaatactcttacaaaaatgttcacgacagcactagttataaaggccaaaaggtggaaacaacccaaatgtccatcaacagacgaatggataaagaaaatatggtatatcgatacaatggaatattattccaccataaaaaggaacaataaactgatacatgcttcaatgtgggtgaaccttgacaacagtctgctaatggaaagatctcagacacaaagtcatatatggtatgatgccatttatataaaacatccaggccaggcagaccactccatctcaaaaaaaaaaaaagaaagaataaaaaagaaaatttccttgccagctagcttgaaaatctctcttggggcccaaattggccttgtttaggaagacactttgatgagtatctgggaggaaaatgaaaccctgaagtcatctgtcaattaaaaccaaagtccaggaaaatcaagttttaaaggtattccagaatttcccgtagtatggaggaaagaaagagacaggaggtgagagaggcatccagtgacaaaatgtggctgcctgagggtcattagctagtgaagaatttctggtgaactttgttgaatcctctggcttcaatcctttccctgtgagaaggtggggaaactcagtcccagagcagcaaaatgcttgcaaaaagaggataatggcaagcagggtgcagtggctcacgcctgtaatcccagcactttgggaggccgtggcaggcggatcatgaggtcaagagatagagaccatcctggccaacatggtgaaaccccatctctactaaaaatacaaaaattagctggatgtggtggcacgtgcctgtagtcccagctactcaggaaactggggcaggagaatcgcttgaacccaggaggcagaggttgcagtgagccgaaatcgtgccactgcaccctagcctgacgacaaagtgagactgtctcaaaaaaaaaaaaaaaagaggtaatggcaaaaacaaaaatcaaatgtgctttctacttttctcctgctatagaatgtttctgaagcacttctctaaggagagacaaatgaatgcccaagctatactctctataaatttacacttacatgaaaggaagaagtcatcccttcattcatccatctatccacccatccacccatcaatccattgatatatcagtttgtctgtccatccattcatcttcctatccatctttccttctatccatccatccatccgtccgtccgtccgaccgtccgtccgtccgtccgtccatccatccatccatccatccatccatctgtccatccatccaaccatccatccatttcatcaattaacaaatattttagcacttaatgagctgaagtcagggattttcattgcaggcctataggccatgaccaaacatttgaattttattctaacagtaatgaggttttatgtaagggttttaacctggggctagcttcatcttatttaagttataatgattactttggaatatggaagatggactggagggagcaaaagcagaaattgaaagatgtatcatctaaataacacagtccaacaatcctattgccttcaatcacatgggcttctgtgcaattcaacaggcaccttttacaattttttcaatagatttttggcgaacaggtagcgtttggttacacgaataaatactttagtggtgatttctgagattttggtatacccattacccaagcagtgtgcactgtacccaatgtgtagccttttatccgtcacccccaacaccctttccctgagtccccaaaattcattgtatcattattatgcctttgcatcctcatagcttagctcccacttatgagtgagaacatacaatgtttggttttccattcctgagttacttcacttagaataatggtctccaatcccatccaggttgctgtgaataccatcatttcattcatttttactgctgagtagtattccatggcttgtatatatatcacaatttctttctatatcacaatttatttatccacttgttgattgatgggcatttggactggttccatatttttgcaatggcgaattgaaacagacacttattgagctgctactgaataccaggcccagtcaatctgggtgcagggatgaccactgaatgtttccttccctcattggagctgatactacagtggtggatggagagaagaaagctgacaattgtgaccaggatgggacagcagatacacagatgccaagacagtaagggtggaggccttgacaaagtctaataaaggcagaggtaagccctccaaggggggcttcttggaggaattggtatttaagctgaggatataaggatgcctgggacttggctgggaagtgtactcttagcaaagaaaacagggtgagtgaaggcacaaagcatgacactgcagagtttcacgtgggaagccacaagagcccttcaggaatgaggcagaatactacatgggtatgtgcgtggaggggttgtgggcaggcgtggtgacagctgacaactggggtcactatgagtagaaaatgagactcgagataccagtggaggctaagtcatgacagatcatatgtagattacatcctgatggtactggggaggtactgattataaaaaggagagggtataaatcccccttcctttgcttctttctgagtacagagccatggtctgagcacatctggatgagaaagaacgtttgaaggctgagcccttaggaagcaaattccatatgccatttgttggtataagatgtttatgtggggaacatattttcaggtgcaattatttctcttgcaaaaacatgacctgtttctcctattatacttatcatctatttattttgaagagtgagaaaacagactttaaaaatgaacaaaaatttaaacctgcaattttttcatctagtgataactgttactattttattgtatgatctgtcatttaaaattacataatcacgacttttctataaatgggatcatagcctgcacactgctttattagttgcttttttagttggaaatacagcatcaacagcctctgtgttttcttccaagggctgccaaaacaaagtgaatggcttaaaacaatagacatgtattataggtttagaggctagaagtccaaaatcaaggtgcttgcagggccaccttccttctaaatcccataggagaatccttcctggcctctttctggcttatggtggtcactggtaatctttggcgccccttggcttacagttgcataaccccagtttcagcctttgtcacttgacattctccctgtggctctctgtcctcacatggttgtcttcccatgggacaccttttgtgatggttcatgctgcatatcaacttgattagattgagggatacaaagtattaaccctgggtgtgtctgtgtgggtgctgccaaaaaagattaacatttgagtcaaggggctggggaaggcagacccacccttaatctggtgggcaccatctatcagcttccagggaatacaaagtaggcagaaaaacttgaaaaggagagactggtccagcctcccagcctacatctttctcccgtgctggatgcttcctgccatcgagcatcagactccaagttcttccgttttgggactcaaactagctctccttgctcctcagcctgcaggcagcctattgtgggaccttgtgattgtgcaagttaatatttaataaactcccctttatatatatttatatgtgtatatatatgtgtgtgtatatatgtgtgtgtgtatgtatatatatatctcaaaaagttaaagaatgatcacagagcctagcaattctgctcccaagtagatgcccaaaggaattgaaaacaagtgttcaaacgaatactcttacaaaaatgttcatgacagcactagttataaaggccaaaaggtggaaacaacccaaacgtccatcaattatatatatatatatatatacacacacatatcctattagttctgtccctctaagagaaccctaatacacctttcatattggactaggggcccaccttactccagaaatatctcgtcttcactaaacatctgcagccaccctatttccaaggaaggtcacattttgaagtactaggggttaggactttgtgaaaggaaagtaccttgggcccccaaaatcgctaagctaaaaggaaaattcaagctggaaactgctgagggcaaacctgcctcccattttattcaaagtcatctctgtgctcactgagatagatacatattctgattgcctcctttggaaaggcttatcagaaactcgaaaggatgcaaccatttgtctctcacctacctgtgacctggaagccccctccctgatttgagttgtccctttgtccccgcctttctggacagaaccaacgtacttcttacatatattgactgatgtctcacgtctccctaaaatgtataaaaccaagctgtgccccgaccagcctgggcacatgtcgtcaggactgcctgaggctgtgtcacgggcacgtcctcaaccttggtaaaatacactttcaaaattaactgaggcctgtctcaaatttttggggttcacaacttcgactttttttttttttgagatggagtctcgccttgtcatccaggctggagtgcagtggcacgatctcagctcactgcaacctccacctgctgggttcaggcaattctgcctcagccccctgagtagctggggctacagacacacaccacaaggcctggcaaattttttttttttttttttttttttttagtagagaagggatttcaccatgttggtcaggctggtcttgaactgctgactttgtgatccgcccacctcagcctctcaaagtgctgggattacaggtgtgaggcaccacacccagaggacatatcttttttttttgatgggggagactcggtgtaactcataacagcctcacttgccatctaacactatttttactggctacacactattacattttgtaaatgtacaaatgtccctgggtccatctttgtcacactgaacaagcaatctgctgcgtgtccttgtcctgccgtgtgtggtgacagcagccatcagcctgagcactgtgatgctgggtaccttccaaactcacccaatcttccgctccctgctagttgctactgacagaaaaagacggtggactcaagttctctgaaaatcctttcaaacacaagggcaagagcaaaaaggaaaacttcacataaccagaagagtcaatggatcagaatttcccccaggcattctggttcatgcagatttgaccacattttggaacaaaaccagttctaagtggtctactcatcagttgctcacctgaatgcaacaattactattattattttttgagacagagtctcgctctgtcaccaggctggagtgcagtggcacaatctcagctcactgcaacttcacctcctgggttcaagcgattctcctgcctcagcctcccgagcagctgggattataggcacacgtcattaggcccagctaatttttgtatgtttagtagagacggggtttcactatgttggccaggatggtcttgatctcctggccttgtaatctgcccgccttggcctcccaaagcgctgggattataggcatgagccaccacacccggccataacaattattttattcaacctgccttatgaatgtaggcaaaaagcatccaactccagtttcccaggatatcactcattatcccaaaagatgtggcagcagcctagaaagcaagtctgttttaaaccataaaacctcccctttgtgagcaggagaccttccgcaccacgtcttcacacacacatggagcaacagtactttgtgttgcctgttgcggctgtaaagaggttttcatgcacactggcccatttgattatctaagcagtccagctggaaggtcaggaccattcatacctgaggctttggaacatcctgacttgcccaaacctgctcagcttataaccgccaccaccacaaatcaggaattcagccatgtgtggatagacagtcttattcaatcttccccaaaacataagaaagtgctgtgttcttttcccttctagagaaaaataaactaacccttaggaaacacgctacctgacccatgctcagacagttagacagtactggaactgggtcttgaacccacactgcctccctccccaggccatgtttgtaaccacaaagctaacttgtgctgggctaagacagacttttaactccttgaatcttgactctttttgccgcatgacctggtttggttcaacaatggcaatttatctctatttaaaagcagatgttgggacgggcatggtggctcacgtctgtaatcccagcactttgggaggctgaggaaggtgggtcacctgaggttaggggtttgagaccagcctgaccaacatggggaaaccccgtctccactaaaaatacaagaattagatgggcgtggtggcgggcacctgtaatcccagctactcgggaggctgaggcaggagaatagcttgaactcagtgggaggaggttgcagtgagccaagatcatgccggtacactccagcctggttgacagaacaaaactccttctcaaaaaaaaaaaggaatggatgctggctgggtacactggctcacacctgtaatcccagcactttgggaggccaaggcgggcggatcacttgaggtcaggagattgagaccatcctggctaacaaagcgaaaccctgtctccactaaaaatacaaaaaattacccaggcgtggtggcacacgcctgcagtcctagctactcaggagctactgaagcaggagaatcactcgaacctgggaggcggaggttgcagtgagccagatggccccactgcactccagtctgggtgacagacgtagactctgtcaaaaacagaacaaaacaacaaaaatgatcttttaaagttacttactatctaggatacctgctaggctgtaggctccgtctggaagtgtgtgacaacttaggtccttgataagtatttgccaagaaggagaagggatgggtagatgggctgggctgtctgcaaagttgaagctcaccagaccccagcttccttccttctgggatgcatgaaacagagaagtgtcaaaatgtccagcaaggtaaatgacttcctgctccaaagcatggaaggctcattttcaccccacttagcagtgaattatgttacctgctggtgaggacaactccaggaggcccgtaattagttccctgattattcacaattgaagcgatcacggctaactgatggtgttcccacaaaaacctgtaggagagccaggccatttggcagcaactgcgttcccaacaaggcagatcaatttccgtttgatttgtttaaaaataacagataaacaatgcggagcagctcgcaaggtttgggttcctcctttcctaaaatttgaggaaaggaggccgtttgaaattaccagttaggaataaaacaggcagatcacattcgtggctcaatcggattcccctataatcagagctaataactgtatttttctgctactaaacaattctgttattttaaagctaactataccgagctggctaaataatactcaggggctggccacagagaagactccctctgaaatgcagcgatgatgcccactttttcctactttgttctaattttgtccccagctgatgggtgacctgctgactcttgctgggagagaggctggagggatgtccagggagattttttaagaaacctagaatctcacacctttccctggaatacaaagggaaccaacccatgtttccttgaggataatgaattttaaaggcttctcgacctggattcactcataatctgagctcttccttgacctctgctattttccaaatatctaaattccgtccctttctcagctaagtccttcaatgacttcccactgccattaagatatgcctaagccacttaggtggctggcatggccctgtctgccggtccctcacctacttctctggccccaaattcctccatccacccgcaactccctttccttcatgttcccactacactgaattatgatctgcatggagcagcatgatagaggctatggactctagcagccagggtgcctgcttctaactctagctccaccattcatcagctgtgtgacctggggcaagtcatgtgacctctttgggcctcagtggccacatcgataacatgggaatcatagaagtacttgccctgtaatgtagctgtgaccatagatgcattaatgactgcatggtgctgagatggtggttggtgcaagcccgtgtgcctggcagagattggtcgtttgtactactttttgtttgtttgttttgttttttggagacggagtttcactcttgtcacccaggatggagtgcaatggtatgatctcggctcactgcaacctccacctcctgagttcaagtgattctcctgcctcagcctcccaagtagctgggattacaggcacccaccaccatggttggctaatttttgttttttagtagagacagggttttgccatgttggccaggctggtctcgaactcctgacctcaggtgatctgtccgccccagcctcccaaaatgctgggattacaggcctgagccactgcccccagccagcactactcttcaaaggtgcttttttttttcctctttgcatatgtggtttccgttgtcaggattactctttctgtctctaattctttgctttcttatttgactcatcttttggtatttagcttagacgtgacctctgcctggaatccttccagatgccatagccttcctctggagccaagagcatcctcaacttcctccatcatagacatctccccctgtggattgtaattacatatttgtgtgtgtcttatcgccaccaccagggtttctcagcctcagcactactgatctatcgacatttggggccagattattcttggttgtggggggccatcctgtgcactctgtgatgttcagcaccacccctggcctctacgcactagatgatggcagcagccctcctcaacccctagttgtgactatcaaaaatgtctccagacatggcctagtgtccctgggtatgggcagatatgaaattgctcctggttgagaccactacactaaaccataagctgaggggacaggaaatgtgtctgtctttctcatcccaattctctaagcacctagaatagccccaagtgattatttggtctttaattaatgtctgcggaacagaagaatgtggattctggggccaggagcggtggctgatgcctgtaatcctgcactttgggaggctgaggtggaaggatcaccgaaggtcaggagttcgagaccagtccagccaacatggtgaaaccccgtctctgctaaaaaaaaatacaaaaaattagccaggcatggtggcacatgcctgtaatcccagttacttgggaggctgaggcaggagaatcgcttgaacccgggaggcggaggttgcggtgagctgagatagatagtgcaatagcactccagcctggacaatgaagagcgaaactccatctcaaaaaaaaaaaaaaaaaaaaaaaaaaaaaaaaaaggagattctacactgagcagcaaagcaaatcaggtcaaagtgaaaagacctgagttcccctcctggatgtgccagtccctggctgcatgacttggagaggcccaagtttggttctttgaagtgacttgaatgagcatccttgtgtggtcacagacagcagcatcagcatcacctgggaatttgctagaaatgctcattctctggatcccccagaccagtgaatcagaattgcagggaggagctctgaaatttgtgttttcacaagctctctaggagtttctgattcatccttcctcagttctcagatcacccctggccaatcttagaattcacctggaatgctttttaataaaggatgcttaggaggctagattttcccggtccaagtgcataagaagctctggcattcaggctggccatcggtgtttttcacctgcttcaggtgattccaatgcacacacagccaggactgagatgttctcgacgcgcagaggctgttctaaatctctgtgcttcccacgttaaagcttttgggaactgcattaactctttcagtccaccagagggccatttacagtgctaggaaagggacagggttatcatttcatgtcctggggcacatggagccatagaccataagtacacaggtagaagtaagtgtccaagaccttcctctctagctgtacctggaaaaataccagaccggaatgtgaagcatcagaaatgactctaaggcttgactcatgctcttgcaataaccctgggacagccaagaggaacaggccaacctcaaccaggattctctatttaacccactagttttaaaagccatgtccaagaatcctctctataaattcatttttgaagccctccgtgtccctgggttcatgaaagcttttttgttcagaaggtggctgcagtttattatacagagtagatgcgaagccagacatacctgtgtttctgagaacctgtttccctcctctggatctcagattttattattttagttttttgagacagagtctcactctgttgcccaggttggagtgcaatggcatgatctcggctcactgcaacctccacctccgggttcaagtgattctcgtgcctcagcctcccggagtagctgagattacatgtgcctgacactacacttggctaatttttgtatttttagtagagatggggtttcaccatgttggccagactggtctcaaactcctgaccttagttgatccacccacctcggcctcccaaagtgctgggattacaggcgtgaaccaccgcgcccagcctggacctcagattttaaatgagggtaatgaagcttagctggctaggctgcgatgaggttcaacataggtgaacaggtgaaacaccagcctcaaacagtcgcttagtaactctgtggttctcaaaagcaccctgggatgtggttctcaaaagcaccctgagatgcggttctcaaaagcaccccgacaccagcagcttcgtcaggaagcttgctagaactgcacattttcagatgtctcctgccctacccccgccgcaagaaaaatactgaattggaaactttgggggtggaataacttagcctctctgagtctcaattttctcatttttgaaaccagaataacagtacctgcatctcagagacccactgtaagggttaaatgagctatgtacatcaacttcttagcacagtgctggcatacagcaagagctcagtaaatggtagctttcactgttattgcaattattatcatcttcaaagctccctgccccatgcaagccttagaaagaatctttcgtcagaactctgcacaagtatctcttattgaactttgcaaaataccgtattttggctctgaatgctccctgtggactacaacttgcagagcaggagctcagtacaccaatatgccctgtgaatacctcagccaacattataactcattctgagagatgccatctgtgttagtccgttttcacactgctataaagaacttctctgagactgggtcatttataaaggaaagaggtttaactgactcagttctgcatggttcggaggcctcaggaaacttacaatcatggcagaagaggaagcaggcactttcttcacaaggcggctggagagagaggaagaagcacaaaggactaacttccaaactcttataaaaccatcagatctcatgagacctcactcactattatgagaacggcatgtgggagattgcccccgtgatccagtcacctccttctcttgacatgtggggattaccagtccccctcttgactcgtgggggttacaagttgaaatgagatttgggtggggacagagccaaaccatatcaccatcgctcggagcaatacaactatttactgtagggtcgcattatggattgtgatctatttagttctaccccgctgtcagaaagactggctttccctccaccaaccaggaacaagcgaatgggcttggggcaaggaaaagaacaacaaacaaacagcaaataggacctgaaaaatattacactcatggtcagagaaaatgaaaaagatactgcaggagggaaactgagtcagctctgagtggccttgcggcagtgacagagaactttccagacgaatccatggaggcagaggggtgtctgatatttgcatctgccagctgtcagaaagagctggattttcaaggtggaagagagataagtggaaggtgggattgaaatttaccttcatgcaggtttcagtaatcagggtgagaagtagagaatcctcagctgaagatagttactttctgcaaaagtgggctttcctttctttctcttttcttgtaagggattattttcctgctcagtctcctgagtctcccccagtggccccagcatctatgacccaccattccctgagggcttaactggtcattagctaaaaagaagttgaatgaaggtggggctctctgcagttattaagggttgagaatgcaaatgccatgagagggaagaatttatctgaaacatatgagcaacagcaaacaacggacactgaggactaaggaatgcatgcctcaattaaaagcatttacattgaaacgcaaaattaaagccaattacattgataaaactaatgaaatatggtattaatacataacacacttattgcctgtgtgacttaactgtgtaataacaataagaatggcagcataggactagattccagttgctgtggcctcaaaagggacggatttgatcgtacttgttcccacttcctggaaaatagtggcttttcatgatctggcagctgaagcagcagcaccatgctgctgtaagtgctgctgatggggatttattcaaatgtgaattagacgaagctggtttggacaggcgatgagtcggggaacgctgggacatcctccctgtgacaaagtcctttcacaagcaaagactccccagcccaacagtgatccctgggtgtttcaagaaatccattcagcctgaagtctgaatgccagctctgctacttttagctgcatgatcttgaacttgttctgaatggctctgactcagtttccccatgtggaacattgggaagattacacttacctcttggaattgccatgaatcaaagacattgttgactaagtgtccagcagtgtacccggcacacagtagactttcaaccaatagttcttattgatagtattattatcatttattactgctactaccactacatccctccaaaaattgatccaggatgggtgtgtcaaatggcagggtaaattattgttaagaatggaggaacagcagactacagaattttaggagaatgtattattcttaggagatgcatgctgagttatcaggggtgaagcatcatgatatatgaaatttactttcaaatggttcagaagaacattgtgtgtgtgtgtgtgtgtgtgtgtgtgtgtgtgtgtgtgtgtgtgtagagagagagagagagagagctcctgagagagcagaaattgctgtgtcaacaattttgaatctaaggcaaaagatacgcagatggtcattatactatactattctttcagcctttgtctggagccaggcttcctacgttcaaatcttcactctctcacttactagctatatgataacttctggcaaattaaagaaacactcagtgcctcagtttcaccatcttaagatgagaatcattaaaatgcctaactcaaagggcttttgtgaggacgaaatgagttaatgtacttagaatcatttattgaattaggtgctcaatgtgtgctaactccataattagctgtttgtgattagatacatgtataaatagatgggttgatagaggtggataataagatggggagaggaaggagggagaaaaaagtggaaggaaaggagggaggaaggaaggaaggaatgaaggaaggaagtaaggagggagggaggaaggaaggaaaggagggaggaaggaaggaaggaaaggagagacagctggaatatctcatcactcatagtgagtaatgttttatttgtagttttcagtaaacttcaagtttctgcacttggcataaatgaggtaaacattatcaatgaggtaaacgttattacaaacatatatgtaaattatataatgcccctacccaggttccagcctgcaaacccagctagaagacgttgttctttccacacaggtgttcatcactccttgcgggcatgggcaggagcttggaacagcagagtttttgagacctggagtgatcccctggcacccagagtagaggtgcccttgcttcccttccgtctgctccttctcacctgccctccaaagtcaatttcagtgccatctcactgtcagtggtgcccttgtggatacgggagtcctgttcggccgaggatggagtctccctaatggtaatgcatgcagaataggactggcacctggattgcattttaaacacattccgcaccattaggccatcctcatcattcacaggactgacggcagagttgcgggggcctccaggcccagcagcaagtccagccggttcatccggtcggggcatcctgccaagacccttcagctgtgaagcggccactctaggcacaggtggggagacctgatgagcagaaagcagcctggagtctgcctcctgggaatgggaacaaggattagggggccaagccctgaggagcatcccagccactctcctgggggcacagattctacccattggaataataagtgctttctttttcacgcgcctctctccaacttgctctagcactgcagccactctaaccttattttcctttctccaacacacctggaactttctttacatgggaccttgacacaggcaaatccttctctccagaacattcttccttctgctggttcccttcttgctgtccaactcacctccccaggaagccctcctagatctcataatatcataatatcaagaggttgtccctgcctcattgtcttttaccttttatttacttatttatttagagacagagtcttgccctgctgcccaggctggagtgcagtggtgcaatcttggcttactgcaacctccgcctcccaggttcaagcgattctcgtgcctcagcctcacgagtagcaccgtgcccagctactttttgtagttttagtagagataggttttcaccatgttggccaggctggtcttaaactcctggcctcaagtgatctgcctgcctgggcctcccaaagcgctgggattacaggcgtgagccactgcacctggtcttttatcttgatactttctttcttttcctctgtgcctcagcttcctcctttgtaagtggggtaacaattgtgcggaatgtgctctatttggtcaacttttctaccatgttctacattcctttggctgatcagttggttctcatgtcctctgtctggattcagtcaatgagaggcaggcagagaggagatgggactattgattgatcccctgggcttacatgcttacctgttgggtggcgctgagttcctcttttcaagctttctgatggacagctgtgttcttggctctattaggttggtgcaaaggtaattgtggtctttgccattactttattttttttgagaaagagtttcactctgtcgcccaggctggagtgcagtggtgtgatctcagctcactgcaacctctgcctcctgggttcaagtgattctcctccctctagagtagctgggactacaggcacccaggatgcactcggctaatttttgtatttttagtagagatggggtttcgcatgttggccagcctggtctggaactcctgacctcagatgatccacccgcctcggcctcccaaagtgctgggattacaggcgtgagccaccgtgcctggcctttggccattacttttaatgaaagcgtccctccggtgttccttcagcaccaagggtggtaacagctccctgatgtggccagcgcctcggtgcttcactgtcccttgttggtttccttgggtcctgcccacacctttgtaaattgtcccttcgctgcactagcctcagtaatggctcagacagtgtcatctgctacctaccaggactctgatccacataataatagtccctatctcatatgttgtgaggattaaaatgatttcagtgcaggatacacagtgctaagattattatttgctattattctccttcctctcacttatcacactttgcacttagttgcaatgctaattgctcactacttttccctctggttaattgacaatttgcatgaagagggagtctctgtctgtgcctgttcattcaatctcgtgatggtccagtgttagatgcaaaataggtcctcagaaaatatctgatgagtgaataaatgaatgaatgaaagaatgagggttggttttcactttccaaagcacttttatatatcatgttgaattgtgtggtagcatgcatattcgattggttttgtttgataaacacagtaatttcacaagcctttacctattacattatcctctttgatccatgaagaatagtcacaatttaataaataattagactgagaagaatggagggaaaagtagaagggggaaatgctgcctgagaacctattatgtgctcagattttccattagcatttgatggacatgatttattttgattttcacaatggttattatcataacgacagaagcatcattattccctagtttacatatgcagaacacaggacagagaacagttggaagactcacccgtagttactgtattagtcagggttctctaatgggaccgaactaacaggatagatgtatatataaaggggagtcgattaaggagtattgactcacacaatcaccaggtgcgctctcacaataggccatctgcaagctgaggagcaaggaagccagtccaagctccaaaacaacaaaaggagggaagcccacagtgcagccttcagtcagtggtcaaaggtccaagagtcccacagctgaagaacctggaatccgatgttccagggcaggaagcatccagaaagggagaaagatggaggctgggagactcagccagtctattctctccatgttcttcaacctgcttttattctggccgcgttggcagctgattagatggtgccctcccagattgagggtgggtctgcctttcccagtccagtgactcacatctcctttggcagcaccctcacaggcacacccaggaacaatactttgcatccttcaatccaatcaagttgacaatattaaccatcagagtcaccaagctggagggtcatagaactggactccagacctcatgtgtttcactcaaaatgtcatgcttttcccacacagcagttatcccactgagagaccccagagagtctcttataatgcatgcagggaaaggtataaacaagtatctgtttgtaatagcaaaacaaatggcagcaaccccacgtgtctattgggggagaaagggtaaataaattgaaacatttaaacactgaaatagtgtggccataaatgtgaatgaactagaggtgcacatatcacctgcaataagtgtgaaggaaaaaacaaattgccagaaaattccttagtgtaataccattttatatcaaggtttacaaatatacaaaacactgctatggttgggagtggtggctcatgcctgtaattcccacactttgggaggctgacgcaggcaaatcgtttgaacccaggggtttgagaccagcctgggctacacggtgaaaccctgtctctacaaaaaatacaaaaaaaattagccgggcatggtggtgcatgcctgtggtcccaactgctcagaaggctgaagtgggaggatcgattgagcccaggagatcaagactgcagtgagctgagatgacaccactgtactccagcccgggcaacagacggagcccccatctcaaaacaaaagcaaaaacaaacacaaagcactactgtgctttatttaaggatacaactatgtcattacaaagtgctcacattcaagaaatcacacataccaaattcaaaattgtggtagaagggattggatgatactttaggggagtgacttaggggtctccatggttcctgtgatgcttttcttaagaggggagggggtttgctatattattttatacttttttcttcttaacagaaatgtctcatttataaaaaagtggtaccttgcctaaggacacccagctggttaaggatggagctggacatgtacataagccttgcgactcctggctcagtgctctttcccctgcggtgagctgtccaaaaacggggtaattatctcccttgtgcaacttgggaagaggtgaaacgcaatgttgagtaacccttccttgcttccttccttccctgattacagccttaccaacaccccggataccttctttcaagttgttcatgttgcctgcctctcagagtatagtttggtttctgcacggcttcagtgcaaaaaagagaaacttcctttcattgactcaatcagaaagtctcagaaagatcagagaaagtaaccatcccatcaagaagctggcgtggggccgggcgcggtggctcatgcctgtaatcccaacactttgggaggccgaggcgggccagtcacctgaggtcaggagttcgagaccagcctggtcaacatggtgaaaccctgtcactactaaaaatacaaaaattagccaggcgtggtggcaggcgcctgtagtcccaggtactcggtaggctgaggcaggagaatcgcttgaacctgggaggcggaggttgcagtgagctgagatcatgctactgtactccagcctgggcaaaaaaaaaaaaaaaaaaaaaaaggaagctggcatggcaggcactcttgtctgcctgcttaatgattctatgttagcagggaccgtctcctataatagaagtccgaaaagggggctactcattttcccagcctccccatggcatggccggtaacctcatctccataaagggaaaatctgctgaggggtttctgggaaatacaccccctgttggtaaaaaaggagagatgcaagaaagatgccatctctctttctgctttgtatgttgtcatgcaagaatgtgatgtttggagctgtggcagccaccttgtaaccatgaggaaaggaccaagagaataattaagaagctattgctgacctgttgaataatctcaagccacctatctctcaattgcttcttaagtgagaataaaaatgaatcaatattgtgtatccacttttactctagtgttttcttcctggcaaacaaaatcacatcatctgactctcctaaggaaagaaagataagcaggcctgtggtccaggtacaaaccatctagacacaggcacttacatgccatctgcacacatgtgcttagatgggatctaggataaatagaagtttgccaatcccttgattagcccttgccataacttctacctgttctttggataagagtcaaaatcttcggcaagaccttccaggcctggcccaactggtccctgcctgcttcctgcctcaacctgggccactctccccatatgactcacaaggttcccacacataagtcttgttgttgttttattttggtttggtttctccagtttgccaaaaccttgtcaattcagggcatctgcatcagcttgtccctctgcctcaaaagtgccttccctcactctttgcctggaaaacttattctaaatcttccattcttgccctaacaatgatttcttcagggaaaccttcccattcttgatagattcctaatatttatatatctcataggacgatgttttctccttcatagccctgatcgtctattatattttcttctttttctgtgcatttatgtttctttgaccgtctccaacaatggaatttaattccactggagcagagactgtgttggacttcagtgtccctccactctaacccaaaatatgcaccatcgccctactttctcaaagtgaaggtctgggcagatcacctccattttcaagactagttaagataataaatgtggctgggcgcagtggctcatgcctgtaatctcagcactttgggaggccaaggtagagggattgcctgaggccaggaatttgagaccagcttgagcaacatagtgacactccgtccctacaaaaacatttttaaaaaattagctggatgcggtgttatgtgcctgtagtcccagctacttaagaggctgaggcaggaggattgcttgaacccaggagttcgaggctgcagtgaactatgatcacaccactgcactccagcctgggtgacaaagtgagacactgtctcaaaaaaaaaaagaaaaaagaaagaaatgctagctagtattactattatgtctattcattttctagagttaaatttaaattccttagcctggcatttacggtcacatttaattcatctccttcttcattcattcagcaaatatttattaaacaccaacatgctccaggcactgttctaggcaataacatacctttcctcctttatcttccctccactcctcactaagtcatctgccattcaaaccacctcaacttcattcacattactcaagtttttctctaaaccacatagtaaatactattttttccatatttttcactcaaattctttcttttgcctaaaatgcctttctcactctgtatatttccaataactcctcacctatctttcaaactccaccctcattattttatgcaaaaatatttattaagcaccttttatgcatgtcctggtctcatacatcggattggacatgcaagagaccaggaagtgcatacaaagtgcttaataaatatttttgcaattggagattccctggggggatgggggggatgggagggatgcaggtcacgcgtgtggctcttcactgttcttacgcaatgtctgacgcatagtcagtgcacatggtctgctgaattgtggggaggaaaaaacagcttgagaagcccctttcgctttcaaggcttaaagcctctgagccaagggtctccaaatattttcgatcatgaacacctccctccaaaaaagtgaatgggcaccccagtattagattgattttatatttaaacattgaattatatactcttcatatgataatgcacaagccaaagaaagagactgaaagcatgagattaaagaaagtaaaattcagtagaaattctcacagttttcatccagcatttcttggatcaagttacccatccccattttagagactggtctaacctcagaagataactgactctggctcacatggcggggctaagaggatctttcgggaaaggcaacgcattttcgttgcaatgacagagaagtagttggcctggggcttctacgtctgttgcttcccatgaccctggcatctctgttcattggagcttccttggatcttgccccttgaaactaacagatcagctacttttttcctcctcttccttgcctcatccatgacctggaactgacctcatccatgacctggaattgacctgcctatcattgaaataattgaaattgaattatttccactataatttcattgaaataataagcagcaggctgtaaatccgggttgaacttgagagctggctaggaaggtaccaggcccttctcttgcttggggttttcctgcagatgaagcagcaactttgacttctcaaggtaggcggggaatttctgtgaatgtctcatgcttggagaaagcaaacctgccaggggacgtgtcccaatactgttttcttccgtgcatcacaacaatttatgaagagccacgccatcgccaccctaatcctgctggctccttctcaaggcaaaatgagtttcggctgcttccccaggtgtctctagccccacctctgcaggaagcagcccccttagaaactgcctagccttcatctctgacaccctgtcaaggccagcaccctgagcctggcctgggcacattgtttaggcctagggcttcagcacaaactctttgccaggtgccccctctgggagtggccaggaacttgggagtaaaaccgccagatatcctattaagataaccagttcttttcatgccctgggccctgcatggcagttagggtgaccaatcatcccagtttgcctgagactgtctcagtttagcactgaatgtcccatgtcttgggatattcctcagtccaggaaggactgactacataatttgcagggtccagtgcaaaattaaaatgcagggaccttcttcaaaaatgatgaagattttcaagattgtgacaacagggtgttaaaccaaataaggtgcccttttgaccatggggacctatggacctatgtgtctgcacaagttacacactcatgaagccatccctggtcccaggcaacccatgacagttgctaactctactccctatacagagattcagaaaaaataatgtattgttaattccacgaggttgttggtttcttacagaaacatgtgctgagacaacagctcttgctcccatctttctatcctccccacacctatgccagagctttctgaaatacgaaatcatgccacgccccaacttaaaccctcccgccatcatattctcaaatgtgactaataatagtaatacaaattgcagactcctggtattgacttcagttatttttactatactgttgcttaagtatgtgccaacataaaactcggcgtaaactttgtgtgctaatagctcttatacaatggtaaaaccacacttataaattaaaacgataagactatagaaccaataaaattcaaaggaacaacattcatttaatgggacagatgagttcgttttgccaaaactaaaatgccgctcgcagagtgattatggccttgggttggctgcagcaaagtgggttatttctcatggaggtgcttcttcatgctctggtccccacatggcttagatccttactcgggacccagctgggatatgtttgtttgaacaccatgacctgacactctttgaaccttacttggtacaaaatcaccctctgtagatcaaatccacctccgatcttttcccattaacccatgatgctgaaagacatactaattggcaccaatggtatcataaataaacatgcaagcatgggcattgaaatcgcattgcagtgtcaggttataaataggccacctagataaactaaaaatgcctacattaatttaaaaactatcaatgaaataaaaagaatacaacaataattagcatttgttgagcaactactatgtgacaggcactgttctaagaacttggcttgtgataacttattccatcctcacaactctgtaaggccagcactagtattaatgccatacgacagatgagaaaactgaggctgagagaggttatgttgacttgtcctaagtcactcaccatgtgtgcagaagttttctaagaaaagtcctcaatatgaactcacagacctctgatcaagaatcagggatcttgtgaggttcctgggctccagcctgggatcactagctcacagattgaagttaaagctcccgagtttggcaatagaaggctttcttcatcttgcctattgacttctcacccttttctcattctgatcctcttctcgttgcacctctatacttctgggctatcttgaaactccaagaggacagcaagctctttgacacttttcattaccttcgcttggaagtcttccctctgcctggaatgatcttaccccttcttacctggaaatggactatgtgttcttcaaaatgctcagtggcatctctctagggtgctgttcccaaatacagttgactctggaacaacacaggcttggagtgtgtgcttgaagttcatgtccatttatacttgaattttttcaataaaatttacaccaagtgtgcctgcctcttctgccttcccttccatctcctccacctcttccacttctgccacccaagacagcaggaccaactcctcttcttcttcctgctctttgatttaacgtgaagatgacaaggctgaaaacctttatgatgatccacttccatttaatgagtagtaaatatattttacttatgagtttcttaataaattcttttttctagcttactttattataagcatacagtatataatacatgtaacatataaagtatgtattaattgactatttatgttattggtaaggcttctagtcaacagtaggctattaatagttaagactctgaggagtcaaaaagttacatgtcaaatttcaactgtgtatggggtttgcatccctaatctctgcattgtttaaaggtcagctgtaagttctttgggatcccaccacaccgaagtctcccttctcttctcaaagacatcattatcctcctcacagcctgtgccctggcagccttacagagctgaaccaaccagatccttctcctctcgaggttttaaattaagactctcagagactgcgggaacttgaagtcagaagctatgctgtgataacagctagcacttatttagtgctgacattgtgccggccctgttctgagaccgttgcatatatcaccttatttcaagctcacagcactcctacgcaggatatcgtctccccattttacaggcaagaaagctgacgcacagaaaggaggatgcattctccatggttgtgccaacagtggagcacctgcatgtgaatccagagtccatgccttcagttatgacaccttattgctccagtgattgcaggagaactgggactggggctggtgtaatggcaaaaccacaggcaatctggaaatatacaagatcagaaactgaggagtgggaaaaggagaagctggttcacagtgagtagaacaggccatataggcagacagaagcaaagacaggataaaaaccaaccccaagatgcagagagagtctctgtcctagttggaccaatgccccagccactgctcagccacctgctgtgcatcttatttggagcccaagtctctcatgcaacttttcctttcttttccattgactcgtttttttaaaacctgactcagactgagtgacattttttctttccttatcacctatactaaaaaactccaaccactggaaattcaccagctccgatgtactctaaggccctgctgctatgcatttttgccacacctaaaaggaagctcacctgctgactcaccgagcaataactgggtcctacttacgccgacatttttaagcagaagtgtgcctcgtgcaatacttagaacatatttatactaaaaaattatttgctgtttatttgaaattcaaatttaactggctggtctgtattttatctggtaacccttacctggaattctatgagaaatgcagacacccaggctccaccccagacctaataaaacagaatctgcatttttaacaagatccttgggtgactcatgtgcacaagaaagtttgagaagtctggctaaaagatgaattaaaggcagtccagagacaatacagtagctccttgtccaccagggacccaaacccttcttatctttccattccaatatacttacctcatgctttctacccttaaggtcacttcctggtaaaggttgccagcctaagtctggcctccagatagaagcaaaaagaagatgccaacagacatttcccaaaccccatagaatggcctccactcccatctcattagctgttcctattgcaaggggagctgggagatgtagtttttccgttggacccaggatgcttctgtgacttaagtgtaagtctgtgggattgatattcaacaggaagcaaatctctgccatttcttctccctgagaagaacttggtaaagttaacaagttgtgttcagtttgaccagggggtctgaccaaaccaaagaggcagggaagggcaacaagatgcctgaaataagaagaaagaacaagggagtcctagccgtgttctagacctaggataattatagtactcagctcaacaatagattctatgctttcacagagaagagatattttgggtatattttggctgatgtagaaagctctagcaggcacagataccctaataccatactcgtgttccagagagcaatgactgattgcaggagtactagagttaaaatcttgcaaggtcaaggacaaaacactgttgggtatgctggaccccaaggaagtgcaacttctgttgggatttaggttacaaaggggagtgtggtggaactgcacagaaccagtcttcaacagcgatgtcatgtggctgcaagaagcaatagcaatgacagcgcaatcaaactctagtactctctgctcattgttgaagacacctggttccctttagactacataagccctttaagtgtgaggaccactgaggatggtcctaaatggtgtatcaacatctcgctggtaagaatgttcaaatgtttaattgaaaacaaacatgaggccaggcgctgtggctcatgcctgtaatcccagcactttgggaggcagaagcgggcagatcatgaggtcaggagttcgagaccagcatggccaacatggtgaaactgtctctactaaaaatacaaaaaaattagcctggcctattggcataccaataatcctagctacatgggaggctgcggcaggagaattgcttgaacctggaaggtggaggttgcagtgggctgagatcatgccactgcactccagcctgggtgacagagcaagactgtatcaaaaaaaaaaagaaaagaaaagaaaagaaaactaagatataaatatatttgcactctgagatcaaggagcaaagaaaattatcatggtattagggtgataaagaagatattattggcgaggacaaccttactttcccctcaaatctaaccctccaggtttggttagtccaaacccataactgctcttggatcatctcaaaccagatttctttcaagtaatgccaaactgaattaattctgggtttctagatgtttgttatacaccatgacaaaacccacttccgatgcaagaagtatttttcttcaaatagcagttgagcatggcaagcaagttgtggctggaatcagcctgctccatactgtggggctttattaacaaacagcctttctttaattgacatttctttcaaggcaatttgcagaataaagataaaaattctctgtgccaaattataactcctcctggagggagacacagtggtcccacttattctttcttttgtagggactccagcagacgtgagcctgtaattgtgaaagatggcaagaaatttctgcatcctggcaagggagaggatggccggaatgagaagccacagtgggatgaatttggaggataatccaagcagtgtcagtgagaagagggaggctccagccttgttgcaggtcaactgccaggtgagccaaaaactcaaaaaccaaaccaaaccaaaacaaagctacaaagcaaaaaatgctctctctctttgcctatagaatgaatacttagaagagagaggagaaggagaattaaaaggaaagggatggaaggaagaagagttattggatctaagggactgaaatatatcaacgaattgtgcaaaatccattctaggtgttcaatgtcagttactcatctgttgcatgtggtttcaatttccttttaaatccatatgtatttgaaatgaagccagaccagggtaggatgaaggggagcctgcatctcactgcttccctcaaaacaaagttttggatgtttttggtcattccctctgggttctcagtgcctggtggattccatcgacaatggatgttaaatccatcctctggggaaaggaagtgcttgcagatattgaacgtggacctcagagtctctaatgtgatgagagattgcaaccaactggcttctgccttttaagaggccctgaatccaggccgtctggaaattaaatagggagcccagctcactgctacagcttgtcagtgtgattgccacccacgattggctctgagcatctcttctaaaacatgccagcaactgtgtctttattttgttgatgcaagtccagatgctggtttgaaggaggtaagctttgtttctgagcccctatagcgcactcttcacagcattcagaaagagaaccaatgccttgggtgtgatctccatgaccctgcatgacccaaccccttcatcacctttctgacctcacctccccaacgttccctccattccaacccctctggcctcctcataatcccttgaacatagcagacagtctcccacctcagggtctctgaacttactgtttcctctgcttgaaattctcctcctgcagatacatgcacatcctcagatctcacctcgaaaattaccttccctggcagccctacatttttaaactgcccatggcttcctagctccctggtctactttactttcttcccgcctaagcatttattcctactgaatgcagtatataagttactggtttatcttgtgccttatctgtctgtctctaattacaatgaatgctccatgaaggcagagctttggtctattccattctgtactcaatccccagtgcctaggacagagcctgggatatggcaggcccatcacaaacatgtgttaaatgaactgataaagtaataaacagaaatgtgcatttggcaatttgaaaagctgaaagtgtggcatagtctaagttgggcaatctatggagaattggggctaaagttaactcggtttcatttccataaggaccccctaccccaccctgtacctgttataataggcccacactcgtttacaaggaagccggtgccaggagctccctggggatgggatgcctgtctcctgttaggtggcagcttgaccaaagccacagatggtgccccagggccatttgcatcaacctggcattcaaggccctgcccagcctgacatggatcagcctttatagctatgtttccaatagtcttccattttgtattcattcacccaacaacatgtgtccagttttatcttaaatcattccaatttgcattcaaccccattagatagtcttgcttgggagaatagtaaaagaacatttttgtttttgcaactcttttagctcaactttgtggtcaggaagttccacagattcacgggttcagctttccctctccagggctttctctacatcaagggcccttgagtcaactaagaatgactgagttttctttgatggcatttgttcaacatcacgcaaagcataatcctggagtccagtagaagaagtagtatctagcctgtcatttaacccacaatgcataattggtatatccaccatataaacacattaacacatacccaaatataacacacagatatgcaaaagcaaacacatacaatgtaagaaataaacatgtaaacacacacacaactgtagacacatatgagtcaaacacctgtaaacaaaatttcttgatctaaattcagtgaagctttccatgttgtttagactgtcctggaagataacactgaaaggcaccaacagcttctgcttaagggatgagatgtggattctttaccctaataggtagttcttttcctttttctttccttagaattggctgttttgaccaatcaaactcttggcttggttttgtgttgaaatgatcatagctcaaccttagaccaggctgttctgatatgcccttactttatcaaattgttagctaaggattattatagagattcttttaaggagaagtgtttgcattgggcatgtgctgcgggtatgctgggaaataagtatattctgggctctgctttgagaagcaaaaggtgatcataggtggggaaaaatcaaaggaggaacattctataatcctttttatttttttgatccttgaactccttgaaactgggataaatgttctaagggcagttcccctgatagtacaaaattaccataactgatctcacaaaggaagataaataagaaaacacatttgtttcaagggagccagggagaaggtatctttttaccttctttctctctctagcctgttgtattctccccctgttctagctgtttcttgctggaaacaatctcaaaaaggctttctctatccagtatggaatgatttatcttagtcttggaattctgggataaaatgtgcatatatgcatacatgtgtacacacacacatacgcacatacacacatgggacctaaagtttcaggaaaggtttttattttattttttaaatgaaaagcaatgtgacactactttcaaactggtttataagaggcacatcaatccagttgtgaactgagaactttttaagggaaggagaaattgttcccgttaagccctaaaacagtattctttcccattgatcatctaaaccaatttgctttatattgaatagctgtattaggaaaaaaaagtcagctgttgataccctccaatgtcagctagatggatttttttccctcaacataaggtgcagttgtagttttcctcaatctcataattaaaaaaaggtgataagctatttgttctgaatcaattcacttagattttaaggagcataatggaacgtctgttgttcctgaaataaacagcacaatctcgagtactcagacagcttgcctaaggtggtaggaatactatgtttttgtcctaccaaggttctttacccggggctccctgacccagaagacctgtgcataaaattcagggctgtgtgacttggatggggaaaatgtgcatatcagttttaactaatttccacctcaaatgcagcgtttcagttaattatgaatataagcaaaattgacagcaatattaatgactttgcacctatggtaaccacagatagtttatgttagattacagacttcttttgtaaaatcggatatagtctatttcacatgcatttagaaacatcattttaagaagggggtccttgggcttcctcagactgcaaaagtcaccatgaccctgtaagtgttaagaccccttctccaggagacctgggtcattagtaaaggtcatgatccagcacaggctgtgaaggtgcatggcatcccatcaccaggaaactctttttttgtcgggggccttgaaccttctcactcatccagcaaaatgctcactctaatgccccagggtggaatctgtcattactgtatgtatttaagcttcttcagattagcggcagaggtgaaggagaaagaggaaaaagagatcacataccactcctccatctcttcacatattttaatttaaatatggaatcatactctatgtcagtattttgtaaacttttcttttctgtttttgaaacagggtcttgctctgttgcccaagctggagtgcagtggtgcaatcatagctcacagcaacctctctctcccaggttcaaggggtcctcttacctcagcctcccaagtagctgggacaacagacgtgtgccatcacatccagctaatatttgtatgattatgattatgatttctttatagagatggggactcatcaggctggtctcaaactcctgggctcaagtgatcctcccacctaggcctcccaaagtgttgggattagaggagtgagccaccacgcccagcctgaaatctttttcttcctaattttttaattttttgagacagagtctccctctgttgcccaggctggagtgcagtggtgtgatcttgactcactgcaacctccacctcctgggttcaagccattctcctgcctcagcctcccgaatagctgggattacagttacgcaccactatgcctggctaatttttatatttttactagagacagggtttcaccatgttggccaggatggtctcaaactcctgacttcaagtgatctgcccacctcagcctcccaaagtgttgggattataggtgtgagccactgtgcccagcctgtaatctttttcttcttaatattttgatagcacaccttgatggagctctttctgtgtcccaagcaacattctaagcgcttggcctgtgttatctcatttccttctcacaaccactcttggcagggggtactcttctgacctctcataaatgttggctaaatgaataatagctgtctcttattgaagacttaccatgtgccaggagctattctcagagttctgtacatggtctcatctattcttccccaaagcccacagctaggttttattatttttacattttatagataagggaactgaggcacagagagattaagcaccttgcccaagatcacacagctggtaggtcaccagtagaaacctctggatatcagtggagacagtctgactgcagagaggtgttgttaaccagcaggcagtcccaccctctatgatgaacttttgtcatggtgattgtttgagcatgctttagtttgtaaggttgccacatcattcctggaataggagatagctttttctttcgcatagatggatactgaaatcactctatatcagtattttgaaaaattttggtgactctaccctcaccatagcatcatttcttgagaaaaagaagagaaataaacgaagcagcagcacgagcagtttctcttcctactggtctgtaatctggccacgactttaggctgtggctgaaattcctgaccttaaattccagcagcctctgattgagggcacccactcagtcaagctcccttcttggaaacagtcaaacgccatctagtgactgaatgcagaatcgcatactcctttcagccaggaagggagaccatggagggggagccaggctgggtcaggaagaggaaaccctctctgggctggtaaagttgaaagcaaggaaatcactgagccccgaggaactgcaccagcatctggataaaaacccttcagtcttcactgtgaacacatctggttagttgatgaaactgttttcacagtacatctggctggatagatacaaccacacagccaccaccacaggctcgtattaactgagcagtttcttcccagcaaaactaactgcctggaaaaaaaacgcatgaacaaaacatatttgtaatttgtcaaatctaaataataccaatagctcagcgatttgctcttttgatcaagactgttttatgctaggaagtgtgctaagtgttttacatacagtgtctcgtctgctctttttttcttaacagctctgagagctagagattaaattattcctgtgatcaaactggagctcaggaaagctaagacattgtccaggttcccacagatggtgtgtgacagagctgggagctgaatgcagatcttgctgactccaaagctcagactccaaagctctgactccaaagcgcacgcaccacacacacacacacacacacacacacacatttaaagatgcagaatctcattatttagctaagctaccctccgtgcagcaaatatatcatcacagtgaaagtctagtgatagtactataaagacaaattatatgtaggcaggaaagagaaggctaatatccattattatcgttacagtggatttttggaggatttgacttttatcaaaaatattgttttaaatcaacaaataccaggaaattgaatccaacagcatattaaaaggatgatatgtcataaccaagtgggatttattctaggaatgcaagggtggttcaacataagaaaatcaatcaatctaatatgtcacattaataaaataaacaaaaaatatataatcatctcaattgatataaaaaagggcatttgaagaaatacaacaccctttcaggataaaaatactcagaaaagatagaatagaagggaacttcctcaacatgataaaggacatttattttaaaaaacccacagctgacattgcacctaaaggtgaaagactaaaagctttccccctaagatcaggaacaagacaagaatgcctcctttcaccaatggtattcaacactgcactggaaattctatccagcgtaattaaacaagaaaaagaaataaaaggcatctaaattggaaagtaagaagtagaactatctctgttcacagacggcatgatcctatatatagaaaatcccaaagaatctataaaaaagccattagagctaatgaacaattcagcaaagttgcaagttacaagataaacatacaaaacccagttatgtttctacacacctgtaatgaacaatccaaaaaggaaattaagggagcaatctcatttacaacagcatctaaaagaataaaatgcctggcaacaaatttatccaaggaagtaaaggacttgtacactgaaaactcaaaacattgcagaaataaattaaagaagacttaaataaatggaagaacatccagtgttcatggattggaagatgcaatattgttaaactgtcaatacactgaaagtaatctacagattgaatgcaatgcctattaaaattgcaatggcctctttttttctgtggaaatggaaaagctagtcctcaaatccacatgggattacaagagaccctgagtaactaaaacaatcttaaaaaaagacgaaaaaagttgaagaactcacactttcctgtttcaaaacttactacaaatctgtagtaatcaaaacagcatgatactgacataaggataaacatatagaaaagtggaataaaaatgagagtccagatatatacatatatttctattatttatatatatctcatatatatgtatctcctatatatatatctcctatatatatatctcctatatatatctcctatatatatatctcctatatatctctcctatatatatctcctatatatatatctctcctatatatatctcctatatatatatctcctatatatatatctcctatatatatctcctatatatatatctcctatatatatctcctatatatatatctcctatatatatatctcctatatgtatatctcctatatatatgtctcctatatatatatatatatatatctccaattgatttttggcaagtgtgctaagtttgttcagtcattcagtggaggaaaaaatagtctcagttggtgagggaacaactgaatttccacatgcacaaaaatgaatttggatccctacctcacaccatatgaagaatgaactcaaaatagatcagtgacctagattcaaaagctaaaatcataaaactcttggaagaaaacagaggtaaatctttatgattttggatttggcaatggattcttagacatgataccaaaagcactagcaaaaaaaaaggaaaaataaagataaatgtgtatatgtgtgcatgcatgtgtttgtgggtgtgtttgcttagtccagaattagggtagtagtaacaatgaggacaataacttcttagagcaccttcattcaggagttgaatcacagttcagttatcagacaatgccaggaagagctatacatttcttttggtatattgacatcttaatattattaagtcttccagcccatgaatacaggatgtttttccatttatttaggatactgaaacaggaaagaagaacagagctattcgtgatcatacagctaacaaatggaaaaatgacaattggaaatcaggtttttaaactcaaagttcatttctctctcccaaggagtgctaggacaattactcatttgtaatttgtgacaattcaggcaagggctgatctctagtttcccctgctcttgggaaaattttctcaaagatgctgtgaacacagtggggaaaaggttgcaaagagaatgcttaaactgcttataaccaaattgcttttaagcagcactttagtagaatccatttatataataagaatgaatatgctaactgtgagccatttttgtgtatccttgagggatctctacaggacaagcctcatttgaattattctcttcctttagtaaacatccagtacctgggatttactgatttttggcactgagtctgaattgctgagatttattttttttgtaaagatgaaattattaaagtagaatgaggatggaactatcatttactgaacacctagtaggtgttaggatgcatccttaccatccttgagtcctctaagctccaggaaaagaagcctttgtaccaggcaaagaagcctttgttctcagctcatacctaacataaaggaggattcacctcttcagaagattaccctccactgaagacacacaaattccccaatgtaataataagaaatggatattgtactgcaatcttatggtactgaagggaggttttacatcacacaccacgcaacataaacatctcctttaaaacttcttgtttttaatcctcaaatcttttctttttgccagtggcttcattattcactctcctcttacccaaaagagcatcacaaagaaatgtttcctattggcctgagcaattcaatggtggtgcccctagattgtaaacaaccctcaggagaggaaaaagtccggttgttaattaaacagatgatcaaaattgtttttgtagggtgtgtatgcatgtgcatgtgcctgtatgtgtgtgctgggtggttctcatttcatctgggttcacttttgttaccttctttgctctttaaaacaaccccaagagatcatttagtcccattttgtagaagaaaagattgctgcacagaatgatttggtaccacgtctaaggttgcacagtttgtcagtaggggaagccacagtgccatacagacctgattctagtattcatgatgccagaaactggtcccagaaatgaaaggctgtggctttctcgattttcatagcagtgggtaaattcttctttctaccacaatggaccttcttcaacgggccctgagtaagtggtggccaactatgtattagggtattcaagaaatgtatagtctaaagcaggacttagcaaactacaactagtgtgccagacccagcatgccacaggtaaataaagtttcactggctcacattaggcccataactttagatagtgtctctggctgctcttgcactataagggcagtgttgagtagctgcaacagtgatccaatggcctcaaagcctacagtgttttactatctagaccttagtgaaagaaggatgccaatccttggtctagagagtcaactgacagataagttggaaattgaaaatcagagcttaagtaggtggtaggggagcacaggaaccatgtaattgccaacaggtagactttgtttaaaaaccactcacagtaatcagcatccttccatctcccaattctccatattgttattaggaccttgaaaataaccaattaataaatcactatatattaattacttgctgtatgccatgctctgtcatatgtgctgtggatagagctatgagcaaaacaaaataaaaaatgagtgtggaatataggaggaacagaaagaaggctattaattgcttaattgatgttactgagagcctggagctcaataccagatgagactgcgagggagggaggcaggggccaggatgtggaagactgtgggattttattccaggtaaaacggtaagccactgagaaattctaggcaaagtggaggttgtcattatcatatttaatatgatcactctaactgctctatgaagattgaataattggaaggtgaggatgggagcatggagaataaggaggaggttactgcagttatttaggcaagacgtggaagtagcttgactagcctgataacagcagagacagagagaactgtttagatttagaatatgtttagggttagagctaagaggactcatggatcatgaggatgcatcttaaaaaagaagctcaaagcttgcttccaaaagaaccaaggagaacgtcgcaaattgtaagatttattatgattctcacctgcccacacaggcagggctgaggcagcttgcagtgcccacccaggtcctctggtgtagaggcagccatttttgctctggacagacttgtcctggggcctgtgcaccaccgctgcagaaacgggcagatgcagcctcaaaataaatgaatctccttgtgccaggtagctggcctcctcataaaaggatggattggactggttagagagatctcgacacttgtgttgcagatccattaacgtcagccacacgttaattctgagcaatttccaggtgatccaataattcattaaactgacaaaaacaaatctttggaaaaccaagctggtgacagatagaaagccaatgatttattgtctggagaggaataagtgtcttcctttccattcttcagtctgttgagtggatcgaagtgtgcagtaagaacaaggtaggtgtgagttctacttaatgggcattgttcaggcccaatgtggcattcatgtcacactgcttgcttcataaagtatttgggggaaggaagtataatgtagcaggaagacctggacactgaggttgggtaaaactgagtttgacttcctcctctgccagttattagcttctgtgaccttgggaaagtcactccacctttctgagcctccactggttcatctcttcaactggggtaataatatattttctcctgtactcatgtctgcatataataaatgaatatgatgaagtacagtgcctagaacattataggatactcaatgaatagctaacgttattgttatttgtgataacaaagaagatgggtgagctttttttcctttggtgtgtatattagttcattctcacagtgctataaagacatacctgagactgggtaatttacaaagaaaagatatttaattagctcatgattctgcaaggtgtacaggcttctggttctaaggaggcctcaggaaacttataatcatggcagacagtaaagggaagtaggcacatattcacatggccggcagaagagagagagagaaaggggaagtgctacacactttcaaacaacagatctcgtgagaactccgtcatgagacagcactagagggatgatgctaagccattagaaaccacccccatgatacaatcacctcccaccaggccccacctccaacactgtgaatcacaattcaacatgagatttgggtggggacacaaagccaaaccatatcaatgtacatacatcaatgtgagcctacaacaaggcattgtctgtattcatactgatgctgcaagaatgttatagaatacttgcctagacatgcaaagagaggagacatccaagacagcactttttttccaaggcagagtctgagaaaaaatgggaaatcagaagactaagaatatgagtgataggatttggggggtgctggtgaataggaataaaagggccctaggcttaaatagaagaattaaaggaggacagcttgggaacttacttccaagcagcagcggagaggatgagtcatgtgaagaacagaataatacttagaaaatgatgctgcaattggtttgaagtctggatggagaaggtgacttctgaacttagacctgcaatatgtcaggtgtggaggagacctcagacaccaaatggaagaactgattttctttaaactcttgtacttttggctgttcactatccttttcatcatctggtaatagcatttctgtattccctaagggcccacccctcaaaggtgcatacgtatctcattttctgtatcctttcagcttttatttatgggagctctatcacagctatagcaattctggacagaaattgtgattttctcagctgaaaatacctaaaagccacaaagatgcctgaaagggatgaattaccatggattactgttctcataaatagattcctggtctaactaaatgcatttaggggagtatctgttggaaatccattagacaaggcttagttggagcccatggaccctaagaacctccaagaggaactttgaactttggcacccccaaagtgtgtatgagaagcctttaacttggcctgtcttctaaagattgaaaatgagtttgaaatcataggaggcctgggaatgcttaaagtataacttgcccaccattggaggtatgctcccaagtattcaccagttctttctgtaagagaatcatacaactctccactattgtaatggggcttgggctgctttctgaggggggagtagactttttgacccactgatgtcaggtttgtccctgtgacttgttttagccaatggcatatgagtcaatgtactgcaaaccaagttcaagcagaagttttataattgtatgtttttatcagccctctttctctttccctctgacccatgaatgccatgtctttgatagaggaagttgcttcaatctggatcctggaatcagaagatgtatggagcagaactgcagctgagctgtgactaccagcataggataaagagagaaaaaaacctaagttgttgtaagctgctgaaattttggggatgcttgttacacagtgtcatctagcaaaaactaactgacataggaagtgagagcagccactaactcaaaagctggtcattaaacattataacagcagccagagatttttttgaatgctaactcttccaacttaatcccgtgatatattagccctgctctttccgctgattcaagagtttgacggctcaatggatctgatctttgcagtctaagtgcatgtgaagagtgtgtgtgtgtgtctgttgtgtgtgcatgtgtgaagcttctcacgttgtgcccaagtcagaaggacacatgttcctgcttaaagcttggatgactccatctttaagagttgtgcttcccaaagtaattatacgtagtcagatgttcatcattcaggggctgattattccacctctttctttctcagtatggatttgaatcatctcatgtacatcacagctgaagacaatagtgactgcaagaaactaaaggcaaagcccaaagtcactcacttgcctattgactagtcactgtcagaagggaacaacaattacatgccaagcactgtctaggtgctgaacatacatgattgaatgtaatttttatggcaattcataagtatcattgttcccattttacagatgatgaaactgaggctcagagatattaagcctcttgcccagaatcatataacttgcaggtagagttggaatagagcataaggtatttgtctatgtttttcctgactttagtcaatacaaaaaaacttaatttaaatggtagataatgtcaaataagatgaaaacaacatctatataccatttagaagtatttgggctgaggagttcctgtataataatgtgatagaaaaatggaagctaagaggcaaactcacagtcttgagatcacagagagaaagaacaagaaaaaccaacactgaggaccagcccttttgtccactgtgcctaaataggctccctggaagatcttgcagaatgtggtagcaatggagggtgagaagactctatttctattttaggagatttctcctttcgctcaaagtaaaaaagcaacagcttttgtttaaacccctaaacaaactgtttattctcttacctcatgcaaggagaaactgagaaatgcatgacggtgcactttgagtggtaatattgtcctcagcccatgttattagtgatgcaatggaggtacttaccactgacatacatttgtgataatttataagactggttagctcacacattgcatttgaactcttgcctgtctagagagtttcttgaatataaagcaatcacctaacttgaagccaaagtaagagtgaaagaaatcccagaatagtctaggtttggcaagtgctgatggattacttagttctgtggttctcaacaagggggaattttgcacccacaaggcaatgtctggagacatttatgtttattacaactgggtggagcggggaaagtcactactggcagctagtgggtagaggccagggatgccgctgaacaccctacaatggacaggacagccctcctcgacagaaaattgtctgctccaaaatgtcggtagtgctgaggttgagaaatccagactacctcaatgctcctgctttgaccaacatccagaggcaaaaagtggcttactcaatatcacacagcaagttagtgcaagatctgggcagcagaataatctgcaattgttagaagcacaggctctggaatctgaatgttcggctctggaatctgaatgtttggctttggaatatgaatgtttggctccaaatcttgggtttgattcttactaactgaggaaccttgagcaagtcacttaggctgtctgagcctcaggtagctcatccagaaaatagggagaataatggcacccatcacaaggtctttgaagaggatccaatgagataaagcacataaaggacttggcatagagtgtatgtacagtatgttttccatttatcattagaattctgtactttcttagcaggattcaggtaagaaattaattttaatttcactaatataggaaaagaaatttctaattaaacattgtcagctttttctatgtcctgttagaggagaaatctctgaatcactaaagaccaattcaatgatctctttagtctcatgaatgtaatccaaggaggcgccactaggtatgaagaaagggtgcatgcagcagaacacaaacatttttctcctttagtttgataagctcaacactgctatgcactattataaagtgatagagggtgtagtacgctgattaatgacccttctttgatctcatccccaaagatatccaagttctaatccgtagatccagtgactgttctcttatatggaaaaggggactttgaagctgtgattaagttaaggatccagagagagagagagagagagagagagagagagattatcttgaattatctgggttggctctaaacgttatcacaaggatccttgtaagaggaagccaagatggtcagaggaggaacaaggtgaagtgaccatggaagcaggggggggaatggtgatgtgatgtgtagccatgagccaaggattgaggatagcttctagcagctggagagggcagggaggcagatcttcccctagagcttccagaaggagccagacctaccaataccttgactttagattcatttgggacttctgaccttcagaacagtaagagaagaggtttgcttgaagccaccacatttgcagtaagtttttaatttgttaacagcagcaataggtaactattacagagggttattcattgcggggaatggagggcacatttacacagggggctgagtccctttctggggagaaaggaattgagatgctgaccccattcattgttgaggttcaaggttatccgatatctctgctgactcatgtggctgtgactgaggtcagccggcagcacaaaccatgagggacaaaagagggggactcaccgcagtggaagagacagctggacttgggacacaagaggagactaaggcttaggttgtcctgggagggaggctggtcctggagagtgtgaggccatggttgagacctttctagaaacatgactccagatgcaagttaggaaccatggcctgttatgatgaaaaatctggaacagacattgtcttaagatggggagagatgaccataagtgacagacctgagaaaccacagcatcagttttgggtcaatgcacagtggaagtacagggtgctgttgtgatggacagatttgaaccgcagcatcctgggggcagcgttatagtgagagggagagaaaacagaagcaccaaggattttagcaagttatcaggctaaactgaggaaaacagcaccccctcctgctacaaccatagatggacatgacattgtaaacccatcaaaatacccagcaagggctggatgtggtggctcacatctgtaatcccagcattttgggaggctgagatgggtggatcacctaaggtcaggagtttgagaccagcctgaccaacctggtgaaaccctgcctctactaaatataaaaaattagccaggggtggtggtacatgcctgtaatcccagctacttgggagactgaggcaggagaatggcttgaactcaggaagcagaggttgcagtgagccaaactcgtgccatggcactccagcctgggcaacaagagcaaaactctgtctcaaaaaacaaaacaaaaaaaaccagaaaagcctgaaagtcagtgaaggaactcctcaggggccagagatgacagccaggctgtagtggtggtatgtaagtttcagagatctgattatgggccaggagactgcagtatggggttcaaacacagaaatgggaagtgaattcaggctcgcaaaaggcagagaactggggcaactctccctaaaatctagagcagtggctctccttaggttagtactgtcagaggcatttgaaccagagtgaccccatcttgaataagggctgggtaaaataagactgagacttactgggttgcatgaccaggaagttaggcattcttagtcacagggtgagatggaagatctgcgcaagatacaggtcacaaaagccccgttgacaaaacaagatgcagtaaagaagccagcctaaagccaccaaaaccaaggtggtgatgaaagtgacatttgggcatcctccctgctcattatatgctaattcgaatgcattagcatgctaagagacactcccaccagtgccacgacagcttacagacgtcatggcaatgtccagaagttaccctatgtggtctaaaaaagggaggaaccctcagttctgggaactccgcacccctttcccagaagacacatgaataatctactccttgtttagcacataatcaagagagaactgtcagtatactcagtcacgcagcccataccactgctctgcctatgaagtagccattcttttgtttctttacttttctaataaacttgctttcactttactctgtggactcccactgaattctttcttgcgtgagatccaagaactctctcttggggtcttgactgggagccctttccattaacagtactgcctcctagggggacatttggggaggtgggggtgggcgtgttttttatgtttctgttatgatggcaggaggcaccagtagcatttagttggtaggagccaggataccagacatctggtaatgcccagggcagtctgactcaaacaaaaaactcctgccagcctgtgcagagttcaaatgcccgctgagaatttgcataggcaaaaaaatccattcattactctaagcctattgctatctaggtgaactcttctacacataaacgtaagactttttttttttcacttttaatacacactaaaattttcagaaatttcaatacgatgaaaatcaaggcaagctggtactttatatgtttgggaccacaggaagagtggttcactatcttggaaaatcacgttacccatggcaacaccggtcctggtgtttgcatcaccctatctgcccccatttccgcctgtgttcgtagttgtcacagctgtggtgattctacactcaggttcatgcattttattattccattaagtctcattgtgcctcagcagttactcgccctgatgccctgataccgcgtatgtgagttaggaaccatgggtctctggtggatgaaaaatacatatgataataaattagttttcaatttttaatataacatggcatttttaaatagttacgagtaggttctattagctgtgattttcatttcaaaacagtaaggaagatattacaaattgtttactagaaaaacagccattggatcaggtcagattgaaagtcattggcctggcatctccaagagctgtcccatccattgcagaggaaagggaaagattctgccagccagcctgggggaactgcaaggaggctgtctgtctattgtctgtctgagtcctctggatgcaagagaagaaaaatgtcacctgtgaataaatcaacccctgatcactggtggcctctgcagggtagaggttccacagtctgggaaatgaacacagccactgttgaatgaagtcaaaaagtcacggtcagcaagctgggaacagagagaggcaggtagacttggtaaccacagagcttagtgaccctccatggggctgtcagcgtgctggaagagttggagaggcagggagctctctcatagaaacttcttggcagccctgtagtcatccaacagagaatttcaaaagctcaggggaaaggcacagaaatcagtaattcatgataacccaaccctgggatgcaaaagaagttgtagttataaattcacttcctagtaagggggcaggttgcgaggttcactaatcctcatttgcttcatctgcagaagaggcaaaagaacatcaactttgtcaagaccggagactcttgactggaggagactttcccaaggacattctgtcatgtctggagatattgttgattactgcggagatgggggtggaggggttgctactgacatctggagaggagaggccagggatgtcgctgaacaccctacaatgcacaggacagacccacaataaagaattctttgtttcccaaatgtcaggagggctgacattgagaaagcctggaggaaagaacaaaggtcatgaaatgatgcttaaaaagagctggcatgactcctggctccttatgggggctcaggaaatatgactgccctgctggagtctaagcatccacgggtgttgctattttcagacctggaagtaagggaacaccgtcaccattgattgcattaattgctacagatatcatcaccattgtccttgttgtgattattactaatggctggtatttactgagaccttgcttagtgaggtcctgttctctgtgcttttcatgttgtgattcacaactctgtgaggtatatgaggtagttcttattattacctttattttgcatagaaggtagttgagtgcctatataagaggagctgaccacaggcagtacactcgtatgtcaaccattttcacagggtcttttatttgtaatcaatcaattaattaattttccattagtgagtatagttgacaaatacaattgtataagtttaggtgtttggtacaatgatttgatatacattgtgaaatgattatcacaattaagatagttaacacagctgtcacctcacttacatttttttctttggcaagaacatttaagatctaccccttaagcaaatttcaagcatacgatacggtgttgttaactatagtcaccatgctgtacatgaaatccccagaacttattcatctttccactaaaactttgtaccctttgaccaacatctccctgttttcttctcccccgattcctgccaaccactcttctactctcggtttctgagtttggctatttttgatcccacatgtaactgagatcatacagtatttatctttctctgacttatttcacttagcataatgccctcaagtttcatccatgttgttgcaaatggcagaatttccttcttttttttatggctgagtaacacccactgacgggcactgaggctgtttgtatgtcttgactattgtggataatgctgcagagaacatgggagtacagatagctccatcagcgatggattttgtttcctttgagtaaattcccagtagttggatttctggatcatatggttatttttaatttttgagaaacctccattttccataatgactctaccaatttacattcccaccaacagtacccaagggttcccttttctccacatcctcaccaactcttgctatttttttttttttttttttgataatagctattctaacaggtgtaagatgacatctcattgccgtattgatttgtagttccttggtgattagagatgttgggcaccttttccatgtatctgttgaccagttgtatgttttctttggaaaaagtctctaaaaacccttgactcattttttaattggatttgtgtttgtccggttttggttttcaccattcagttgtatgaattccttatatatttcagaaatttaccccttaccagatatatggtttgcaaatattttctcccattccataaattatcttttaattttattgattgtttcttccgctgtgcagaagatttttagtttgatgtagccctacttgtttttgtttttgttgcttgtgcttttagcgttacatccaaaacatcattgccaagatcagtgtcaagaaggctttcccctatgttttctttcagaagttttacagcttatggttttaagtatttaatccatttagagttaatttttgtgagtgatggaagatagggtacttagttttgttctttttttcatagggatcttctgtttttgcaacaccatttattgaagaaaactatctttcctagttgtgtatttttggcagattcgtccaatattaatcgactatttatgcataggtttattactggactcttgtttttcttttcttttgttttttttttgagacagagtcttgctctgtgaccaggctggagtgcagtggcatgatctcggcttactgcaaactctgcctcctgggttcaagcgattcttgtccctcagcctcctgagtagctgggattacaggcatgcgccaccatacccagctaatttttgtatttttagtagagacagcatttcaccatgttggccagggtggtctcaatctcccgatctcgtgatccgcccacctcagccttccaaagtgctgggattacaggagtgagccactgcgcccggtcctgggctcttgtttccattccattggtctctaggtctgtttttatgccagcaccatactgttttgcttactgtagttaggtaatatatgttgaaatcaggaagtggatgcttccaactttgttcttctttctcaagatttctttggctattcagagttgtctgtggctccaaacaaattttaagatttttttttaaaaattacatgaaaagatgctattggaatattgctaggatttcattgactctataaattactttgggtaatatgaacattttaataatattaattcttctgttccgtgaacacaagatatcattccatttatttgtgtcttcttcaatttctttcatctatgtcttatagttttcagcatacagatgttttaccttcttggttaaatttatccctaagtattgtattgtttttgatgctattgtaaataggattgttttatttctttttcagggagttcactgttagtctctagaaatgcaactgatttttgtatgttgatttcatatcttgcaacttgacagaatttcttgttgttgacaaactgagattctagattgcctgtcttaaacttctttagtttctctagaatgtctagcacataactggaaaatagaaaaggagagaaactaaacatttatttggttccaagcacatatttgtgtatatacatatatttgtttccagttgattctcattatttgcagatactgtattggtgattttgcctattcacaaaaatttattcataatcccaaaatcagtacctgctgtgcttttgcagtcattcccaggcatgtgcagagttgcaaaaaagttgagttacccattgtgtttatcccacctgagacccaacaaggccagaatctgctttctcggttctactctcatactataaatgagtatgcatcttgaagtttacttagcgctatgcttttcatacttttgtgccttttgctggtggtttttgctgtttaaaatggtccccaagcctagtgttaaagggctatctagagttcctaagctcaaaaattctgaatgaatgagagtttgcatagataacagtaatgttaactccttcaagaccaaggtttctcaaggtttctttgtttggtaccatgtcaaacaaagatgcaaagtgttgcactttgtgatgtggtttatggagaaaaatatatatttgttagataagcttcgttcaggcatgaggtatagtgctgttggttgtgcattcaatgttaatgaatcaatatatattaaataaggtgtctttacacagaaatatataaaacaaagttatgtattgatcagttgatggaaatgtcatgactggaggctcaaaagaaccaaacctatatttccccccaggagtaatggttcagtatttaataacttagtggttgtggagacattattgaacctaatcatagcaaataataagaatatacacacagaaacacacaccacacacacacacacacacacacacacacacacacacacacacttttttgatctcattttgtatttccagccacctgtaaggtaggtactattatggccacttgacagatgaggacactgagggtctgggaagccaggcagtttgccaatgatcacaaagacccagaaaccaaacccagtttagccagaattaatcttccatgctctttctagagaatgtcaactttttttcttttcttttcttttttttttttttttttttgagacagggtctcactctgtccccaaggctggaatgcagtggcaggatcatggctcactgcagcctcaacttcccaaggctcaggtgatcctcctgcctcagcctcccaagtagctgggaccacagccatgtgccacgatactaggctaattttttaattttttttttttttttttttttttttacagatgggttctcactatgttgcccaggttggtctcaacctcctgggttcaagcatttcacccacctcggcctcccaaagtgctggcattacaggtgtgagccaccatgcccagcccagaatttcaatatttgatgattgaatcaagtcatgttaaacatgcaaaagtacttgcatttttaattagttttttttttcttgtttccttctcttcccaactcaggaagaggtagagtccagggtggatcagcacaagcaaaagacacttccaaggactgtttctaaaacccactttactacatcccaaaacaggacaaatctcatgctagcgactttggggaagcaagtataagtttaaatacacctttctaacctaaaagacagtgaatcttaaatcactacaatatccacattttaacctttttattgatttctttgttttagtctgtaagacagtttttttcttattttttaggttagctagactcttttataatcttttagtttgtgattttaatgtttttgtttgctttgttttgagaactgaatgacttcttacactgtcttttttatcttcatctgttcggatcataaaaatggtctataagcctagatcctccagtgagaagaagctccatctaaagatgctggatctgtgcactgccacaggaaacattataaagatcaggtcatgtgatccacaagtcagctgtgaacactcttctgttctcttaaaatcgactcaagcccccagtttcatactcagctggaaaatttaatctctgctccaacatttctgctgatttcagcatcttatattcttacaattacctctaattctaatttattgttaatttcgccaaaacttcactctggggatgccaacagagatatggatgtcagaaactttttttcaattttctgagtccagaatttacaaaaggcatttacttaggtatgaaacagtcttaaaggaagatttgaggtgatgaacgacttctacccagcccacaacttgaaaattgatttttaggcacacgtgatcttaaaaatccttcagctatttctatttatgatttttttttaattgaccattcctgccccttttgcaggatgctttcctatgacttttccctattcctctccctatttctcccaagccaaattttctggggtacatccctggtcactaattctttgtattattttccttacattttggaagcttattattaaggtatttttcttaaaaaaagaaaaaccagaatcacctaagaagtatttttatcctagctataaaaataacattttcacctcttttctacggagtggaagctccttagaagagaggattcgaatgagtttaccagggatttaaagaatcaagactacggaggtgaggccaaaaataccagcatatgaatagcaattgtactttgcatctttgtctttatttgacaagatgccaaagaaaccttgagaaacctcagtctagaaagagttagcattactctgatctatgcacactctcattcattcatgcatgctttaagcaaatagttgttgaggtcaaactgttgtcaaacactcttttaggtgttggaaatagagtagcaaacaagagggacactttctcactggctgtttacttttgtaaggagaatgtaactcactcaatttctagtctcaaatgctgtcactttcaaacaaagatggccaaaatcaacagaaaatgtgatggtgtgcattaaccagcccatttttgctgtgtgagttctcaccatttcctgggcacatggaacagattctagttgagaaaacattccccttcattccgaatagaaatattaactctaataattactaatacttatgtagtgtttgctttatgagtgttttacattatttcactgcattatttaactcacttagtcttcaccacaagccaaagaggcaggcattatttttaccccattttatggatgagaaaactgaggcagagaagtcacccaagatagttacaaaccaagacaatttggctccagaatttatgtccttaactgccatgctattcagcctctctatgattttcacaaatagcaatgccaggtgactgctgcgttcagtgatccaacacagaattatcagagcaccaacgtcatgggttaaaatcttgcaaaatcctgttcacaaaagcaaagacttggaaccaacacaaatgcccatcaatgataggctggataaagaaaatgtggcacatatacaccttggaatactatgcagccataaaaaaggatgagttcatgtcctttgcaaggacatggatgagcctggaaaccatcattctcagcaaactaacataagaacagaaaaccaaacaccgcatgttctcactcataagtgggagttgaacaatgagaacacatggacacagcgaggggaacatcgcatacaggggcctgtcaaggggtggggggctaggggagggatagcattaggaaaaatacctaatgtaggtgacgggttgatgggtgcagcaaaccaccatggcatgtgtatacctacgtaacaaacctgcacgttctgcacatgtatcccagaacttaaagtataataaaaaaatttaaaaaaaatcttgcaaaatccttcaagtgtcagcctgaacaccactttcagagagcagtcttgtccagctctcatgcttggatcattcctgttatcacacattctcacttcatcacatgctccttggtgacctgtactgtaatcaataagtaattatttgtgtaattacttcatctctgtctcctcagctaaaatgcaatctccatgagaacagggatcatgtccctcttgttagccaccctatctccaatacctacaagagtgtttgacacatggtttggcctcaacaactatttgaatgaatgaatggatgcaaacatgaatgaatgagagtatgcatagatcagagtaatgctaactccttccagaccagggtttctcaacctggacgctattgacatttcaggccagagaattttttgttgtgagagctgttgtgtacactgtagaatgtttagcagtgtcccagcctctacccacaaccccagttgtcacaacccaaactgtccccaacatgcatgactttctgattgaatgagagggtgacagatgaacacaatgatatctcttattctagggaaacagagaatacagcatttttgaaggctgaattttactaataagaccagcttattataaaaatgtacttttgcaaatcacgttctttgggaacaaatataggaaggaaggttttatttaagaacgtagatgtcttatttaataatgacagctatcattgtgaagtacatattataagcctgtgttatgctaagtgttctatatcattatcatttagttcttataacaacttggtgggtcacagaggcccagagaacttagtaacttgaccagtattccatgaatggtaaataggagaactgagattggaacctaggtgggtctagcggatggcaaagcctttgctgtcagccaccacgctaagagtcccttagtgatcttaaagtcttgtttttgcaaacatttctgtatatgctctaaacccccatctatatttatgagaagccatctggaagacaaataggggtgcctccaggtgtcccaggacctgacacttgcagatatgtgctgaataactgaatgattagaaaggtctttcccactccaagtttattaaaattaagttcccattatttatgaaaggatatgtctatttcttatctaattcttgtccacatctaaacaaagaagtttcaccaagtcttcagtcactagagcttctgtagactcatgccttccacacttgccctttaacccaaaaccacttgttaaaatatttctcctaaaaaaaagatagtcccctccctacgaaggcaaattcatagtaaaattcccacctcatatatatacattctttaattaggtagggaatattttccctattttaccaatggggaaaaaatggagctgcacttattagtaaagggatggtccagaatgtttcctaaagcccattaatagatgcatattttttttcagtaaatccttttctgtatttctaatggagactatgaaaatgagatatgaagtctttccctagcaattcaggcaggatgatgccttccgactctttttgtttccttttgggtcatgtctgatgctctgaaattctctacctgcctgactgttgcttcaagacagtgggtgtgagccaaacaaatctatccaaccatttgttacatcccaaaatggtaccagtgagatagaaggccccaggtgatggggccccagatgcagatctgaatattctattctaagaagagcagtggaatagatggcccctatgaggtttttgatggaaaccctgaaaaaacaaatcaaaatataatagctcctgctgtcggtcccctccccctccccccaaaccctagcctggaactgggaggatttgagtgggccacaagaaaacagatggtgtcaccagaagaaaggaacttgttgtctgagagcggcctttcgaggcgtaatatgttctttgagggacgtgtttctcttgtgatggaatcaacgcaggcagaacatgctctctaaagagatcttctctctgagtccaatacttctcaaagaaagaaaaccgtaaaagaatacaaaggcagtgtcaattttctgctctccagctgcaaaaacttgcacttgaatgcgacccaaggatagttttcggaacttgtgcagtgtggctgagtactttttataggttgcaagaatctgtgatatgtttgatacctgtttggatactggcgccccttttggacaacagggtcattggagggagaggctctggcttgctcattttagaatccaagttacactgagcacaagatcgggcaaatacgacgtgcttaaaagggagaaagggtgaaggcagggagagacgccaggtttgtggaatcagtatagaagacagccgcatcaccacccgcttcattgctacttcaacctttaaactaggggtcctaaccttctgttgtggcttggacccctttggcagtcagatggagctcgtggataccttctcagaataacgtattttcaaaaatacatgaaatacgttgcatttcaaagaaactaattacattgaaaaatagttatcaaaatatttaataaaacaaacgtgtgaaatggtaatgaatgagcttttttattaacacattaaataaaaagatccaatggcatgtgtaaagacttcataattatgaaacagcaataagggtaaatgatattttgaaatacctgcagcacttgtaatgtgataattacttgtggtttctactggggacacagtaccagcgacatcaccactgctgtggtttattccgtcactcctaattgaggggcatgccaaatttcagttagatgttcgtgagaatgaagacacattttattttttctctctgagtttatgaccttcctgacttctattggcagatcagggtagaaacctctatggtcaatattggagtgacacaaggaccaattcctcaggccccttctcttcaatgtctgcattccttccttccactctagcttctagtctcctgggttcaaatgtatttgcttatatgctaatgagtcccaactttctggaactctctccagacattcccattgaagagcagctcagcatgaaagtcttttttttgtttgttttttttttttgttactttttttgagacatagttttgttcttgttgcccaggctggagtgcagtggtgcaatcttgactcactgaagcctctgcctcctgggttcaagagattctcctgcctcagcctcccaagtagctgggattacaggtgcccgccaccacacccggctaattttttttttttttttttttttttttttttgcatttttagtacagacgggggtttcgccatgttggccaggctggtcttgagctcctggcctcaggagatctgccctcctcagcctcccaaagtgctgagattacaggcatgagccaccgtgcctggcctgagagtcttgcaggcagctctcttaatccattagagctgctaccgcaaaatatcattaactgggttacttatgaacaacagaaatttattgctcacaattctggaggttgtgaggtccaagatccaggtgtctggtgtctggagagggttcacttcctggtttaccaatcgtggcttcttgctgtgccctcacatggtagaagggacaagagatctctctggggtctcttttataaagacagtcattctattcaccaaaagccactgttactaccacctccaaaggctccacctcctaaaaccatagagatgaagatttcaacatcttaattctggggaaacccaaacattcagatcaaagcagttatctcatcctaaatgtgtccaaatgggtctcagtccccccccctgcatcacacttgtccaactgcagtctcacccatttcagtaaatggggctccatcctcctgggggtgggcaggccaaagaacttggagtctgactctttcctttctctgtctcacctacatccaaactatcagcaagtcttgtcagctctgctttcaaaccgatccacgccccacctctgcttcttgccacctcagggctaccacctcgggggaggccccgctcacccctcacctaaatgattgcagtagcttcttaattatacccctcctcctcttacacctccctaaagtctactctcagcgtagcagccagagtaatctttcaaaaacaaaaggcaaggaatggtggctcacagtggttatctcagcgttttgggaggccaaggtaggatgatcacttgagcccagaagttcaagacctgccagggcaacatggcaagactccatctctatttttaaaaaatataaaaaataagccaggcatggtagcgcatgcctatagtcctggctaccagggaggctgaggcaggaggattgcttgagtctaggagttcaagaccaacacaggcaacatagtaagaccctatctctatttttaaaaaatacaaaaaattagccaggcatagtggcacaagtctgtagtcccagctaccagggagactgaggaaaaggatcacctgagcccaggaatccaaggctacagtgagctgtgattataccattgcactccagcctggacaacagagcaagaccccatctttaaataaataagtaaataaataaataaataaataagtgatacaatctgtgaggtcctctgttccaaactctccaaaaaccttttcttttcaccaagagtaaaattcagtcttctgaccacggactgtgagaatcatataaccctattacctctctgacgttactcaactagctccagctactttgcctccagtaattcttcaaattcaccaagccagttccgactccagggcctttgcccatgctgctcctctgtgggaacactcttcccgcatgcccttcatacccttccagtttttttttttttttttttttttttttttgagacagtgtccctctgtcgcccaggctggagtgcagtggcacaatcttggctcactgcaatctccgcctcccagctccaagcgattctcctgccttagcctcctgagtagctggaattataggcatgcaccatgcccagctaatttttgtattttttttagtagaggtgaggtttcaccatgttggccaggctggtctcgaactcctgacctcaagggatccacgtgcctcagcctcccaaagtgctgggattacaggcgtgagccactggccctggcctcttccagtttttggtcaaataaaatcctatgagtgaagcttcccttaaccaccctatgtaaaataattctactctccatcccggcactcatctttcccagttatcctgcttcatttttcttgaaagcactcatcaccattagatacaccaaacatgtacttgttttattcatttatggtccttccccttgtgttggaatataagtgttatgatggcacagactttgcctagattgtagactgatgtagcactaggacctagagctgggcactcagcaaatatctgttgaggggccgggtgcagtggctgacgcctgtaatcccaacactttgggaggctgaggcaggtggatcacttgaggtcaagagttcgagaccacggcaaaactccgtctctactaaaaattcaaaaattagccaggcgtggttgtggatgcctgtaatcccacctactcaggaggctgaggcaggagaatcacttgagcccgggaggctgaggttgcagtgagctgagatcgtgccactgcactccagtctgggcgacagagtgagactccacctcaaaaaaaaaaaaaaaaagaaaaaagaaaaaaaaaatttgttgagtgaatgaatgaatgaatgaatgaagtggttggcttctcataaaactgcttctttactttaaaaacaccacaggatccactgttagcacatgaagccgccacttcataatgagcacataattagttagatcatcccacattcatgcatgaactaatatgggccatctcatgcctttttactgaaccaaccaaggcagtgacaatggtaatagcatggacctaggctggccctcttcccctcacacctgaggcatgctgtttctcagctgggtagatagatgaggcactatgtttaattgctagtgaaaatattttccattttggtgtgctttcaagtttgcaggtttttttctatacattagatttaatcctctctagtgcctcagaaaaagttgcttattcactcaatatttgcgtaagattttattcatactgtgagcatagcatgttaagttagttacatgtttatctacctcttctgttggtctatgaatttctagaaggaaagaatgtttgtattctcaaggctgagcatagtatctggcagatagcaaatgctgatccaatatttgttgatagtattattatctaatatttactgagttatttcagtgtccttatattaaaatggggatactattaacagcccctttcaagactgctgtgagagtggaaagagttaacctaagtaaaccactgggaacgtgtctggcacagagtaagcattcagtattagtcactgtccctcctgttgatgatgttgtcatttgaacatctatttaatgtactcaagtgctttccttaaaacaattatgtgtgatgataaaccagccataatcatgataacactgaacagttattgagcagctaataaatgccaagtttgaggctactttaaaaatgcatcatccaattttcacagcagccatataagatacatacaattctcaatttagagaaggaggcacagattcagaaaggttaagtcgccttctcgaagtcacatagcaaagaagtggcagaggtgggatttgaacctgagccgctctgactccagggtcctaactactatcttatggtgggtggcattgccttaattctaaaaaagaagaaacagagacatgaagagggcagttaactggatcaaagtcacagagcttacaagcattagagctgagatttgtgatagaagaatttcctctgagccagtgggccagaggtactgtctggggtctggaatgcacttcataagcacaaacagagatggaggagatggtcagatgtctggatcatcccctgagggtgagttaatttcgtgctgttaaatgaatctgaaatttgaaagcatactgaataaaaccacgcattttccctcatcctaatgggacattaaacagctacttacataatgaattatttaactgctgactgataagtgctgtaaggtgcaggggctctgagagttcatggcaggaagtcctgcctgagcctgggtcagaggaaagaaaccacaaaaacaaagatgcacgccttccagcaggaggttatggtaatttgcacaaacctcactccggtggggggcctgagaagaagctgaggcgcaccttccaggggaaacaggcttcggagaattaaatgatctcttgcatctcctctcaatcatatgatgtaattattgggaaatgtcacatgcagctttttttgcagggacaggtgtgtgcgaagaaaggtaggcagggttaatattttttcttctggtttatgagtttcattgattttcctagaaggaaaacccttatttgaccttgttcccacaagcaggtttggcttgggatgagaagtctggcagctgttcaaaggcagatgctcctggcctgaagccccaagggacgtcaagaggcagcgagacaggagcaggaaggtggagacagctctgtgcgcctgcaactctgacttgtctgctccgccacatccagctcatcacccaattgtgcaaatttaactcctaaaactccccccaatcttcccattcctctcagccccattgacagcaccccaacgcaagatgccatcatttcttgaaacagacacttaactcatccctcacactccattcttgtttccttataatatcttctcatctgagccaaaagtgaccttcttaatacataaagacatacatcactgtcacctccatcttctcaaaacccttcagctgcttctcattgcacttgggataaacataaaaaatctttttccaaagttgggcacagcagtatgtgcccgttgtcccagcgaaagtgggaggattgcttgagcttaagagttgaagtccagtctgggcaatacagcaagactatgcttgaggggggatggcggccagagatactgtagacacactgaatttggggatgctatttagttaggattatgcgtggctgtaagttatagaattgcgatcaatggtagtctaaacaatctcttatcttactaacaagaagactggaggcagacaccccaaggttcgttcagcaacttgatcttgtccctaaagaccaagttccattccaatatggacttccatttttagcatatgggctttttatactcatgcttcttgtcccatagttacacggtggctgctgttgctccaggcatcatgactatattcaaagacaagaaggagaaggtaaggagggaaattcaggacattaagaaaggattatatcatttctttctccttatatcaggaaggaaatatttcccaaagttctccagcagatagctgctgctgtttcactggttaaatagtcctatgtggccatccctaaccacagggggagttggaaaattagggatcaagcaaggggaaacaggagtgctatgaatggctcagatcgatcatgattctcattctagggcttgcgtattgtaccctttccccgccctgccccaaatgagattgagattctgtcaggcaggagggctgactatttagtagacaaccaacagtgtctgacagagggtggaaggtgggattgggttttattcaaacaaccaccttctgagtgtgaaaaatggcagctacctcttgacttcagtactgtgaaaactgccacttgttccagctgagcctgcttctcttggctcatacattcccaagaagatgactgtgcagagcggcaagagcttccctgtttctcagaatattctcaagaaataaggctacattaataatttgttttcttggtatgggccattcggttgcaaaacaatattgcagtcatagcacgatacttcccttcctcatttacattcactgttggtttaattatgcttttcagtcagaatacttattaattttatagacctacctgaaaattaaattggataaattccttttgcctgataccttgaagaatgtgtttttccaagctgttgatggggcccgcttcggccccgtgcaattttgttcccctttaagttcatttgcaaataacactgtgttggtttaaagggcattcatcatttctgagcaggagaaacactgcaaactgcagcccaattcggaggaaagtaggaggacaatggagaaaattgccaaatattttattttctcattggagaggggagtcattgagtgaggcataaaatttcccttaggattccatgaatccatcttgctggtgaagagaacactacgtgttactggaaggcatcagcaaagccacagggtaccaaaaggacacagagcagggaccttcccaactgaccagggctaaagcggctcaacgtgagaacagcaggcagtgtatttattcattagacattcactgtgtctcaggcacgatggagctaaaaacgcaattaagacatattacctactctcaagcagcttgaattttcatagcagtagacaggcaaataaaggcacagtgatgataaagtgtgtctatcataaggtagaaaaagcacagaatgctgtgagattccagaagcagtacaacacgcccctagcctgaaagctctatgaggatgggaagtgtatttatgctatgctgtgctgtaactttgctgcctagccccatgcctggcattcagatatttaataattagttgctgaattgaattgaattaaaatcaatccagcctggtggcatgtattatttaggtgtggttagctgctataacaaataaatctccaaatctcaatggctgtaacacagtagaaaaatgcatatgtgtgtgtgtggggtgtgtgtgtgtgtgtgtatttgctttttcttcacaaagatcacatcagatctgagatgatagagggtgtctgtcccaagctgctatttgagaactgaagcttctcccatcctgggtctcttatcatcttctgagtcctcacccccacttaatgaatagagtacaaaacaaaattaaaattctaaggccccccaaccacctgaagagacccctcctttaggccaagggtcaagttaacctgaaaatcaagttcaggccacaatgagaagtgggattgggacatgcctcattacagcttcctcccttttgcaattactgatggaacagactctttaagtctggtaagaaacatttacaatctattctttctgaagccttatacccagtggcttcatctgtctgatataatgttggtctccacaatcccttatgataatccacagccagctagctacctagctagcttgcttgcttgcttgcttgcttccttccttccttccttcctttccttcttcctccctccctccctccttccctttcttctttccttcttactttgagacagagtctcactctgtcatcggggctggacagcactggcgcaatctcagctcactgcaacctctgcctcctgggttcaagggattctcccacctcaggctcctgagtagctgggactgcaggcatgtgccaccacaccaagctaagttttgtatttgtagtagagacagggtttcaccatgttggccaggctgctttcagactcctgacctcaagtgacctgcccaccttggtgtcccaaagcgctgggattacaggcttgagtcacggtgcccagctcacacattcctgtctattgataataacattttcaacgaattgccaatcagcaaatcttttaatctacctatcacttgggagcaccaattcctaccttattacccccagcatttccagttgtcccccctttctggactgtaccaatgtatatctcacatgtattgattaactccttatgtatccctaaaaggtacaaaaccaagatgtggcctgaccaccttgggcagatgttcttgggatcacctgagggctgtgcctgggccattggtctctcatatgtgactcagaataaatcctttcaaatattttacagtttgactcttcgtcaacaaaaggaaaagagaaaagagagccactgggaagtttaaagggctaggattagaagtggcactcaatgcttcctcttgcattccactgaccggaagtcttacatggccatatctaagtataaggccggaaaatacagtcagattaagtgctcaggaggaaaggatatagatttggtaaaaacgttactggaaagcggtcctaatccagaccccaagagagggttcttgaatctcgggcaagaaagaatttggggcaagtccacagtacaaagtgaaagtaagtttattaagaaagtaaaagagtgaaagaatagctactccatcaacacaggagggcgttcctgaaagtaaaaggagagacgtggccaccctgggtacaacgcttgcttatatataggataacaacaacaaaaccacagggagatgtgctctattacaagggtttgtgataaagggttaattttcctaattactatatattgcaagaatcaatattattatctctaaagcaaaattaggaaggcttctgtcagaggcgtttgaaccggagcaactctatcttgaatagaggctgcataaaataaggcggagacctattgggctgcattcccagatggttaaggcattctaagtcacagaatgagataggaggttggcacaagatacaggtcataaacaccttgctgacaaaacagattgcagtaaagaagccagccaaaacccaccaaaactaagatagcaacgagagtgacctctgcgcatcctcactgctgcactccaccagcgccatgacagtttacaaatgccatggcaacatcaggaagttatcccatatggtctagaaaggggaggcatgaataatccaccccttgtttagcatatcattaagaaataaccataaaaatgggcaaccagcagccttcggggggctgctctatggagtagccattctcttattcctttactttcttaataaacttgctttcaaatttgctctagggacttgccctgaattccctcttgggccagatccaaaaaccctctcttggggtctgaattggggacccctttctggtaacacttctgttttcaagatatcaggatatcacggcattcctgactctgggtctgtttagtaaaggttctcaatctgctcccttaactgtaaacatccagagactaggaattcctaacttcctgggaatgcagcctggcaattcccagccttattttcctagccctcactcaagatggagtcgttctggttcgaatgcctctgacaaaaacttcactgttttttatatgtagctggaaaagtggtcccaaacaatctttaagatgaataggagatatccccaatgataaggagtaaagaacattgcaatcagaagggttagtgtgaataaagatagcctggggttcataaatggtgaaaaatcacatgcacagtaagataaggctgtaaagtgaggcagaagttaagtcacagaagggattttacactatgccaaggagtttataccttgtcctaagggcaactggaagccactgaagctttttgattaaaagggtagggtggtcagctttgcattttagaacaatgcctttgggctaggtgtggaaattgtggggggctatcatacacagagatggagaggatagatttgagaaatattagaaggtaaaaatggaggggctaggtggctgagtgtgttagaggtttttgaaccagagcaactctatcttgaataggggctaggtaaaatgaggctgagacctactgggctgctttcccagatggttaggcattctaagtcacagaatgagggaggaggtcagcacaagatacaggtcatggccgggcgtggtggctcacgcctgtaatcccagctctctgggaggccaaggtgggtagatcacctgaggtcagaagtttgagaccagtctggtcaacatggcaaaaccctaattctactaaaaatacaaaaattagctgggcctcgtggctcatgcctgtaatcccagctactctgggagactgagacatgagaattgcttgaacctgggaggcggaggttgcagtgagccaagatcgtgccactgcactccagcctgggtgacagagtgagactccatctcaaaaaaaaaaaaaaaaaaaaaaaaaaaaaaaaacaggtcataaagaccttgttgataaaacaggtctcagtaaagcagccagccaaaacctaccaaaaccaagatggtgatgagaccatcaaccaagatggtgatgagacctctggtcatcctcactgctacactcccaccagctccatgacagtttacaaatgccatctcaaggtcaggaagtcaccctattggtctaaaaggggagacatggataattcaccccttggttagcatatcatcaagaaataaccataaaaatgggcaaccagcagccctcgagggctgctctatggagtagccattctcttattcctttattttcctaataaacttgcttttgctttgctctatggactctccctgaattatttcttttacaagatctaagaaccttctcttggggtctggatcagcgcccctttcctgtaacaatgccaaggagtttgcaacccgtcctaagggcagttggaagccactgaagctttctgatcaaaacggtagtgtggtcagcttcgcattttagaaggatgacattgggcttggtgtagaaattgtaaggggctatcattacacacagagatgaagaggagataatagacttgagaaatacttagaaggtaaaaatggcagggctaggtggcttattggatgtcaatcagcctctttgtcctttctgtgaactcccttcccttgtcttctcattctgagtaccctagctaaccttctccacctgaatgcttagtccaagttgtgaccagatccatttggctctgggggattagacttggtgccatttattagggatattggatatattccaatctcgacccaaggatctggcagggcaaaaattattactgaaattctaaaatgtagataaatttatctagaatttatctgggaattcaaatttatctgcctaatcattgttcattttatggccagaaatttatagacagccccattttctgaacagaaattcagagatacataaaattttctggaggtgtgctttacattgataaagttggggagggggtgctagatgggaaggaagtgctgtggctggggcaatactttccctccctatagcgacaagtgtcactggtcttccaaagcagtactgtgtaaaatatcccataaaatggggaaaatggtaacataaactagtattggtgctaaactagtggtttagcactcacgctatggcattagaggttagatcctgctttcctaacttactggttgtgtgacctctgataatcatttgactccacgggagttcagttttctcagctacaaatgaaggtagcaatagctctagtcctgcaaagttgttatgagatgtaatgagataatatgcattcagttcttggaagactgtaggaacaaattaagtgtaatctttatggtgagagaatggctactttcccacagacaagacatttgattcagctgcgtatgttctttagccatatcaatggtaataaatatgggttgaaaggattgatttaatgatttgacaaatattttcaaatatattcaacatatattgtgtatataatatgtgcctaattttggagacacagtgttgaaaaagagcaagcttcctactcaaattgaaatttaattgtagtgtcaaagaaaaacaatgaataacaaacaaacatgcaatatgatgctaagtagtaatactgttatgaagaacaaataaaggagggtagaaggtatagaaagtgacaggagatgcttttaggtagaacagaggtctgaataatgcaatgaattaaagggtgaatgaggaaatgaatgaggagcagaaggaagataaagcagacagtgtgatggtagcttccaagaacacttcagtccagataaaaatgtgtaggatggatttagactttccaaacataaggttaactttaagagtctagaaagtgataagtaaattaaagcaaaaataaatagaagaaattgatacaaaaaataagagctgatataaagaaataaaaaagcaaacagataaaagcaaaagttggttctttgaaatgacccacaaaattgattaactgtcagattgctgaaacaaaaaagagaaaacacaaaataccaatatcaggagtgaaggagacattgtaactacagatcctacagacattaaaagtttaagaagaaaacattaggaataattgacaacatattcaataatctatatgaaatggtgacattctttgaaaaataaaactcaccaaaattgacacaagatgaaacagaagatctgaatgatcctaaatctaataaagagattgagttggttttcaaaaacatcctcacaaagaaaactcgaggcccagatatttcactagtgacttctattacgcatttaaggaaagaataataacaatcttatatgaactttatatgaaaattaaggatagaacactttctaactagttttatgaagacagcaaaacccttataccaacacttgccaaaggtatcacaaaaaaatcataattacagatcaatataatttatgaatacttctcaaaataaaaaaatgcttaacaaattgttcacaaactaaatccaataatatataaaaaataataatatgtcatgaacaagtagagcttatcccaggaatgtaaggttggtaattcaccatattaacagaaggaggataaaaatcatataatcattttaatagattcagaaagcatttatcaaaattcaacacacattcatgaataaaaactctccacaaattaggaatataacagaacttaatcaagttggtaaaagatatctgtgggaaacctatggctaaacatcacacttaatgctgaaagactgaacacttttccaataaagatcaggaaaaaggcaaggccattttaccacttttatgtgacattgtactagaggttatagtcatttcaataagtcaaggaagggacataaaagacataaagttgaatgctagacataaaactgcttctatttgcagatgtcatgagtgtttatgtagaaaatattaaggattctagaaagcaactactgcaaataataaagcattttagcaaggtcccaagatacacaattaatatcacaaaaatcagttatgattttatatactagcagtaaacaactggaaaatgaagttaaaattttcacttagcctcaaaaaacatataatacttagaaataaatttaacaaaacatacatgaaagttttaaattgacctattaatataaaacattcctgaaattaaaggacattaaataaatggagagctatataccatgatcatagattgagtgactcaaaacacgtggtaggatgtttcatttttcattcattcttcacccaactccaacacacacacacacacacacacacacacatacacacacgtgcacacacacattgcttcttctccagctttaaagttatccaactgaaaatttaatattattttattgtggtaatgtgagatgaattaaatgtcattttactaaagatgtctccccacctatggcctattaaagcacctgtaaccactgtatgaatcactccaaaaagtcactttcttagtggtagaacaagactctgcacgatgtagactctgcataccttcccatccacatttttcagatttactgaatgttttgctcattccatctctagtccattggcctttgcatttgccattcattccggaaaatttccttccctcctgttgcaaaaccattagatctcagcttagacaaatactctaggaataatgaaatgtctgccgttcctccaggaagggtcccaccccaatcacagactgaacaatgtttacacataaacacattcccatctcattcatgtaagtacagtttgcaagaaatctgcgatgcaaatgtgtacatattttcaaccaatgcttgtggggaaacattgtgctttgggccatttcaacttcaaaatctaatgaatctaatcattccaaatattctcatgggattaataacatatcttatatgtataaagcatggcctcttcccatgagtcccgactacaaccagtgttttggagaatgtgtttcactccaacattcagactcctgagatcttgataggtatgtaaattgcctgtccaatctccattctccccttttttcttggtaacagagccctgattttattcagagaagcaatacatctaactaaaggtctatatccccagccttcactgtagtaaggtaggacagtgttgactaaattctgacctttatagaagtgttgtgtggcttttcaaggaatattcttaaaggaagctgattggggtgagaactatgttttcggggattttccctctttttccttccttcctgctgtcaataaagtaaccgtgatgaccagaactttaacaactgtgtttgaccatgaagctatcttgaagatggagttgctgtgggctcagttatgccagaggagacaacaagaggggtagaaactacaatatctgctttgggcaacgtacctctgcactgcttttcatgggacagtaagcctttgagagtccgagccacggccattgagcgttttcggttatttgcagctgaaccttatcaaactaatattgacaacttgggaatttaaccaacaggaagtgaaaaacatagctgccccagcctccaatcatacaggaaaggaggagaaaaggggggagaagagagaggaagaaaaggagttgaggaagaggatgaagatgatgaggaggaagggaaggaggaagagcagaagaacgatgagaatgagaaagatggggaggaggacagtgaggatggggaggaggacagtgaggatgaggaggaggattatgaggaggaggactgtaacagcagcaaatacatagatggtgcatgtgtgccaggccctgttacctattcttactgacttaatcctcttaatcaaccctatgaagtcactattatcatccccattttataaataaggcgaggctaagagaggtgaaataaatcacctgtggccacacagtttatggttgaaactgctgagtttactcctgctatgatcaaacctctttcctgtgtctttgaaatactgaacagcaaaggctgcaaggattggaaaccctttttagagatttcaaggattgccttcttgctttttagtttttcttggtctcgcttcccccaactattttgtagattcctttaaaggaaggagagtaacatggtttgtgaaaaaagtgaaatataatgatatgatatataatgtaaaagtaggcttaaagatacttgaaaataagtagtcataacagggaaaacgggcacatccaaaaactacaatcaaaagtacaagggcactctttatataacattctcaaaacgtcaaagttacagcgacatgccaaaaattatacaaatcaatggtttccagggttagggttcggggaaggctgtgctcgtcaatagcattgcaccagtgttagtttcttgggtaaagaagggagcttcaccattacctctgggtcatcctgggcacctctgtgttgactgcccaggtcatattctgttaacacggcttaaaaaaatttttttaaaggaaaacaaaagtgactttaaactcacccctgaaaaaggttattaaaagacagtatttactttacaaaaaaaaaaaaaaaagcaacccaacctctttgcagaagttcataaaaatccctgtacgcatcaagactgagaggcttttcaattataaatgagactttaaaaggtagacagaacccctgaagcttccacataccacgcaccattgtggcggatggaaggaaaaccgtcgccctgtgttgacggcgtatttataattgaagagtttgagaacgcaaatgcaaatgaatcaacaccaacagggatgtctaaaagacataagtgagaattacggcaattaagaatgttgtctcagaggaaattagactgggccattaattacaatgccttaaagggaaagaggtcccagtgaaaatgcaataaattaaaatatcaaaaagaaaattagtgggaaggaaacatggaagtgccaatgagaagctaatctcagaggtggtgatggggaagagaagggagaaggcatattgaaagcgaatattgaagaggtgaggcagacctgcccaggctaaatcctcctgccctcccttcttttctcctcctctgtctccttccttccctccttcctttttctctccttttcttctttcctctctcctttctcacctcccatctctattctttccttacttttcttcctttctccttccttctcttacccctccatacttccccctttccttccttctctactccccctttttccttccttcccaccattcttttcttcttctgaccttccctgctctctcctttcacttttcctgtcccctcctttccctgtgacttcaaagtaccaaatcctaagaggcagagacacaccaggagccatcgctctgcccagggagaaattagaatctgccttgggaagcccacacgcatctgctgctgcctggctgcatctcccctgcccttgccctttaaatcagctgccaggctcctcaaggggagcagccactagactgtccccagtgaatggcccaggtgtccctgctcactcctggtccagtgacactctaatgttccttggctttaagttctcaaaaatcatgtgtatttatttgtctcctcaacttggcagggaaaatcttgagcgtgtgtgtgtgtgtgtgtgtgtggtgtgtatgtgtgtgtgtgttttgttttgacatggagtctttgttacccaggctggagtgcggtggcacatcttggtctcaaagcaacctctgctcccaggttccagtgattcttatgcctcaggctcccgagtagctgggactacagtcatgtgccaccaggcccggctaattttgtatttttagtagacacagggtttcaccatgttggtcaggctggtctcaaactcctgacctcaggtgatccacctgcctcagcctcccaaattgctgggattacaggcatgatcaaccacgcctggccagcttttgttttttgatataggtactaaccagaccctctggatgtggcacctcctctcttctggtgttcttccaactctacaccatggacatcctctaaccctaccttgccgcaatccagcatccctctctgccacaggcaggaatgaccaatcctccaatttcctcacctgtctaggcttccacatgacattctcaagtatctctatgataggaagagttgctttctatggtgcaaaactgtcccaacttcagtggtttttttttttttttcctgtaaacactttttacctgcataatgattcacttaatagtactctttaaaaaaccgcattaaaaattattttaaatttcaatagttttggggggacagatggtttttggttccattgataagttctttagtggtgatttctgagattttagtgcacctgtcaccagagcagggtaccctgtacccaatatgtggtcttttatccctcactcccccaacttaccttccccccttgagtccccaaagtccactatattattcttgtgcctttgagtccacacagcttagttcccacttataagtgagaacgtactatatttagttttccattcctgagttacttcacttagaataatgtcctccagctccatcctagttgctgcaaatgatattatttcattcttttttatggctcagtagtattctctgctgtgtatataccatattttctttatccacttgttggctgatgggcacttaggttggttccatatctttgcaattaaaaattccattttatttatttatcgagatggagtttcactcttgtcacccaggctggagagcaatggtgcgatctcagctcactgcaacctccgcctcccgggttcaagcgattctcctgcctcagcctcccaagtagctaggattacaggtgcccaccaccacacccagctgatttttatatttttagtagagatgaagcttcgccatgttggccaggctggtctcgaactcccgacctcaggtgatccacccgccttggcctcccaaagtgctgggattacaggtgtgagccactgcgcccagccaaaaagtccattattttaaattcaaatactttagcctcacctgaaagcaataacatctgtgaaaccaaggcttttctacacaagttatggatctttttcttgtgaatattaacataaacacatgtctacacaacgtaaaatgtccaatcagtttccttcatgggtttgcctcttgtgagcggcaacacttcttgtacaagaaacactgctggggtgagaaagtacaggatacgaattaagtacaatccaatttggtttcaccacctgctgtaggatgttgggaaaactgggtattacccttggatcctcagtgtttccatctgaacactgggtataattatgtttgtctttctaacggttgtttagggacttaatgcatgtagtaggatacatgtatttcctttctccatgactataactcctatctccctatcctgtgtgttcaattcactaggaggctgggacaactttaataccacttttaagtactggtcagatgtctagccccatacctcatgtttgcttaagtggtggtatgagaacggcgagggcgtctgaacttctttcaaagtagaccataagctctttgataaataggcaatatttcacaattctttgcatcaccttgatgctcacctggtgccaagcatatggaggtgctccatcaatacctgctgacccactgattgatttcccattctggccagaactctgagcacagtcaatgtggggctctgctggaggtgtggaggtgaggtcggctaacagcttccatggagcagacctggctttaagacatggctgcaaatagttccccaagctcgaaggcttgccaactcagctaccatttcccatctgtgtttctatttttcctgtgagagtagctttattgatctcattaattctcttttccatttttggcatgggaaggtgatattatccacgctttaatgccttctgtgttttgcaaattacaggattactatagatggaatgaccaaaaaaataaaaataaaaaaacactgttttcacagaattgtggcaaaagccatgaactgtccttcatttaaatagatgggggtaatctgtcctggggggtccattcactcaggtccaaggtccgcaaacacagagggagaattttctctcagctatttctgtgtgaagcaatgcaaatatttttctcacttgaacattttcgtttttgaattactgatggcagtgataggtttcctaataaggtttcttttcttcttttacagcaattacatttgactattttttcttctcttcattgaacattagtttgaggaggtcttaaaaggattcatctgaggaatgctgtggctcaaggtttggagttcaataagtattttatgaaaaagaaatctctgctgctctgctgtaaagacaaggaaaagtacctcttatgcaagttcttttagttcgataactaattaaaatcacaaccaccactaagagaaaagtttctcctgatcttatctactgctacttagaactctttacaagagaaggagaaagaaaaataaaataagtgatttccccatagactgtgggtctcccaggacaggtctgctttatctttatgggtctccccagagcctaggttagtgtctagaactgcgaaggcacctaataaatgctgactaaagagcaaaatgaatggacttgttttccttttaattttttaattgaaatataataatctatatgctcaaaagtgcagaaatcctaattaaacagttagatacatttttacaaatttgcaatcacctgcaaaaccaaaacctcaatcaagaaacacaataacataaccccagaaatcctgtacccgccactttccaatcattatcctccaaatataaccactgtcctgacttctaacagcacattctagttttgcttttgggattatacagggtgtcttcttttgtgaccatattcttccattcaacattagaattctgaactccatctgtactgatgcatatactttcagcttgttcattctcattgctatagggtgttccatcatgggtgccatggactgaatgtttgttttcccccaaaactcattgattgaatccctaattagcaatgtgatggtatttggaaatggtgcctttgagaggcaatttggatttgaagaagccataagagtgaggctcttatgatgggactaatgcccttatgaaatgaggaaatgacatgagatcaatctctttttctctctctccgcttgtatatgcaccaaataaaggccatgtggacatatgagaagacagctgtctgcaaaccaggaagagggccctcaccaggcaacaaattagctggcaccttgatcttggactttccagccttcagaactgtgagaaataaatatttgttattgaaaccacccagactgggtgcagaggttcacgcctgtaatcccaccactttgggaggctgaggcaggagtatagcttgaggtcaggagatcaagaccagcctggcaaacatggtgaaaacctgtctttgctaaagatacaaaaattagccaggcatggtggcatgtgcctgtaatcccagctattccgggggctgaggcaagagaatctcttgcacctgggaggttgaagctgcagtgagctgagactgcaccactgcattctagcccaggcaacagagagagaccttgaaacgaaaaaaaaaaaaaagagaaagaaaagaaaagatagatcatccagcctatgatattttggtatggcatgcaaaactgaccaagacaatggaaatatgccacaactaatttatccattccacagctgatgggcatttggcacctttaagtttggagctatcatgaaatgcattgccatagaaaatctaatacgtgtcttttggtaatcacatgtttttctgttgggttgtgtccctgggaatggaaatggatcataagatgtgtacagttttagccttggtggaagctgcccaacattttcccaaagggtttataccaatgtatattcccagtaacagtacataaacatcctacttgctccatatccttgccagcacttgatgttgtcagtctttttaattttagcattcgggtgggtgtgtagtaggatctcattgtgtatgtgtgtgtgtgtgtgtgtgtatgtgtgcaatttctctttattttgagataattgtagattcacatgcagttgtaaaaaataatacagagatatgtcatatgcccttcactcactttctcacaatggtaacatcttgcatacctacggtacaatatcgcaatgtggaaattgatgttgatagaatctaacctcagtcagatctcaccagttttgccatgtatagagtcactgatcatcacagtcaaggtatggaacagtgtcactgcaaggatctttcctgctacttttatatccactgctatctccatgctgctccctaacccctggtaaccactaaactattccccatatccataatgttgccatttcagtaatgttctatgaatggaattgcatagtatgtgaccttttgagattggctttttccactcagcgtaattctgtcaagatccatccaataggttggttgcctgtatcagaattgcattccatgaacaaacttttgaagaaactacgcatctcatttccaaacagttatttttagtagtttatttgttttctattcaagggatggcaaaacagacttgcacatttttttcatttgttcattagtttaatgaacatttataaagtaccaactgcatgttgagcactgtgctagatggtgagcacccaagagacacacagggctctgctacgtagggttttccgaaaaattagctgggcctggtgatgggcacctgtaatcccagctatttgggaggctgaggcagaagaatcacttgaacctggggggcagaggttgcagtgagccgagatcacaccactgcactccagcctgggtgacgagagcaaaactccgtctcaaaagacaaaataaataaataaattggggagacagacttatacatttaataagacaatacagcattacaggtggcaacacagagctgtgcatacatttcagtcaggaataaagaaggaaatggctgactttatgaggatagggtggaagacgagtccaggagatactttttaagggcatgatgcataaaccaagtcttggaagttgaataggttgcctgatgtctgtggatgagagaggaggcaagagaaaaaggggcgtttctgagcataaagaacagcttaggcataagcatggaggcgggaagaagtcgatactcaatttggaactcagcacaccaggattcactaagcctgaaaagtgagtggggctgctgaagagatgaagagttaaggatcaccatctttcaggaacactcattcttactgaagacacagtcccaagctgctgcccagatgccaccagcagaatcctactgaaacattgaaactgcccttctaaagtttatacaattaattagggaagaaaggagggagcttacagcacattcagcattaatcattagggagcttgctctctgatctgcttcctcacagctgtttggcgcctattgcctcagaatcacatagaccctgtgacaaggttatatttggttggtgcaaaagtaatctcagttttgccattataagtaatggtgaggccaggtgcagtggctcatgcctgtaatcccagcaccttgggaggctgaggcaggtggatcacttgaggtcaggagttcaagaccagcctggccagtatagcaaagccccgcctctactaaaaatacaaaaattagccaggcattgtggcatgcacctgtagtcccagttactcgggaggctgaggcaagagaatcacctgagcccgggaggtggaggttgcagtgagctaagattgtgccactgcactccagcctgggcaacaaagactccgtctaaaaaaaaaaaaaaaagtaatggcaaaaaccgtgattacttttgcaccaacctaatagctccccttaactgctctacaaataacaaatcattcattgtgaaatgttatgtttttcatttgagatattctttcaggtcctacacaccagtgaaactactgacatcagctgctctgaaggacttcacaagaagctaactcaccaaagaatgcagtttccatatcttgatggtttcatcccttttacccccactaatcaacaactccaattttccagccccttgcctgatggtctccttaaaagccccagcccagaactcctcagggaagtgaattggagggtccctgtctccttgcctggttgccctgtgaacattaaacactttctctgctgcaaaccctgctgtctcagatttttagtctgttactgcacagaaggcttatacacctgtcagtcctgtgacagtaatatgagtcttctgggctccagccacactgtttacaaaacagtttacaaaactgtttctcacagacccctgcattagacacgaccaaagacagtgacttgagttacacggcttttacatttctgtctcatgagtgtttatctgtcagttgtgcctaacacagagcacacacacacacacatacacacacacccatccatccacctaccttggtgtcaaacacgcaaactttctttcttgccccttcccctgaaatgggaatgagaggcattccttaagtactcacaatagtaagcacatatgttacccctcctctaagacaatgttccaagagccttccatatgtctgttccttattatagtcctctgatctaagtaggcctattatcacacccaatttctagataaggaaactgagtcacaatgaggctaagtgactcaccccaggtcacacagctcagttcgcagagacgagcgcactcgcgtgcctactccctccatgagtgtggcaacaaggagggtatggactctggagactgattatgtgaataaaacctggccctgctgcttgtaagctgtgtgacttgggtgggtcacttaactcactgtgcctcagtttccttgtggatacagtcaaggtagaggcagcctacctggcagtaggtgctgaaatgacagtagataaaaagatcatgctccttcagcatgaaagggtttcaagtggaaagctcaattcttcttctaaaaagttaataggatgaagttagagggttcatcagtctactcagcatctaaaccaacacactcgcaccaaggctaatgtcatcatgacagttttcagcccacaggtgtctcctgatttaattatcaagagagtcccattacttggtatatgaaagtgagataaaaacctatccaaggggcattttcttcggcttccatttttggatattggcacttgctgattcccctctctgccttgtgctaccttcttcccttcctccttttcctcacccagttaatgcctcacttccttagaactccagccaaagagtcaatgccccaggtatatctaccttaatcttctaaggctagttcagagctccctgttacatgtttgcatagcatcttttatttttccctgagttcttatcacaatttataattatatataaatatgtgtgtgtgattatctacttaataaacatctcttctattataatttaagagtaatagaactgagacaatctttatttttacttagcatttaatatccatggcatagtacttgcacatagtaggcactcaatacatgcttacagagtagatgaatgagtaagcatatgaaaaaattaaaaaatctgaatgaatgaatcaccaaagtttcatcaaaaagaatttgatgtcctgtaatgacttcgattccctgaaatgtcttggttgctgctggtgccatagactttctggacacccaaggaataatatttcagatagactcatgaggtttccaggcttctgcgaatcaaatccagcccagcccagcccagccttcctgggaagtctgtatttaagtcccccagtttgatttccatcatcatccactgcaagcgagagcagttgattttctttaattaaggcaggaaggatggcttcctgaatgggtaatatatctcccaagttcagcatttcatctgcacagcccacatttcactcggaaatgggacagattcattaaaagtatggccagacagcttcctctttggttgcttgtttgcctacctttaatgaatgaatacataacgtgcctattcattaccaacttttgagtggaagtaattgctgggttccctcgtttgcttggaacaatgttctttgcatttgaagtgtcttctgcctcagtcaccacagtaattcccaatcaatgggccaaagacaccctccaggggcagatattcacctccagctcacctttgagagaagtaatcactcttctagtcctccagggcctcattcagtgcactaggaatgctcatttatggcaggagaccctgggaccctaagaagtaaatgagactgggaggcccattaattctctgagtacaccctgggggcacctggggcattataatgtaattactactaagaaagactaaattccaatgtactttgtcaaaaagcattttacagaaagtactcagtttggccctccctatgatcatgtgcttaactttggccacaggaaatctagggggccatttgggtgactcttggttgactcaaggtttaagggacccttgagactttatccctcatccccaaatcattaacaaacatttgccaagtgcctacactgagtataaattaaagattactgggtccctcatctgtatcctggacctgtacaacacagctgttctagtggtctcccagcctccttcactgcctccgccagttttattttctccatgattgcacagtggtctttccaaaacataaatgtcagtggctcacgcctgtaatccaagcacgttgggaggctgagccaggtggatcatttgaggccaggagtttgagaccagcctagccaacatggtgaaatcttgtctctactaaaaatataaaaatcagccaggcatgatggcatgtgcctgtagtcccagctactcgggaggttgaggcaggagaatcacttgaaccagggaggtagaggttgcagtcagcagagattgcgtggctgcactccagcctgggcaacagagtgagactccgtctcaaaaaaaagagaaaagaaacacaaatgccatcacaacagtcccctgctaagaatcccaaggcttccccttgcccccaggattcaggacaaagtcctcttcctgattcacaggaccttctttgtgcaatctggccagttttgtatccacctaccttctgtcccactttgtaagcatctgcctgccgtatgaagctacttgcagttctctgaatatattccacagttcccacctcgatgcctctgcccacacattttcctccacctcctccctatgaccatcttgtattatttgaaacgctagatcagattcagagccctagaagagagaggcaggttgcatcactttacgatcagagccatgagtaaagtgatagggagtggtgaggaatgggacaaactggtgagcacacgccctctctgtgaggggcagctataccacccagcaatatctaattgttgccatgaaaggatgtgggttcagtgttttcatatccactactttccaggagaagctgaaaatctgaaattttatctgaaatattttttaaatatggtatactccatcgtaacttttaaaatgttaaaggccttccaaagtgggcctgagctcttaggtgctagctgctgactcttgacctctacccaacaggggacacctccttggtgaagtcatctctcctttgtgtcaacattataacttgtggctcaaggaagagcttcagcgaccaatctttgtgtctctgaaagttggcatagtacatggcacacagtgaatgttcagaaaatgtaggataggtaagccaatgaataaataaagtcagtttcttcccccaattggaagcttataaatcacatacacttcaaaaaggctgggggatgttggtgtatcctttttaataatcaggcaaaaaatggttttttatagccagccttcaaccccggtcataagagaagttggcatccacttgtgaaaagcaatttgagagagaacactcagtcctgctgtctaaaaatatctatcacctataacacctgcaatccccaacgttatcacctttaatgggttacattgtagaatattacctttgcaggcatcgttgggaactagcccttccctggcaggaaatggaagaagtgttgtcagctcctaaaagttaatataaatatataccgggttcttttccaatatattctacaaaattgctgtatgactttaggcaacttcctttatcagaaccctactttccccatttataaagaactattctgggccaggggaggtagctcatgcctgtgatcccagcactttggcaggccaaggcaggcggatcacctgaggtcaggagtttgagaccagcctggccaacatggcaaaaccccgcctctactaaaaaacacaaaaattagccgggtgtggtggtacacgcctgtagtctcagctacctgaggaggctgagggaggagaatcacttgaacctgggaggcagaggttgtaagccgagatcgcgccattgcactccagcctgggtgacagagcaactccgtatcaaaaaaaaaaccaaaaaactatatatatatatgtatgtatgtataatttttttgagattctctctctctctctccatatatatatatatatatatatatatatatataattttttggagactctttctctctctctctctctctatatatatatatatatatatttttttttttttttttctgggccagtgtctggggtcttcatcattattattatatggtgtgcaatgaaattagaaaactgctatcttagaccaggttagaaactcaaatatatgtaggaatgaagaaagagaacaataagagctgggaggggaatttggcaaactggaaagctcacatccttctggagggaagagccgctgttcaattccagctcactgttgccacaagggagggtcagctcagagctacctgatcatctgatttttaaacagaagccagaaatccatgattttatgtaaaatatcccaattgcttactaaatcacctgagcaaacaaacaaaaacagtgttgccaaaacaaaacatctacatggactagatttaatctacccatgaaccaatttctgggaggtggggaatggaagtgggctcaacctgtatcacatgtccacctcccttctcatggttccttaagtcacaatcgaaagaaagcagacaaaagctacaggtgggcggggtgcagtggctcacacctgtaatcccagcactttgggaggccaaggtgggtggatcatctgagatcaggacttcgagactagcctggccaacatggtgaaacctccctctactaaaaatacaaaaaattagtcgggcatcatggcaggtgcctgtaatcccagctacttgggaggctgggggaggagaaccgggaggcttgaaccaggaggcagttgcagtgagccgaggtcgcgccattgcactcccacctgggcaacaagagcaagattccgtctcagaaaaaagaaaaaaaaccacaaaaacaaaacaaagaaaaacttcaggtgtctgctacaaggcacaaatcaaaaagactaataccacttgagcttcctactgttttttttttccttgagtcatgcattatttagcttgaaattggttgatttgaaaaagagcccctatacctattataagcagatcttcccttacccatataagatttctgtagcctatttccaagaaggaggcagccattaatgaaccgtgtgttcccacctctgggtcttgccagccatagagcaattctgctcaaggagaccctggttcacttctcggtaattctgacttctcagggaccggcttttgtttattttccttcctcccaagcatacatatttcatctggcagcttttccacatcagcaaaatctgtcgtgccagcaccagattcctcttgtgcacaggctccatcctgattaactctatttatataatttattttggttgcccgtttcccgtttgggagatcgatacaaatttaaatgagaagcaagagtatttacagccacttcaagcgttgatcaaacacaggccaggatgtggatgttctgccttggagatgagtccctctgtgggatcatcttggtatcatctcacaaatggagagaaatggagaaggagaaaaggaagcagacagaggacggaaaaagggagggaggaagaaaagaaggaaaggatggagggaggaagaaaggaaggagaaaagagaaggcaagaaaaaaaaaaggaaaagaaaagaagtggctagactagttttccagctttccagctcagttggcaaataccaagcacttttagccttcggctcaacttttatacacatatctgcatgctgagacgtgtctagaagtaagtcaccaaagtttttgcttatattagttcccaagtaaagcagaagacgctgccagcttatttgtgcatgagtttttagctgtcaatgcatatttcaaacagcaggcaggaactgactgcataaatcaagctctgcggggatctgctgcccttcaccaggctggtgtgtgatccaggatgtgatttgatttttgggctttctccttagcagaggccagctcaacggcccagccttcatgatctggaccaaattgtgtgtatttcggggggtggagtagcgcatccttttgttgagctggcactgcctccttttctttagttctcagtttggacactgcctgctatttcttttttttttttttaagaggaggaggtggctgtaaaaagtgtttctccaagagacccatgtggtcaaggagcggaatgaggagtgagtcaggaggcctttgtcatggtttgactctgactttcttagaatgaactcagtcctattattctctacccagagccaactgtagcatctccacccatggggaaggctatggtttatttaatcaacagaactggtccatttggctctccattggtccattctgatgtacagaaaacatggatctgtacatcaatcagatacaaaaatcaattctgaatagattaaatatgtaaatgtatacaagaaataggaaagaaagtaagaggctctatatataaagagttgtttttatatggtctttggttgaacagatcttaaaggaccaggatgggggaagaccttcctaatctagacagaaagtccagaagctatgaaataaatggttcacaaactgattacaaacaggttgggtgtggtggctaacacctgtaattttgggaggctaagacaggccgataacttgagtccaggagtttgagatcagcctggccaaaatggtgaaaccccttctctactaaaaatacaaaaattagccaggtgtggtggtgcacacctatagtcccagctacttgggaggctgaggtgagaggatcacctgagcctgggaggtcaaggctgcagtgagccaagatcgtgccactacactccagcctggctgatagagtgacaccctgtctcaaaaaaaaaaaaaaagaaaaaagaagttaggaaggaagttaggaagaaagagaaagaaaagaaagaaaaggaaagaaagaaaagaggaaggaaagaaggaaggaagaaaaagaaagaaggaaagaaggaaggaaggaaagaaagaaagaaggaaagaaagaaagaaagaaagaaagaaaggaagaaaagaaaagagaaaagaaaaagaaaactgattacaaacaatgtattttaagatctgttagactggctgggcatggtggctcacacctgtaatcccagcactttgggaggctgagacgggtggacaacctgaggtcaggagttcgagaccagcctgacccacatgcagaaaccctgtctccattaaaaatacaaaattaactgtgtgtggtggcgggtgcctgtaatcccagctactcgggaggctaaggcaggaaaatcgcttgaaccagggaggcagaggttgtggtgagccaagatcacaccattgcactccagcctctgcaacaagagagaaactaggtctcaaaaataaataaataaataaaagagatctgttcgaccaaagaccaaataaaaacaaaagacaatgacagactgggatggaacatctgcagtacatatggtgctcaaactgttaatattcctaataactaaagggttcctaaaaactgaaggaagaagataacccagcttaaaattggagaaaatatatgacccggtaatacattaacgggaagccatgaaaacacttaccccaatccactgatgagtggaaaaatggaaactaaggcacctatatggcaccatttttctcccattagtgtggtaaaatgtttaaaaaattaataatctcctgtgctggtgaggatgttgcaagggaaatggccgtggtgcagtcaagagtaggctgaggtaaacatgcggcacagcatgacgcagtggaattggagtgcaggctcacaatcccgtgcattacataatcacagttatggagccatgttatgggagggctcatcacctgtctctgagccacttttgttcgtgaggtgcataaatacatcactaacactgtgagaggggggtcgcataataaagccatctgtcacctgcctaaagctccctccaactcaagtggtctttcaactacccaccacctgtccaccaactccccttgatctcagcttgggttggaacctgacagatgtggagaaatggccatgacagcaacaaatggctgaaactgcaaatttattttgcaacataattaatgcaatatgtattaaaattcaaaagattcttatcattaagccagcaattcccttttttgaagcaggtacaggagaaataaaagctatacagaggtttatttgtacaaggacatgtatgcatattgtagcattgtttatggtgtccccttccaaggagagaaaaggaaaggaaaagcaagacggagcggaggcagactcagagagagagagagagagagagagagagagagagagacggggacagagagagacggagacagagacagagaagaaaactggagacattctcaacaaatatttagaataaattaaaagcaataagcattaataaaataggataaatatttgagataactgatgtggtcatttagaggaataagtcagatctatgtgtactgtcatggaagaacagcaatgatttgatagtaagtaaaatgcaaaaaataacccacaatcgcaaagcaataacaaaaagtacagggtaacagacttagcttaggttagttcatggtactgagaatgaagtttctaaggccagcctacttggattcaattctctccttcggttgttagctctgcaagctaattaacctctctgtgtctcggtctcctcatctgtcaactgagaaaattactggggcaattagatgagttcatcatgtaaagtacttagagctgtgcctggtaagcttcatcatcatactcttactattgaaagggtgctaatacagctgatagcctgcagttaggcaaccttggggctctagtcattgccagaacactgaagtattttcacaccagctggtaaagactgtcccccactattctgattattctaggcccttccctaggttcaaccccttactccaggcatccccatggtctagcaaataaaggtttaataccttggcttcccagtggtctccagattccaactccagcctaaggcttagaccccctgccaatctggctttgaattctgcatatcacctctaacaacagggatgtattacctgtgtacatttttgaaaacaatcaataaactataacagggaatataatgcaagcctacatttctgcatcttggtggcattcaccaaagccaagcctggcttctgtgatttgcaaatggctgccttctcctcctccacccttccctcacagagggaagtaattcaaattactctctacctgaagctagcatggtaaataattgaacctctaaaagaatataaaggcttaaaaaaaaaaactcttaaatattacctacacaggttttactgcaacctacagggtgtcttcctcaaattcactgctcaaaatctcttgagccccagaagtcttttagaataataccaggaaatgaatacccacctggtaatgcattataatttctaggtctggctgtgatggaagccaagtccaggtttgtacaagttggaaaagaataaaatgtccctggttacaaataaatagctgtgccaataacagactttaatgtactatatccccagaagcctgagaggagagaaatgagcaggacgatgagataatcggtctaaaagggcaaatcaagcccctctaagctggctttttttataggtgggcttgtaaaataggggtggagaaacttctgcttcaaaagcaagaacaatgaaaatgaaagttgctatttcaagactgaaaatatgtgctcaggctacagaggatactctcccagggcccatttcacaggtgaggaagctgaggtgcaggacagttaactctcttgcccacaggtctgaaaagcaataacatttgttgagcagggtgtgaaagcaggtgcctctgtcactacagttcacagaagtctgtaaaatgagacatatctgtctcgagacatagggacacagaaagatggtgagagagacaggtttatgacatgttttgtgatcggattcatttgccagagcctctgaattaaagattagaccagtttcatggctagctcatgtcaggtctggattcatttagggctggctggttggtttgttgattttgcagggctgagtcccttcccatcaacatacacacgtactcctgccttgttcaggccacctttacctgctctttgatgctgcctatgcagcgagtgagttagaggtgaaattgctgctaactactaagagtccctgcccccttgcaactgacaacagatgacactgaaatgaaagggaggaagggaagacctcatgagttcctggtgcttgtggaaggaggagatgcattataattatatttatacaaggcagcgatacttcacctcctgaaatcgttaggcaatgttttgtttatatgctcctatgttctgggggaggattttctggggagagcctccctcaaattctcaaagggatctgtggcaccaaagaggttaaaagtcgattgtcatgggtgtattagtctgttttcacgctgctgataaaaacatgctgggtaatttataaagaaaaagaggtttaatggactcacagttccacgtggctggggaggtctcacaatcacagtggaaggcgaaaggcacgttttacatggcagcagcaagagagaacaatgagagccaagcaaaaggggaaaccccttataaaaccatcacatctcctgagacttactcactaccacgagaacagtatgggggaaactacccccatgattcaatcatctccccctgggtcccttccacaacacgtgggaattatgggagctaaattcaagatgaggtttgggtggggacacagagccaaaccacatcacatagggtctgtaaatcaaatatgtccggatagtcatccccattcagtccttctttcattcaacacataatgagctcctactatgtgcacatcagggtcaggtacagggattacactggtgaatccttccttcatggaccttatattttagttggggacacagacattaaagaattcatccggtgactcatggatatgatggtgttaggagcttcaaaaagcaaggaggaagtgaaatgaggacctatttcctagtacactctgggttagggaagacttccttgatatagtgatatttaagctgagctcagaagcatgagcagttagtggggaggggagggttgccggaggagtgttctaaaccctgggtgcccagggggatctgcagaccagcagcatcagcaatgtctgggaactcattagacgtgcagatgctcaagccctgcctcagatgtaatatgtatttttttttttttaggtggagtctcactgctgtgtcacccaggctgtagtgcagtggtgcaatcccggctcactgcagcctccgcctcctgggttcaagcaattctcctgcctcagactcccgagtagctggggtgacagatgtgtgccaccacgcccagctaatttttgtatttttagtagagacggggtttcaccatgttggccagactggtctcaaactcctaacctcaggtgatccgcccacctcagcctcccaaagtgctaggattacaggcgtgagccaccacacctggcctaaaatcttaaaaattttaaaaaatactttcgacttttattttagattcagggagaacatgtgcaggtttgttacataggaatatattggatgatactgagatttctggtataaattatttcatcacctaggtagtgaccatagtacccaatggttagtttttcaacccttgccctccttctctcccctctctagtagctcccagtgtctactgttgccatctttatgtccatgtgtacccaatttttagctcccacttataagtgagaacatgtagtgtttggttttctgtccctgcattaattggcttaggataatggcctccagctatatccatgttgctacaaaagatatttcattcttctttatgactatgtagtattccatggtgtatatgtacatatatggtgtatatgtacatatatggtgtatatgtacatatatggtgtatatgtacatatatggtgtatatgtaccatatgcatggtgtatatatactatatactatgtagtattccatggtgtatatgtaccatattttctttatccagtcccctgttgaagggcacctacatagattctacatctttgctattatgtatagtgctgctatgaacatggaaatgcatgtgtcttttctgcagaacgatttatattcctttgagtatataactagtagtgggattgctgggtcaaatggtagttctattttaagttctttgagcaatcttcaaactgctttccatggtggctgaattgatttacgttcccaccaacagtgtacaagctttcccttttctctgcagcctcgccaccatttgcagttttttcactttttaataatagcctttctgactagtgtgagatggcatctcattgtggttttgatttgccttttcctaatgaaaagtcctaatttttaacaagatccctaggtgattgatatttgcactgggggctgagaattgttcctctgaagagaggcaggagtatttgaggaactgtaggaaaactggtactcctgaaactcagaaagaggaggaggtgggggagatgaggctggagaggcaagagcagagacatcagattcttgtagccatgttaagaataaaagaaatatttgagggcaagtgaatgattatgcttttggcaagaactttttttaaattaaattaaattttttaagttccagggtgcatgcatatacaggatgtgcaggtttgttacctaggtaaacatgtgccatggtggtttgttgcacctatcaacccatcagctaggtattaggcccagcatgcattagctctttttcctaaagctctccctttcccacctccaccctcccccaacaggccccagtgtacgttgctcctctccctgtgtccatgtgttctcattgttcagctcctacttataagtgagaacatgcagtgtttggttttctgttcctccattagtttgctgaggataatggcttccagcttcatccatgttcctgcaagggacatgatatcattcctttttatggttgcatcatagtattccatggtgtatatgtaccacattttctttatccagtctatcactgatgggcattttggttgattccatgtctttcagcaagaacttttaaaactctaatttggtagcttgggctatggggtttatatgtagaatgactgagggaaccagcttttgtttgtggtcgcctatccctccttctgcacattccacgcttcatctctgttttctcatctgtaaaatggggataacaagtcctctcttgcgcagtccttgggctggttgaatagattgttccctataatgcacatatgtcaggtccagtgcataagaagtattaacaaatgagtttacttctcattgtttcaagaaatatttgttccaattatttattctaagccctgaaataggagctggagatgttacactgaacaagatgtgacagcctcagggagcccaaaatcactctggggaaactaggactcaaatagatgatatgatagatacaataacaggcaaagtacaggtgccagtaagaatgtaccaaagatgggtaacagaatccagggagcctgtccaatgcttcacagaggaaaggatatcgaggctgatgccaaagaatgagttgaaattagccagacaaagaaaaggaaggtctgcacatggcagaccctacttgacatctacaacatccagaagcaacgagggatagctatctagaatatacaaagaactcctctaaattaggaagaaaacagagtaaacccaatggaaagatacaaaaaaaatcatcatcagatgattcagatatggagaaacctaaatggctctatgacctatgaggagatgctcaacctctttaataaccagagaaaagcaaattataacaaggcaccacttcctacccatcagaatgacaaaacagtagaaagatggcaaatgccaagaagcatgaagctgtaagctctcctttcttactggtgcgaatgtaaactggcaacaccatttggaaaagttatctggtgagtcttggtcaacataagtatgtgtgtgccttactgcctattaatctctctcctaggtatataccctaggggaatgctcacatactcataaaaggatgaatttaaggcatcaactttctttgtagcatcaagaagttgcaggcaactcaggtgtccatcattaggggattggctgagtaaagtgtgacagatgcacattatagaaaatcaaacagcacaaggaagtcacaagcaattttatagaaagcaaattatacagaaagcaatttggatagatcgtcaaacaatgcggaatgaagaaagcctcagaatggggtttccaacacagtgctatttatgttaattaaaaacactcaccatcaaagtaactctgcatattttataatatttacaaacacatgtctaacacatgagaaagggttcccctaggggaagagaaatgaaatggggactaggtatatagaggaagaaataaatgaatagtaaaacaagacaataattgaccatatatgatgatgcaccataggctaggaaatttgactagctcaacttatgcttctgagatccaataaataaacaaagtatcaattaaaatggaagtgtttcaggcaaagggaataatgtgcaatttgcagaagtaatggaggacatgatacattctggaatggagagagatcagtagaattgggacaaataacataaggcaggaagtgttaaggaaagaccagacatgaagaaccctaaagctatactaaataatcaggattcagcccaagggcagtagggagccattgtagtgacatgattgtgtttttaatcttgctccaagctccaacaatgagaaaataagccattccgctgagtcagaagcgcatgacatttctcagtattcatgtggcatatttatcaagtattaatgaaataagccttgagcatcttagcacccaactcatgaacctcatttttccccccttttataccaattatgagatagtcatcgacactttcaccaataaccaggcaacatacagaaccacatttactatttgaccttgggcaaagtcatctgaactccaaatatgagttgccttaatttctttatcagtaacaagaccacaagcatttcctatatccagtagccactggaatcaaacagaaagtgattttacatcttcaaaataaccttatgagatagatagtattcacattttataggaagaagaaaccaatatggagacagagatgttaagtaatttgcctaaggtcattaaccattaatagatgcagaagcacgcatttctgtttacagactgtttaagagtctattctgcgaaccacacctcatggtaccacccttagatggtagtgcttccttcaaagtttgtagcattggaagaccttctgcaaacagtgtgtttggcaacactggagcctagaaatcaatctcaaatgaatggcctctgagctactttgggactgtatacgtgttttctttaacccaagtaattttcttttttaaattctgtataatagcctatattttgaaatctgaagattttacgtagaaatccaaaattttggtttctggtgaaaagttgggaaatttgccaagactgggctcccattccctttcagaaaaatccactggagctgagtagcagctacacatttagagagggcatatgctctccaattttccacagtccccacccctccctaatacactaagctcatttctctcattcccattaactgcctaggcctaatggaattcaatgttatgacctctgttgtagggaataaatagtctaatcaccgagaggatgggacgagccaaggttttaaaaatccaaagcttgatctatctcagaatgaaaatgaaaattaaaatctttctggagatttatcttcctggtctcaattctcattggtcttttccccctttgacctttaatttcatttattatgaaacagccaagtggcacaacagaaaataccatcaaaatgtgagcactggggttgttccttcagaagctgaatgttaggcctggcttttccaataactctctattcattcaaatctaattacaaaatgatttttaatcattgtggaataaattcactcttcacatctagaaatgttaaagccctaatttaacagcaataaccaaaaaaaaaaaaaaaacaccctctaatggatttgcactaagaagcagaacatggcctgtgttgtcagatgttcaataatttaactgcaaatgaagtgtgtaaaatacaatatttgtgtcataaaccacccagcttgtcacataatagatttttgaagagtcatgtttcacggcactgagcaatgttatgttggaatggtggagtagccaaattgaggtttaaaggttccatttgcttatgcagaaagtgattgagtctcacttcacccagtgacaggaagcatggaaatacagtgtctctggatcttaccatttcaaagcagtggctggaattcatccttccagctagataacgtaactcatgttcaaccttccctatgttacaagatgtattttggattaccttacaagtctagtgggatattgtggttcctttgctatcacaggccatggtaggcagaacaatgtcctccccaccatcccatcttaaagatgtccatgtttgaatccctaggacctgaaaatacattgggtggcctggaaaagggggaattaaagttgcagataaaattaaattgctaatcggctgacctgaaaacagagattattcagatgggtctgatgtaatcacaaggatccttaaaagtagaaggaggagacagaagaggcaagtcagatggagatgagattatggcaggtcagggtgatgcaatgtgcaaagaactttactttccatttctggaaggagcactgactttccattgctggaaggaggatgggtccacaagccaaagaatgctggtgccctctagaagctggagaaggccaggaaacattattccctagagcctccagaagtgcagcagccctgtcaacaccttgcctttagcctagtaagatttttactggacttctaagcttcatgactgtcaggctaatacatttgtgttgcttgagccacttaggtggaggtaattagctgcagcagcaatagaaaactaatacattgataccaaagccatatctgtgggaaaataacagaggaattagaacactgccttcttttgctcaaaattagtagactaagatacaaacaaatgatgttactatatttcttcaattttactatgcatattcgtttttcaaattatacatttctcacattaggatttatctcacaattgaagaatacattgaatagagtgctcttccccaagtcctttcagcaaaattgaaagctgtcactaaatagactgtacgttgtacaatcttgagtaccccaaaatgacacaaaaagtgttcatcttaaggagtgagcaggtgaaattcaattcaacaagcattgattatcttgttagtaccaagcacgctgctaaacactgaggtaggccagacattgttgtttttgtgactttcacaggcaaatggaacaatgacctatacatgataaattaaaacaaaaactcagactgatgctatgattaattctccaaatgcaaaatgctgtgaggtcagggcctgtgcctgcctagttcatttccaagtcccctgtatctagcatagacatggcctagcacagggtaggtattcctttgaatgattgtctaagtgctttacatgctttatcttatttcctaccaggtggattatatggtgtcttcattttacaactgagggaactaagtttagaaagagtaattcatttccccaaagtcacacagctactagcagcttagaccagggcttctcagcatcggcatcattgatatttgagctggatcattctttgctgggggcaaggggccaccctgtgcattgtaggatgtttggcagcatcccctggcctttagtcaccggatgccagtaacacactctactccacttggaacagtcaaaaatgtcttcagatgttgctgaatgtccctgaggggaaaagggcaaaattgcccccagttgaaaaccactggcttaagcaaatgggcattaatattctaagtatgtgtgcttttaaaataacctccacaaaatctctgatactctccttttagagagttggagcccaattcctaccctattgagtattgagagaacttagtgacttgcttctaactaatggaatgtggcagacacaaaaggtacacacacgattaggccatagaaggcattttggccttctctttgtcctctctcttgaattgctggttctaggggaagttaactcccacatcatgagaatatataaacagacctaaaactctacatggtgaggaactgaggcctcttgcctacagccagtgaggagccaagctacacaatctgttgctatggagtaaactgtcatgggagaagtgcctccagtcttggttcccagttgaaccttcagataagtgacatccccagctggctgatgtcttaactgcaatctcatgtgaaacccagagccagagccacccagctaaaccactcttggattcctgatgctcggaaactgagtgagataataaatatttgtgttttaagctgctgagctttggggcatgtgtaatgcagcaatagatcacaaagacgaaaatgaatgacctattgagggaaaaagtaaatggtccagaatgactggtgtgtggggtgcatggcagaggagggcgcatgggctcgaggatacaaacagaggcagagctgaaggatctgagtgctttgtatatatcagggaaaaatggggaatcagaactttgaggctgggcatggtggctcacacctgtaatcccagcactttgtgaggccgaggcaggcggatcacctgaggtcaggagttcgagaccaggatggccaacatggcaaaacccccgtatctactaaaaatgcaaaaattagctgggtgtcgtggtgtgcacctgtaatcccaagctacttgggaggctgaggccagagaatagattgaacctgggaggcgtaggttgcagcaagccgagattgcaccaccacactctagcctgggcgacagagcgagactccgtctcaaaaaaaaaaaaaaaaaaaaccctttgaggattatgtagcacagaagttggcaagctatagtccagtggctcaatccagctatttttgtaacacccttgagtgatgaatggttttacatttttaaacattttccatatattttccccaaaacaagggaaacaggaaaggccaagaagggccagtttgcaaagggacttgaatgcaggctcaggagtctgaagttctttctagagacccctggggccataaaagagcaacaggacttgtgcatttttcatttcttaaaaacacaaatctgagcacatcattcttgtgtttgtttcccaatggcttcccgttgttttaagcataaagaatgaacactaagaaaatgagagatgacctttcattttcttcctgctgcctagctggtcagcctaattttctgccattgctccagtattgtgcccaacacacacacacacacacacacacacacacacacacacacactcacacacgtagatgcattccctccgaacagtccttctatcccagacatttttagttctcttacatactgggttctactgggactttgtctttgtcccaaatacctctccccatccctgccttttgggctacctatactaattgcccctttttttgaaagtcttcctgcttgggcatggtggctcacgcctgtaattccagcactctgggatgctgaggtgggcagatcacctgaggtcaagagttcgagaccagcctggcaaacatggtgaaaccctgtctgtattaaaatacaaaaatcagctaggtgtggtggcatgcacccataatcccagcaacttgggaggctgaggcaggagaattgctggaacccgggaggcagaagttgcagtgagctgagattgtgccactgcactgcagcctgagtgacagagtgagaatctgtctcaaaaaaaaaaaaaaaaaatcttcctatccttctcagtctagggaggtatggctcccatacattcccattttagtctgagtagatgtttatctccacactcatgagactgttttgtatttgtccatttatgcaattttcctccctatctagatgagagctccatttattagctgcatattttatctctgaaaatggtaaatgtctaataaacgtttgttgaacaaagaataaagaaatgataactgagttgccgctgagagctgtgtctaaagaaatccagacttctgtgtagtttggtagctgggtgatttgtcttggaaggtttctgaagaaaaataagtccagcattaagacgccttatcttacctgaggtaggtacataccttgtagtgcagctggacataaacacggatatagcagtaacgggtttcattctcttccacaaatcaccggaccagttcccctcagaacagaccaagaggcattaccgttactctgaaacatgacctcatttcactgactcatgggcagaaaccctgagttgctggtccctttccaccagtgtccctaatcttccctcatatgacaggaaaaacaatagctatccataaccctgatcattttcaagcaagtttgcctctgttaaccattgagaacccctgaagagcttgttgtggcatctgtctgtttttgtgaactgggttgggctcaaggatactaacaggcgcagctgaaggatctgagtgctttgcatatatcagggcaaaatggggagtcagaactttgaggattatgtaggactgatgtaggcaagctatatccactggctcaatccagctctttttgtaacacccctgaactatgaaaaatttttgcattttaaaaaaattattacattttagatggtcatatgagtatatatatcatttccttttttttttttttttttttgagataaggtcgtgctctgtcacccgggctggagcgcagtggcatgatctcagctcactgcaacctctacctcccgggttcaagcgattcccctgcctctgcctcccgagtagctgggactacaggcatgcactaccatgcctggctaattttctgtatttttagtagagatagggtttcaccatgttggccaggcttgtcttgaactcctgacctcaggtgatcgaccagccttggcctcccaaagtgctgggattacaggcatgagccactgcgccaggcctgggtacctatctaatttcttaaattttggctcttggcttgcaaaggctaaagtatttatcatgtatggccatttaagaaaagttggctgatcctttatgtagaaggaaagacaaagaagccctcagagttggaatttggagaacagacatgactaacatggaatttttttttttttttctaaaatagggtcttgcacagtcacccacgctggagtgcaatggtgcgatcttggctcactgcagccacaacctcctgggctcaagcaattctcccgccttagcctcctatgtacctaggaccacaggcatacactgccacactcagctatttttttttttttttttgagatggagtcttgctctgtcacccaggctagagtgcagtggcacaatctcggctcctgcaacctctgcctcctgggtttaagcaattctcctgcctcagcctcccgagtagctgggattacaggcacctaccacaatgcctggctaatttttgtatttttgtagagacagggtttcaccatgttggccaggctggtcttgaactcctgacctctggtgatctgcctgcctcagcctcccaaagtgctgggattacaggcatgagccaccacgcccggcctattttttttttttttggtagagacggggtcttactttgttgcccacatttgtcttgaacccctgggctcaagtcatccacctgcctcagcctcccaaagtactgagattatgggtgtgagctgccatgccccgcctagcatagattttaagttgcttacaatggagtgtaccctgtaacacatctcctcagcatcccccagagaacctgtgttatgtgcattggccttgaaggcttgtgagtcagcgattctttggtggaactcagcatatgtgtctgaaaagacagagcatgtagaagaagaggctcgtgaacaaggaagcagctgtcacctggtcacttacagccagtcagttgatcgtcttctgggtctcaggtcaggtttgcaaaggaacaacacggacctatcctccttctcctcttcctccagcctaaatggactccagccagctgggtgtcactgctgccatccttagagagggcttttcccaccttcacataatcaggaggctcctttcttcccgcaggagcccatcagtcgaagtgcacggctgcttctcgcagagagccttcttacccatcaagggaagataatgctctgtgatcattttggtttttccaggcttcatgttctctctctcctttctgccccagcggaaaacgtagggctgctattttaagacatcctttagtaccaaaataccactttgagacactcatgtctttcttttcaataatctcttttaaggtataaagaacttaccaggaggggcacgtggtggctgcctatgggaagcaagctaaacggctgctcagagacctttctggtattcctgctgtgccaggacgtcagtactttccaactcatgattctgaggctggtggatcttccttgtcttcttccatctctcatcttcaatgtcctaggctggggactaagggaaggcataatggggagcccaggcttcatgcagatggaacaccagcatgagaaaggaaaggcagatactggccatgtggacaagaaagcaagacagaagaacagtcagtgaaaatacctttccctaccatgaccaataccattgagtctatagctgaaggtagcattaggggtgggtgtctagcaatatcatacaaactaacagacatttgggtgaataaatcatgagcagagtcccccataatctgcctttctaacgataattagtatttactgagtgctatatgtcacttagtaaatgaggtccggttttaatccgtttacaagattcagttcatttgctgctggcaacgatcctatagcataagaaccattgttcccctgtatttacgaagaggaaattagagctcagagagggtgagccacttgcccactatcacacagctcatgagtggtagagctgggactcagacccaagcctgaccccagaacctgagctcataacctctccttggatgggttcttccaaggagtctgcctccaataaactgtgtcccatgccagccaggcaccagcatatgctttggagaaaccaactcccgtagacatctgtctagatggtgctgatattataaatggtactatgaaaaaataaggataaagcttataaatcaggcaaagggaagttatgattcttctggacaccctaatctatctccctataattgcctgtatatgaaatgcctgcatgaggttatcagagtattccctgagtcgcctgcgaaggtaagactgcaattttagcgacccttgttacacaaaccaaagcaatctgttctattttgacactatgacactcctggcttgcaaaagggatggaggcacggacgggcaggcatttgtccacattcttgttccaaacgaaagtaagaagggttaactgtgaggcatgcttactgcaaatgacagctctggcttctaactatactaagcagtggccaccaatcttggggatacttaagagaaaaccacagctccatttctttaacccatctttaacctttagttctagaaatcttaattaaaaatcaattccattttttttgtagtaaatctgacagtaattctatctctaatggcagtggaaagataaatagtatgtcaggtaaactcagcaggaaaatgacattttcattagcaatttactgggtaggaaattcccgccatgataaagcattcctgaacaatactaggtaaccattcccctagggcagctgctaattaatgggggaacaccagtgggattaaatgtcttctacccaaatgatttgaatcgtcacagcagttattttgaatgtacctgcaccgagaaaataagtcgggcccccaaaacaataaacaaagtgacataacaagacgattgcagcctattgcagtccagaaaaatctaatctggtctcctaacagcattgcaatctttattgtgactgtatgggccccaattcatcagcccatttcggcaagctatccccaccaataatcattcactttcagggtagcctctgaacaggtattgactttagagactagcaattcatcccgggccctctatccctccatcgagattcttcggcagtctttgaagcagacttggaaagaaaaatttggtcctcatgtgctagacccccagagagcttccagggataaagaaaaaagaagacaagcaaaattctccattcaaaaggagaataaaatcctggcatcatatttcatccctgctaaacctcaataatgttcccagtgatcagtcaaatcaaggtagaatcatgaagtattagtaagaaaagggatgtagggttagagtatttacatttacagaggggctactatatgcccagggctccaaataactttctaattaaaacttacatcaagcccattgcaatgtaggtataattattagctttcctttcagataatgatactgagcaacgccctggctgaatggcggggaggactgaatggtggtgatggccaagagcaaagcgaaacagcatttccaacaggaaggatgtggacaggattatagaccctggtcagagcaccgtgatgaggaatcctacttggcttggggtgctgatgtccacagaccgataggggagagactttatgctgtgtatctcagataaggcaaagggaagatgtaattagattttactatggagtcataatttcagcccacagaaaacaataaaagtgtcaagagggccgggttcggtggctcatgcctgtaatcccagcactttgggaggccgaggcacgtggatcacgaggtcaggagttagagaccagcctggccaataaagtgaaaccctgtctctactaaaaatacaaaaattagccaggtgtggtggcatgcgcatgtagtcccagctactcgggaagctgaggtgggataattgcttgaacccaggaggtggagattgcagggagccgagaccatgccattgcactccagcctgggtgacagagtgagactccgtcaccaaaaaaaaaaagcgtctgaacacagctctcccttttgcaggaatggttacctgatattctcttcccaccaggggcttggctggagctctgaagctgaagtggatgccactccgtatgatttccatctgtacttattaatggtgaataggagtcagttatgtaactggcatgttcatcacttcgtatgctgggccccacaacccatttctgaaagggcttccatagagcctgctgagtgtataatgagactttggttctacttcttgcccataggttgggccaaggatagaaacaaaattgaaatctgagttgggagaaccaaggtatcacttggggatgcagaatatggtccaggagctccacacagttgctgttgggcccttgactgagaaaccggacaattctgaggcttgcccggctcaaccggacatggccgatatgcagagagagagaggaaagaagcagacgtgcatgcagaaaggcagaaggagacatacccctaagatggccatgtgctcctggcctctgaattcccaattccaggctcctgggagatgtggctgaaattcctgcccctgaattctgaaggctgcctacagtatttgttgggttgcttctggttccaagtgccagaaaaatccacataactcaaactagttaagtcccaagggagttgaatggctgacagagctgcaaagaccaggcacaaatggctgcaggtgcccagaccatgtcctcacggttctcctctatctcttctgcccgctttcctctgaattggcttcattctccaagttgggggctcaccaaaactcccagaagttctggctttgtaacagcaatggagaaaacaccccacgttccaagcaggtttagaaaaactgggaggctgaggctcactggatggtttggatcatctatctacctatgaaccaagacactatggtcctccggtcaatccacccttagaactcagtggggagtgagtgaggccccacccagccatgcagactaagagaaagcaaaggaacactgttcaaaggggacagctggatgctgttagcagagaacgaatgctggcaggcaaagagcaggaacatctaccatgtcccagccccacttcaaagaaacccgtgttttaagttactctgagcaggtttctggtttttgtcaccaaacagactaaatatttagaaaaatgtgtccaaagtgctatgtgtatgtgagggggagggaggggaataaaaatgagtaagatagatttcagtggtcaagccctttaccattttgtagggaagataaagccaatatatgtaaattatacatcacaagaaagagcttgtttcaaggggatatagaaccccaggatttcaaaggctgtgatactggctggtcaccagggaagtttctggtggtattaactttgtgtggtgattacagaatggtgagggtttgaaatagggagaatagttccagtcacagaatggtgtcatcaggccaggggcagtggctcacatctgtaatcccagcactctgggaagccgaggtgggtggatcacaaggtcaggagttcaagcccagcctgacaaacatggtgaaaccccgtctctactaaaaatagaaaaatgaggcgggcatggtggcacgtgcctgtaatcccagctactcagaaggctgaggcaggagaattgcttgaacccaggaggcggaagttgcagtgagctgagatcacaccactgtactccagcctaggtgaatgagtgagaatctgtctcaaaaaaaaaaaaaaaaaaaaaaaaaagaatggtgtcaccaaacatttagaggctgacaagtatgaggtatgcatagagatgatcaaacttacccctaaatatctcttgcatctatttctccccagctttctcactgccagcccagtctaatgtctctctcaaacttctgggacatccacgcttgctctatgccaatccaatttccacttgtcaaccagagggatatttggcaaatgcaaatttggtgagaattatgccccccctgcttctcagtgagtttcccattgctctgatgatcaagattaaaattattttccagcatcctcccttctttgtcacgccagcccatctgctcttctctaagttctacaaattctgcaaagcttcagattcaccatggagactgccagaaatgctcctcccatccctggtccctttgcagtgtgatttgttggtgcccttcttgcagatacccccatagggaaggcgatttcacctagggaagttcaaatttccttgtgaagcacgcatactgtcacactgtatttttctttattgcttttatttcagtcagtgaataaatatttgtgtgattatttcattatgatgctttcctctacaacaatgtttcttaaccttgactctattgacattttggaccacgtcatttttttttgttttgtatggggggaatgtggggtgcacgggggggactctcctgcacattgtaggatgtgtagcatcagccctcgcttctatcccctagatgctagtagcacaccctcccccagcagtgacaagcaaaaatgcctctggatgtttcccaaacatctccctgggtaggtgagtaacattgcttctcccaccttgaaaactactgctgtataatttttttctttctttgagacagagtctcgctctgtcacccaggctggagtgcagtggcaagatctcagctcactgtaacctctgcctctcaggttcaagtgattctcctgcctcagcctcctgggattacaggcatccaccaccatgctaggctgatcttttgtatttttagcagagaagtggtttcacgatgttggccaggctggtcttgaactctcacttcatgtgatccatccaccttggtctcccaaagtgctgagattacagggtatgagccactgcacccggccactgctgtataatgtatactataaagtccatgaggaaagaaatcagtccaaagcctgataaacgtaggcctgaggctctcaactccagctgcactgtagaatcacaagagaactttaaaaacattctgctgcatggtctgaccctctatcaaataaataggaatctctgagaaagatggagaggggagattgaagcccaggcgtccaaaggaaaaacaaacaaagcagaaaacttcctaagtacatctcttgtgcagctagggttggtaatctcagaagcaggcatccatggttggaagctttgttgaatgaatataagggagggatggagagagtgagggggtgagatgagaaaggaggagatgcagggaagaaaggcaaaaaggggaagaagggagagaaagaaggaggaaagaaaaggaattgaagccaaagaagggaaaaccaatgtttctcattagacgaggactcacaaaaagaacctggttatgaaagctggaggcctaagttgcgagcacatttgaagagctttgaatatcattttgttgtagctggggtaagcaatgcaaagccaacaaaaatttcagagcaaggatgcttcaagttccaagcagtgttttaagaagtcgagtgtgttacacccagcacaaaataaaccagggtggaaagacccgggaataaactgcattatatgaaataattgagagtggtgagaataaaagtgaaacaacaaacaccaaagattccctacagcaagataacctggtgattatactccctgacaagtgcagagactgccttttggggacacagccttgtccctgtcattcttagtttagtaactaaggcagacagtgaaaaacagttactaatgtcgtatcagtaaggaagaagcagaaggttccacgggctggagcaggtgcctcccctgatctcaggcttcagaaaacacttctcagagggaagcagctataagttagcatacctcccagcggggagggggtgggctggaagagtgagggagggaggtacgggaactaggaaaagagaactggataggggagggtcaagagcaaagtgaaacagtgacagatgagcaagagaagcccaggaggatggtggagtgcctcgtaagccctattcaggattctagactttccgctaagagtcgaaataacccacagagagaagggttttaagcaaagtagaagcatcatccagatttgcatttttttcagatctccttttcgctgtgaaatataaaacagaaacgtggatgaagagagaagctggcaaaatgtttccaaggctttaacgccacctgagttggaaagagaaatgtgacatgagcagcaatgcagagaggcagccagtgaccagagttagggacaagaaggctttgaacattttctcccattttacaaaagcgtttactttctgggcacaaggtccccatgttgggaagagagtggaaagagctgtgcatcattccaggccctgcatattgtgcatggatccctgcctgcctgcaggtgcctgtgcttcagtaaggagaacctgggtaaatcaatcaggactcctttaaactctaggaagtcaagaaattctcctagttggtctctgtgtccctgaagaaactcaacaagaaaagaatacgggctgtgtagccagtctaatctgacttccaatcctttcccaaccactgaccagctagataatttccctaacaactctgagcctcagtttcctcctttacaaaacggcaatgccactatctccctatgtgtttgtgataatcaagtaacaaacaatacttggacagtgcctagaagagtggttggccattgtattcatccgttttcacactgctataaataccctaggctgggaaatttataagaaaagaggtttaaattcactcatagttccacatggctggggaggccacaggaaacttacaatcatggtggaaggtgatggagaagcaaggacgttcttcacatggaggcaggagagagtgtgagcaagagcagggaaaactgccttataaaaccatcagatctcaagggaactcacccactatcatgagaatagcataggggaaactgcccctgtgatccaatcacgttccatcaagtctttccctaaacacctggggattacaatttaagatgagatttgggtgaggacacaaagcctaaccatatcagcagtgaataaggactggtgttctccctttgaatgaaggtatctaaactatgtagattaatcaccagcttaagctatttgctgctacaaaaaactgcaccatgaacagccatgtccacgatgtagcattaattcaaaatggtgcatgtggggaaggtttagtggaaaggctctcccatttgcttatgatggatgtttataggatacagaaaaaaatgcaggactccaggcaatagaaatatttgaataacagcacagccggaacatttgtagcaggtcaatagactgctcctctctccagtaaattccccatcttgagcttctataatattggcatctttgttatgaagcaacttctgatctatttctcttctggaggtatagtgaatgcatttgaaggagaatggtgctttattacagaccaagggccttgtgtttatgatttataatattgtggtgtttgcctgcctaatatcgcctaaagaagtgacaaatcatgcaaaagaaattaacttgccctgactccgggtctgtttgtttagccaggactcttcagattgcaagcgacaggcaaattaaaatagctaaggaaaaagagaattgtaagggcatggaggaatctcatgcaagaatggaatgaccaaaccaaaaaagggcaggaatgcaggtggggctcaggaactataaaaccacagactcagacatactggcattcttttccatttcttgtagcaattgtctgtttctttctttttttaaaaaaaaatctctctcattacaaatggtctttggctatacagaagaaaaaaaagtgtctcttctgatctcagtagcttctgagttttctatttatgatgtcagtcctcagagggatattgagtttactcccttgatgcttagcccagaagtcctgatggagggacttgttggcttagcttgggtcaggtgcccattcttgggccagtcagctgtttccagtgcagcgtggtgacccattctgggtcagatacctactcatggaccaattgacattggctagagatgtagactacttgagaaaatggtccctcaaaagaaaaccaaacagatttgcaggtggaggaggaatttccagaaaaagagccaggttggagagacaaaacaatgggtgaatgctacacctctctcctgggggtggtcacaggaggactctctggtcttgaattttactcacttattcttctcctccttattcattcattcattcaaatacttactgaagtacttcctgccgttttctgagtttagtgtgaatcaaagttctcccctcctactgctgacacatttcttttttctttttctttttctttttttttgagatggagttttgcttttgttgcccaggctggagcgcaatggcgcaagctcggctcactgcaacctccacctcctgggttcaagcgattctcctgcctcagcctcctgagtagctggaattataggcacatgccaccatgcctggttaattttttgtatttttagtagaaacgcagtttcaccatgttagccaggctggtcttgaactactgacctcaggtaatccacccacctcagcctcccaaagtgttgggattacaggtgtgagccaccgtgcctggccgctgacacatctctaaagcacagacacatccactcatagtcttccatcaacgccttggccggagaggtgctcagtcccacttaatagtgggcaggagcttgcagaccacttcacactaatgattcctcctgctcagagatctattctccttgaaatattcagcaatgcacagacaaattgcagacagatcatcccaatctctcaatagtgacacacatacacacatgcacatatatgtgcaattgcacgtgcgtgcacacacacacatacagaggccagaatctctactagatattgagaaaacacttgcttttctcctgcagaataaaacatttagctgaccaaggtcacttttgtattgtattgacgggcctgcaaatggagacgtacggtattaggaaacctcaaatctggtataaatttatgggtcttccttgaacagagttatctcttctttgtccttgagcttttttcatttgaaaagtgaagagcctgaatatgagctagatcctcgcaaccagttttggaagggaaacaccaggtcctaaattgtcaaaactgaggccttatcgaggactctttctctgacattccaggttgtatctaatgaccaaattcttttcttttctgtagtagttccgggtcgtaagcatctttgcttacaggtaagctcccagttaccctgtaacatctagaaagcagacaccagggcttattcttcatattacagatgcccagcacagaacctggtatataacagacacttggtaaatgtttgttaaataaatggactgatgaaagacacattgtgtgggccaacctcacttgtccacggagggatcctcctctcagcaaatagtggctacaatgactttcgcattgtgagtctgaagaacagagagctcaggctgtcaggtcccacaaaggccaccagaattcacatctcctttgacgttctccagagctgggtcacagagtctcctggtccaccaaggatagcagaagctcaagaacagcacactcaacccagtaatacagagagtagcgcaggctcttcacaggcatttaaaaaaatcttggctgggcgtggtggctcacgcctataatcccagcactttgggaagccgaggcgagaggatcacgaggtcaggagatcgagaccccagtgaaaccccgtctctattaaaaatacaaaacaattagccgggtgcggtggcgggcgcctgtagtcccagctactcgggaggctgaggcaggagaatggcgcgaacccgggaggtggagcttgctgtgagccgagatcacgccactgcactccagcctgggcgacagagcaagactctgtctcaaaacaaaacaaaaaaatcttaacagttaccagctactgagcccttatggtgcaccaggcaccatctaagagctttggaaacattttctaaactagtagttctcaatcagggctgattttgccccctaggaaatatttgacaatgtctagacactattttgattgtcatcctggaaggggtttgctgctggtatctaggtggggagggtagaggccaaggattccagtaaacatcccataatacacaggacagcccccaacaacaaataatggtccagccccaaatgtcaaaagtgccaaggttgagaaatctaagataatcccttccacaaccctattcttactataatgtttaccttagtagaattcaggctcttctcaacctcctcacctggtggtctttcattagctttacaaagatgatttattttgggggaaagggctattatcattttaactatagactcaatgtctcccaagcttagcttggtccaagcccaggaattattaaaggcagttgggaggttaaaggcaacatgaaggttggttaggtcagatctctttcattgccataactttctcaccattataatttttgcaaaggcagtttcaactccacagcacagaaacacctttatcaggacccttgcaaaccttgcccctctacctatcacttcatccagttgttcatttgtatcctttataataagacagtaattataagtatggtactttctgagttctgccagttattctagtgtgggggccgtaagttcttggttccctaaaggttcactgaaaaatcattttatgcaggagatgagagaggagaaatgggtcatgaaacgtgtcagcagtaggaggggaagtacatttcctgattttccaggagcagaaactgaggaatatggaatttgcccaagtagcagagctggaatttgaaccctcagtctttcgggtctaacccctaggcgttcaccctctattctatcactcctggcaggtcttgcctataaggttgaactaaatggagaagttcatggtaacaatcctaaacctacttaatatgctgggacttgacaatttccagttgcctccacgtcagattttacctagtttcatgtgagaaactaaagatgttacttgggccagagctggaagtatcttatattgaatccagtttgccctattgaaacataataacttttaaagtaatctagtctcttcattaccgtgttccatccagttgtcgaaatctcttttgagttggtagttaaaaggcccagctacacattcgtaacatcattgttgctggctaaaatgcttagcaacaacacaaacatcactcagaagcaaattatcagatgtaccgacaagatgctcctcaatttaatagcgtggtaaatgatggctgggagatgttctttgaagctgtgaaggcaaatgtgaaagctaattcaattctcaaatgaataaaagtgagaaagtgttcttataaacctgatattaccagagatagggcttgagcatcctgctgccttgtgtgggagaagagagaggagtgggaatttattttatttctgatagtaaagagctgggctgtgcgaccacacgtttgaccttggatcccgggctgggaacttttgcaagcgtgagggctcctttccaactgagctaacaggcatgctgactaaatcgctggttccccttgtagctgcttgagggagtgaggggtctctaaagagaccttcagggctttggggaaatctgatctctattagattttgggaacacagaagataattttctgagaggagaggggatctcatatcacctgggtcagtggctttccaatcgctaatagggccctaggtcttcacaaaggtaactcagaggaaggagaaggaaggcttgaaagggattcacggcctgaaatttgctatcatttattatatatatcaggtttaggggtaagatattattaacattaatattaagatataacaaaggcttctactgctaaaaatcatgaatgccactaatctactcacttagacgagaaaagctgggctccatggagatgtccccaaggccacacaaccagctaagggtcacaacccaataccaaccgggtgcccaagaattcatttcatttctgacactaattacctgaaattaatgtccaacttcacacgttagggggctcagcaccacaaacctgcctgcacttcagatgctgccgcaagccccaggggccatctacacttctgcttggccaatgcggccataaatttggggattcccatgaccccctttcaggttcacaatttgctactgaagcaaattaaaatattttaccctgaaatatatttctctgacatattttgaaatggctttctcagagctagcagattgaggtgggggtaaatttgcatctgtagagaatctccattaatgtagccaggtcttttctatacctttccaagatgtaggagagactgagtctgacacctttaaaagactagaaaggctgatcacaaggtcaggagtttgagaccaccctggccaacatggtgaaaccctgtctctactaaaaacaaacaaacaaacaaaacaaacccccaaaaattagtcaggcatggtggcacatgcctgtaatcccagctactcaggaggctgaagcaggagaatcgcctgaacccaggaggcagaggttgcagtgagcctagatcacgccactgcactccagcctgggaaacagagcaagactctgtcttaaggaaaaaaaatgtcttaaaagagctgggcatggtggctgacacctgtaatcctaatactttgggaggctgaggtgggaggataactggaggccaggagtacaagaccagcctgaaaaacacagtaagactctgtctcaaaaaaaaaaaaaagagagagagagagagagagagaaagaaagaaaaggaaaaataaaaaactttaacttgaaaaaaaagtcaaaaaagaaatttttactatctattctcttggagggaggcctcctccacataacaaggccacctttgctagccaagcctcttcctctcttcctcccgtaaacctgtcttgccactaagcctgtttttggccatgctctaagtccacactctttctgtaatctcaagcttctgtaacttattgttgggttaggtcttcattctgaaggctcctgtgtatacacattaagcacatctgtatgccttttctcctgttaatcaatctgtctcatgtcagtgatttttcagtgaacctttaggggccaagagcttatggtccccacactagaatagctggtagaactcagaacgtgctatacttacaattgctcttttattatcaagaatacaaaccgggtgaagtaatatatagggtggcaaggtttggaaggctcctgataaaggtgtttctgtgctgtggagttgaaactgcctttgcaaaaattataatggtgagaaaattatgacagtaaaagagatctgacctaatcaaccttcatgttgcctttaacctcgcaactgcctttaataattcctgggcttggatcaagctaagtttgggagacattgagtctatagttaaaatgataatagcgctttccccaaaataaatcatctttgtaaagctaatgaaagatgaccaagtgaggaggttgagaagagcctgaattctgctgagatatagacataaatgattaccagccattattctggaggtcatacgattttcaattccctagttactcctgcagataagatcactattgttgaccctaagattggccttttgagatgtcttttcaggtttttgcatttctgataaccaaggactctaccagacctgccaaccagtcctgtggcctctacccagtaaccaactcagcacaagaagaccgctttgactatgtatgattttatccctgacccaaccaatcagcactcctcacttcctggccccgttcctgccagaactatccttgaaaaatcccagtctctgaattttcagggagcttgatttgtaataactccatccccctgggggatgaccggcctcatgttagctaaatgctttatttattgtgatgctgcggtctcagtgaattgggtttgcctgtgcagtgggcaggaagaacccatcgagaggttagagagtgacgatgcggccaggcatggtggctggcgcctgtaatcccagcactttgggaggccaaagtgggcggatcacttgaggtcgggagtttgagaccagcctggccaaagtggtgaaaccccgtctctactaaaaacagaaaaagttaacttggcatggtggtaattccacctgtaattggaattggcacctgtaattctagctacttgggaggctgaggcaggagaattgcttgaacctgggaggtggaggttgaagtgagccaacattgtgccactatactccagtgtggatgacagaggaagactctgtctcaaaaaaaaaaaaaaaaagagtcagaacacacctccctgccagcacatcagtacacttaccaaccagaaagctctcagagcctcattgcccagagtttttgttgagctttcattatataggcatgattgattcaaccatgggccacatgactgaactcaatcatctccacctccccacccctagccacaggttggggcggaaaattccaatcctctaatcatgcacttagtctttctggcatggccaacttctccttcaaaactaattagggtccaccatgagtcacctctttaggataaactcaggtttagtaaaaagagactcattttgaataacaaaatatactcctaacacgtaagaaattcctaaggcatttgaaggagctctgtgtcaggaaccagggacaaatatcagatttaaaaaaaaaaaatcataccataaaggcagaggctgacactatatatagcgcttgtttttttctgtcaccccagcaatccgactaggtgttttctgagcaatgaaagagcagaatatattggtcagagcaggaggtacctagtgattggctaatttacagactaggaaaatgtgattcagaaatgatgggagggccccagctacgtggtgatcaacctggtctaaaagctgggtgtctaaccctgaatggcaagactctgtagggccccctgcttgtttcctatggcttctgtaacacattgtaacaaacttactggcttataacaacacaaatgtattagcttagagaagtgcaggtcagaggtctaaaatgggtctgtgaggctgcgttccccctgaggattctgggggggattctagtcccttgcccattcccatttccagaggctgccaccatcttttttctcacgacgccctttctccatcttcaaagccagcaacacaggatcttcagatcattccctttccccctctccttctgttgttacactgccttctgtctaactgacttttcccgcatccctctcttaagaagtctatgactgtaatcccagcacttcgggaggccgaggtgggtggatcgcttgaggtcaggagttcgagaccagtctggccaacatggcaaaaccctgtctctactaaagatacaaaaaattagccaggtgtggtggcatgcacctgtaatcccagctactcggaaggctgaggcaggagaatcgcttgaacccaggaggcggaggttgcactgagccaagatcatgtcattgcactccagcctgggcaagaagagtgaaactcaatctcaaaaagaaaaaaaaaaaaaagcagcctgtgattacatcaggcacacagggtaatccaggataatctccccatctggggattcttaactttatcacatctgcaaagtctcgtttggcttttaaagtaacatattcacaggttctgggcattaggacataggcatctctgggagggccttgttcagcacaccacagttgtatattttcaccctttcaggcatgaatttgctaggtttcagctcctgcttttgttccttcacaaatccctgatgactactattgaggaggaagggactctgtctctgtctcctttctccaacttgtttttttattttattttattttattttattttattttatttttttaacagagccccttcctacttttgctggcaaggaatgaggtgctgccctttgaccatacaaggtcctacttaccagaggtgcgagcagtacctttagcactgatatacatctgtgggcacttccttatcgtcctacccgccttgtgtctgccagggctgtgttgctttcctggtcctccttcatttgtggggaggaggtttataggatgtttggaaatattgttccatcatctttgttctccaactcagctcttaccagaggcccctgtaaaacaaatctttacttttcagctagataagttggtgctttatttcctacttggacaatatctaatcattcagaagagataattgtgtacccaagcctcatttacaaacccatttctcccctctcatctcccactgctttgctgtgtgagctgtagggatttactgtcctctcctttttttcaaagtaaaagatagagtggctccagtgagaaatatctttacccccatgatctgcataggtcagtggttttcaatccccaagggcttcccccacctccccagggatatttggctatgcttgaaggtgttttggtggtggcaacttgggaaggggattgatgctggcttctagcaggtagagaccagagatacagctaaacattcatcttacaatgcacagaccaccgccctgactacaaaagagaattatctggtccaaatcaacactaacgcttctgttaagaaatcctgacttagggccaaagagcaggaaaaaacattgcaataagtttagtctctttccctaccaatttacttgatcctctccataggagatttgggactattattgcagcacattaataaacaggcagggtctgtctttgtgcttccaaagcttcaaacacaagggcttcctctggtcttgtctgccctcgcacacagcaagtcttccttctcccatcctattgcctacccatgcagcaaaaataataagcaggacgctcctgctgaggacaggaggagtgaggggagattgcctttcactgattactgaagcctgaacttaaagggcctgaaagtgagggctccaaaccagttctgaatgctttgctgtgatttgtactttggtgtattggtaacttgagtgcgaagcataaacaaggatcagtactcagggccatttcttgatttttataatgtcttccaggccatggggagggcaaggctctagttgcagccatgtaaagctttaccttaagtagagctttaccttaagtaaggctgtaagccacaggggcttggagaaatctacagtagatagcagtgaacaagacttcctgggactctatctcagcttgtactgagtgactgctatatgggcaagtcaggtcctcaagccaaaaaacagatggccaaagggaatttttatgctggattggagcagaaaaatcctgcttcttcctatgacagaaaaaagagagagagagagaaaaaaggccactgcttcttaagaggtaagcctcatatgtagttataaaggataattcttcctttaaatgcaaagaaaaataattttaaaattgcttcattgatcgaaaaataactgagtacaaacaagtattcacaccacaaaaggcaaaagccttttttatcttaacgagaatattatcttgttacagttaatagttattggattacccattatgtcccaggcactatttaagggcactgcaaatatattatctaatttaatcttcaccctaactctcagtccaaggttattacatcaattttatagataaggaaatcgagagagagagaggtaaaatcacttgcccaagatcacacagctggtaaagtggcagagaaagaattttgaaccgagatttggctgatcaaatgatcccttgtaaaccctgtcgtattttttttcagatgaatcctccatatttgcattctcacactttattataagagtgacctaaattccactccagtttattttttttgtaatgtcttttatcggttttggtatcagaaaaatgccggactcatacaagaaattgggaaatgtgttttccttttcaaatttctggaagagtttgtgcagaaatgctgttaattattattattattattattattattattattattattattatttttgttgagacggagtcttgctctgttgcccaggctggagtgcagtgccgccatctcgggtcactacaatctccacctcctgggttcacacctttctcctgcctcagcctccccagtagctgggattacaggtgtccaccaccatgcccggctaattttttttatttttagtagagatggggtttcactgttagccaggatggtctcgatctcctgacctcgtgatccgcccaccttggcctcccaaagtgctggggttacaggcgtgagccaccatgcccggcctgctgttaattatttttaaaatgtgtagaagaattcaccagtgaagccatctgagccaaaaattttctttgtggaaagtttttaagctacgattcaattttctttaatggctatagcactattccggtgatttatttcacttaagtgaggtttcattgttacatctttcaagagatttatcaatttcagttgtcagtgaatttatagacacaaagtttataatattcacccaagtatccttttaaatatctgtagaatccgtaatgagattacctgtctcatttttgatattggtatttgtgtcttccttctttttttctgatcagtagggctagatgtttatcaattgtttgatctcaaagaatcagctatttgctttttttctatttcatttggttctgctctgatatttattatatctattcttttgcttattttgaattagtatgctttcagtttaccttgcttttcactttctatttttctaagatggaaactgaggtcattgttttgatacatttataattttctaaggtaggcatttagtactacaaatgtctccctaagtactgctttaatgacaatgtacaccttttgttgtattttcatgtacattcacttaaaggtatcattttcccttttgatttcttctttgacctatgggttatttagaatgacgcaattaagtttccaaatatttgtttttttccagggatctttcagtcattgatttctcatttaattccattatagtcagaaaacagtttggatgacttgaatccttttaactatattggtgcttgtattttggcttttgtattctggcccaggatatagtctatactgataaatgttctgtggagacattcaaaacacactgaaaagaatgtatattccactgctgtggaagggagtgttttataaatgttaattcagtgaagatggttaatagtattactgaagtcttctatatccttgctgattttccattgacttttctgtccattactgagacaagagtttgaaatttctgactataattgtaaaatactttttgcatttctattggtttttgcttcatgcattttcaagctccaagtaactgatccccttattaaggaaccttctttattccttgctgtgaaatctactttctctgatattaatataactactcctgccttttataaaaagtatatgcatggcatatctatttctatccttttatgtttaacctatttgtgtatttacatctaaagggcacttcttgcaggcagcagatggttaggtcttgtttttgaaaatatccacattgacattgctgccttttaataaggatgatcagaccatttaatatgattattaatgtagtttatgtctcatcttgctatttgtttttcattagacctatttgttatttgtttctctttccttctattccttttttaattttttaaattaagttctggggtatatatgcagcatgcaggtttgttacatagatatacacatgccattgtggtttgctgcacccaacaacctgtcatctatgttaggtatttctcctaatgctatctctcccctaaccccccacccaccaacaggccccagtgtgtgatgttcccctccctgtgtccatgtgttctcattgttcaattcccacttaggagtgagaacatgtggtgtttggttttctgttcctgtgttagtttgctgagaatgataatttccagcttcatccatgtccctgcaaaggacatgaactcatccttttttatagttgcatagttttccatggtatgtatgtgccacattttctttatccagtctatcattgatggacatttgggttggtcccaagtctttgctattgtgaatagtgtcacaataaacatacgtgtgcacgtgtctttatagtggaatgatttataatcctttgggtatatacccagtaatgggattgctgggtcaaatggcatttctggttctagatccttgaggaatagccacactgtcttccacaatggttgaactaatttacactcccaccaactgtgtaaaagcgttcctatttcttcacatcctctccagcatctgttgtttcctgaccttttaatgatcaccattctaactggtgtgtgatggtatctcactgtggttttgatttgcatttctctaatgaccagtgatgatgagctttttttcatatgtttgttggctgcataaatgtcttcttttgagaagtgtctatttatatccttcggccactttttggtggggttgtttttttttttttttttttttgtaaatttgtttaagttccttgtagattctggatattagccctttgtcagatggatagattgcaaaaattttctcccattctgttggttgcctgttcactctggtgatagtttcttttgctgtgtagaagctccttaattagatcccatttgtcaattttggcttttgttgccattgtttttggtgtttcagtcacaaagtctttgcccatgcctatgtcctgaatggcattgcctaggttttcttctagggtttttacgattttaggtcttacgtttaagtctttaatccatcttgagttaatttttgtataaggtgtaaagaaggggtccagtttcagttttctgcatatggtctgccagttttcccaacaccatttattaaatagggaatcctttctccattgcttgtttttgtcaggtttgtcaaagatcagatgttcaacatacgtgcaaatcaataaacataatccatcacatacacagaaccaatgacaaaaaccacatgattatctcaatagatgcagaaaaggccttcgacaaaattcaacagctcttcatgctaaaaactctcaataaactaggtatggatggaatgtatctcaaaataataagtgctatttatgacaaacccacagccaatatcatactgaatgggcaaaacctggaagcattccctttgaaaaccagaacaagacaaggatgacctctctcaccactcctattcaacatagtattagaagttctggccagggcaatcaggcaagagaaagaaataaagggtattcaataggaagagaggaagtctaattgtctctgtttgcagatgacatgattgtatgtttagaaaaccccatcgtctcagtccaaaatctccttaagctgataagcaacttcagcaaagtcacaggatacaaaatcaatgtgcaaaaatcacaagcattcctatacaccaataatagacaaacagagccaaatcataagtgaactctgactcacaattgctataaagagaataaaatacagagccaaatcataaatgaactccgattcacaattgttataaagggaataaaatacctaggactacaactcccaagagatgtgaaggacctcttcaaggagaactacaaaccactgctcaaagaaataagagaggacacaaacaaatggaaacacattccatgctcatggataggaagaatcaatatcatgaaaatggccatactgcccaaagcaatttatagattcaatgctatcctcaagataccattgactttcttcacagaattaggaaaaaactactttaaattttatacagaaccaaaaaagagcccatatagccaagacaatcctaagcaaaaagaacaaagctggaggcatcatgctacctgacttcaaaccatattacaaggcaacagtaaccaatacagcatggtactggtaccaaaacagatatatagaccaatggaacagaacagaggcctcagaaataatgccacacatctacaaccttattccttaagagtattttacaacttcattttttataaaataagttttattgagatataactcacatactatcaaattcagttttttaagtgtacaattcagtgggttttattaaattcagacttgctcaacatcactactatctaatttcaaggcatttttctcatcccccaaagaaatcccatacccattatgcagttattcttcttttccccttatcccctctggcaaccactattctacattttctctctttggatttgcctattctggatattttacattaatggaatcataaaatatgtgagtttttgtgacagtattcttttacttagcataatgttttcaacgttcatctgtggtatagcatgtatcagtgcttcatgcctttcctttttgtattccttttattttttatttgcattccttaatattcctttttgtatagataggtcacattttacttttttaattcataagttgatgaacatttaggttgtttcaattttttaagtagtgtgaataatgttgctatacacattaatgtacacatttttgtgtggacatatgttttcagatctcttggatatgtacctaggagtagaaatgctgtcatataaagccacgtttaacagcttgagaaattatcaaagtgctttccaaagttcctgcaccgttttacaattccatcagtaattaaggttctaatttctctacattctcaccaacatttgttattgtctgtcttttaaaaaacagtcatcataacaggtgtgaagtaatattccattatagcttagttttgagtttccttaatgattaatgatattgaacaacttcttgtgtgcttattggccatttatcttttttgaagaaatgcctactcaaatcctttctccattcttgaattgagttgctttaattgttgagtcaaaagatttctttttattatacattctggatacaaagtccttatctgatacagaatttgtaaacattatctcccattctgtggtttgccttttacccatttcgatggtcttttttaaagcacgaaagttttcagctttgatgaagttcaatttatctattctgtcactcatcttttttttttttttggtgtcatatctaagaaggctttgcctaccacatgttacaaagatatacgcctatatacttcctaggagttttatattaactcccgtatttaggttgataacagatcttgagttaatttttgcatatggtatgcaaaatttattcttttacctgtgagtatcaaattgtccaacatcattcgttgaaaaggctgttcttttcccattaaattattttggcacctttatcaaaaagtaagttgactataaacgtaagagtttattttgaggctgggtgcagtggctcatgcctgtaatcccagcacttcggaaggccgaggtgggcagatcacaaggtcaggagatcgagatcatcctggctaacactgtgaaaccgcgtctttactaaaaatacaaaaaaaaaaaaaaaaaaaaaaaaaaagccaggcatggtggcaggcacctgtagtcctagctactcaggaggctgaggcaggagaaaggtgtgaacccgggaggcagagcttgcagtgagctgagatctacactgcagcctggggtgacagagcgagacttcatctaaaaaaaaaaaagagtttattttgggactgtcaattccattccattgatctgtatgtttagccttatgccagtaccgcattgtcttgattactacagctctgaagcaagttttgaagttaagaagtgttaagtccaactttcctctttcaagattgttttggttattctgggccatataaaatttctaattatcttgtcaatttctgaaaaaaaaatcccactggtatagtgataatgaaatgggagagttccctgacccccgccccatctcaggacctgtgacaggggtgtgactcgtcttttcagccaccacctctgttcaaaccccttatgggagggggagtatgcagacaggcaggtgcaggagctggggtgagcacttctgggctttggccccatagtagcatctaggagtgggtgcctacaactcccaaagcccaagtgggcatgtgttatagtgcactcttttagctttgccatccgtggatggtgtaggtgttaaacagctcagtggaccctctgccttttcacgagggcagagggccagtgcgacagttttctgtatcccgagctcttgtccagcatccaggaaaaatcaggtcacacaacgactcgaaggatggtgaatgcaggggttttattgagtgatgggggtggctctcagtgggatggatggggagctggaaaggggatggagaagatgatcttcccctgcacattggctgtccagcagccgatctcctctctgaccatccccagctgaactcctcttgatgttcagacattccttttcttctctccttctcttctgttcttctgctcttctgttcatttgctcatctgtgcttggagcctggggtttggggtttatgcgggtatgggatagaggggtatggtgggccaagaggcaacatttgggtacaaaaataagaatgcctgttcccatttagggccacaggtttccaggcttgagggtggggcctttgccggggaactgtcctcttctacctctgtctcctgtctgtatcagtgagaattgaatgaaatctttagatcattttggagagtgtggtaggtagaattatgacccccaaaagtatatgtcctaaactctgtaaactgtgaatgtgttatcttacatggcaaaagcaacattgtagatgtgattgagaatgttcatcatgatgggctcaatgtaatcacaagtgtcttttataagagggagaaagaacggtagatttagagaaggagatgtaatgaggaagtagatatcagagtgatatagtcccaaactataccacctggtcccaggatttaatttgtaggattttttttttataagcctcagcatcccaagtatctgggattataggctcctgccaccatacctggttcatttttgtattttaaaaaaaggaatctgtcgattttacatagattatctaatctgttgttatacatgtgttcacaatatttgaattctttttatttctgtaaactcagtagtaatgttccctgtttcattcctgatttcagcaatttgaggctaccccctttttcctcggtcagtcaaagttaaggcttgccaatttttttaatctttccaaaaatcaatttttgatttattgactttctctactgtttttgttatgctctgtgttatttatttatactctcatctttgctatttttctccttctgcttttttaggtttagtttgctctttgtcaaatgaatgagccacagatggcctctgcatattagcccctaggttgtttgtttcttcactgcaggctgagacctgttagctcaaaacccctccagcatcaaactcaaatttttacgtagccgtttgttttaaaaatagcccaaacaaatagctttgtagctatttagggtctgtttgctttgcatgccctatgaaatctcattttgcattggtattggctaatttatgtcctcccaaaattcatatatttaagtcctaacccctaatacctcagaatgtaagtgtatttggagatcacacctttaaagtggtgattaaggtaaaataaagtcatagggtaaactctactgtaatccaatatgtccgtcatccttataagaaaagaagactaagatacagacagaacaggctaaggaatgactatgtgaggacatggtgagaaggcagccatttgcccagcaaagagtgaggcctcagaagaaaccaaacttgctgacatcttgatcttggacttctagcttcgagaacctctgggaaatacatttatgtgtttcgtttgtttgttttgttttgttttgttttgttttgttttgtttgagacggagtctcgctgtgttgtcccggctggagtgcagtggcgccatctcggctcactgcaagctccgcctcccgggttcacgccattcgcctaagcctccagagtagctgggattacaggcgcccaccaccacgcccggctaatttttcgtatttttagtagagatggggtttcaccgtgttagccaggatagtctcgctctcctgacctcgtgatccgcccgcctcggcctcccagcgtgctgggattacaggcgtgagccaccgcgaccggcccatttctgttttttaagctgttcagtctgtggtgttttctgatggcagccttagcaaattaatacccacatctgctagcaatggataagataaagccttgtagttataagactccaagctgctactgctcttgggagctttcagatgtaaagacggcctgctataatactgaggatgttacctacatatgtaaactctttctccccaacccccttcttcctagaagtaaccttgcccccatttcctttagaatggtggcctcctaggattaaacctcgggaatgtctcatgttgccagcaacttcctctcctaggcaattctgtcaaagcaccaccttataaagcctgtgtgttactgtcatggacagccctgaaactccttgaattctaccccgacactcctttttactctagctttttaaggtggaaggttaggcttttaattggacatcctcttctcctcttgaacaacaccctttttttcaagaatacctgttcataccatatattcctctctgaacactgatttaggtttatcccataagttttggcacattgtggttttattttcactcatcttaacgtattttctaatctcctttgtgatttcttctttggttgttttaggagtatattttaaaattccaagtattataaaatttctaaatttctccctgttaatgatttccaactgcattctatggtagtcagaaaacattttgtattatttcaatcattttaaatttattgagacttgttttgttgcctaacgtatggtctatcttggagaatgtttcatctgcacttaaggaaaatgtgcattctgttgctgtggggtggaacattctatactatctactagtattgttcaagtcttctgttttcttattgattgtttgtgtaattgccctgtccattattaaaagtgggtattgaattcttcaactattattgctgaactgtcaatttctcttttcagttctattagttttaaaatatatttctggggtctctgttgttaggtatatatgtattgcaacttttatatcttcttgatggatagacccatttatcattataaaatatttttgtctctagtaacaattttttgtcttaagtctattttgtctaatattagcatcatcattccagctatcttttgatcacatttgcaaagcatatctttttccattcttttattttcaacataccatgtctttgaattcaagtatgtatcttattctcagcatatagttggataatgctctttaaaaaatctattcttccaatctctgctttttaatattaatatttccttttaatgtaattattgctatagtaagatttatgcctaccattctgatatttgttttttatgtgtcttatgtcttttgtttataaatttcctccattactgtctcatatgaaatcgttattttcttgcacgatattttatttcccttgtcatttctttacacaccccccaccaccgcacacacacaaacacaaacacataaacatatacctacatgcattttagttattttcttagtggctgtcttggagattataatcaatatcttaatttataataatatagtttagattaacctcaatgtattataatagcacataaaaattttgctcctatatagtttggttcactttctttgctgtgttatcatactaattacatctttatgctttctatacctgttaatacagatttataattattgctatataaagttgtaaatcagatatgagaaaataaggctgacaaacaaaaacacatttatattgtcttttatatttacctatgtagttacttttatcagcattctttatttcttcatgtggatttgagttactgcttaatgtgtttaatttcaacccgaaagattccctttagtatttcttgtaggacagatctgctagtgacaaagtctatcagtttttgtacatcttggaatgtcttcatttctccttcatttttaaaggacagttttgctggatgtaaaagtcttggttgacattcttttttgtattttcaaatgtcacctcactgccttctggactacatggtttcgggtgagaaataagctgttaatctaattgagaatcccttgtatgtgatgagtcacttctctcttgttgctttcaagattctctttgtttttgtcttttaacagtttgataatgttttatgtgtgtatctctttgtgtttatcctagctggagttcaccaaatctccaggacgtggaaggatgtaaatgtatgtttttcatacaatgtgtgaattaagaacatgatacatttaaacgttccttctgcatctctctctctctctccttctgggttatcagtatgtgcatgttggtatatttgatggtgtcccacaggtttctaagtcttttttcttctttttttttcattcctttttctttctgttcctcagactggatagtcccatttaaactattaatactattactgtatttgagtttactgactattccttctgtctgctcaaatgtgctgttgactcctttttgaatatttcacttcagttacagttactttcagctcaagaattttaattctttatattgatctttctttattgatattctctctgtagtgagatactgctttcatattttcctttatttctttagacatggttttcttcagttctttgaacatactcaagatagcttatttacagtgtttgccttgtaggcccaacatccgggcttcctcatggacaacttttattgactattttgtcattgcatatattgtgtctggttctgttcttgttggttttagatgttttcaaactaaattgtattaatgttattttatcttgtttgaatgaagaattgatgatgttcaaaataaattttcaagatagttcataagacacaactgggctgggcatggtggctcacacttgtaatcccagcactttgggaggctgaggtgggcagatcacttgaggtcaggagtttgagaccagcctggccaacatggtgaaaccctgtctctactaaaaatacaaaaatcagctggacgtgttggcacgtgcctgtagtcccagctacttgggaggctggggcaggagaatcacttgaacctgggaggcggagggtgcagtgagctgagatcatgtcattgcactccagcctgggtgtcgcagtgagactcagcctaaaaaaaaaaaaaaaaaaaaaaagacaactgtctgtgtgctatttgttcagtctctgttagtgcactgcatccaaacaacaacaacaaattagtgagtcatcaacaagaattagcagctatcaacagaggaaaagttgtctttttacagaaggataaggtggaggacacaaaccatgcaagccaagaagctaatctagtaactgtgattcttttctctctccctttctctaagcccacctcaactgatcatctgatcgctgaactgaggcatagttaggccatgggaggggccatgaagatatatgtgaaccttaccaatctgggatatgttttcaaatgatgatgaagagtaaaattctagcctcagcatctcctttggtgaattccaaaaaaagtccattgatctttcagaaaaaagaccttgatctgaataaggaggtggagaatctcagaaatctccctggagaactgggaaatatgtaaggaataaagtagacagggtctcaatgggagtaggtaggggcaagtagaagaggaagaaagtaatgaataatctcagctccttaaactcttttctcattgctgattcagccctttctttcctattctctctttccatcttctgatttgtttaaccattcaacaaaattacactggaaatggaggatgtggaggtaaacaaaaccaactcactaaatagcaacaacagcaacaaaccaatccctgccccagtagagcttacagaccttaattaaataaactttcctatttaaaaagtgctacaggggcatacaagagcttataacaaacagatggcctagatttactatatcggggggaggaggttgacaacagagtgacttgctcagagagcagaaatgtggaagaaaaaggagggattaattcaatgaagcaggtgaggtcaacacttcatgcagaggtacccaccacgcataggccaggaagcaagaaactgatttcagtcctgactccagattttcatcccagagcatgttgggggattggaggaagagatctttgtttgtcaccatgatcttggaggtcttgacatgatgctggagtcatggggggcttgcttgcttgcttttggaagccaaatgtctgtctctctatcctcttctgactctcaccccaacccagatcagtttctgccacgcagtgggtccaaccagtgcctggattcagttcgctggcccctagcatgtgaattgactgacattcttgagcacattattttttctctaattaggcagtatacctgtactgccagtggcttctcctgagcctatggagccacaggaggtcacattaacagtcttggtataataagtcattgccatgcaagctgaaggcaattaatcctaaaatttggaactgttcgagattaattccactaaactatattgtgaaaccagggcaaaaaaaatatatactaccatttatacctggtgctttttgtttcatgacctcatttacttcttaaaaccaacatttcaattaggcagtattgctattttccttttcaaatgaagaaactatgcccagagaggtctgtggaactcacacagcatcagtgctagagttggcatcctagtccatgactaagttctttctgcaatcctatgtgagttatgcttctggtactctgcactgtatttcacactcaaaacttaactattattatctcattatcaccagagaattgatgcagcactctgacagctatgatttcttttcttttttttcttttattttgtggtctctatgtaaataaaatcttttcaccctaatggctgtcctgacactgccaaatctctgatccacggggagacacagggagtctctgtccagagctatcttcctcccagaagagctaacgaggaaaaaaagtaacagaaggtaacttgctgatcctaattactttgcccgttgtacatgtctcagatcaaataccattttgtcctctttttcccctttagggagaattaattaagctctaattacatcgacagaaaaaatagaagctacaataaaattattttttttttaaaaaagctattaacaaggtctgagcacagagcttgttataacctggggagtgagcctcatttgaattttatggcctttgcttttacatttttttattaaaccttttcttaaaatcctcaatatgtcttctttccatggtataatctttcttgggaatttgcaggtgttaaattagatgcttggggctctcttaccctccctgcattcagtcagagtatggtgtatcccgtgaggcagattaatcatttttttaactgatttataagttcacactcagtttttttttctatctggaataaaatctgacgcacagagcccctctggttcaggcaaattgagccaatgttttccttgttagagaaaaaaattaaaaagcttattccaatcagcacatctcactgcaaaaagggagttcaattctttctccctgtcaaatggaatccagccatgcagaccgggctgtgatgatgtgaagatggaaagaaccttcccactcagagagtgagaggtcctcttaccctacaagacgcacattactgacctgaaggtcagagcttgaaaagtaaactatccgaggaggagatgtgacctaccaccgggtaacgcgatgcagggcagaactccacctcaaagctagaccctggacctgcccagcagttcttctaccaacatagctgggccacctgggtaaggtgtttagaattcagattctcatctcagtcctagatctactgaatcagaacctctatgagtgggatcctggaatttgtatttttcaaagccctcagggagattctgatgactagcaaggcccaggagtcatctgattaaaatagtaagactagctgcaaaacactaattttcagggaaggggaacacactaggtattccaaatagcagagaaggagacatactcccaagaaactggagattttagccaaggtggcttcctaaaggggaatttctctggaatctttttgttggtcttaaaaattgatataattttggattccattctaacggtgacatatatacaaatagatgtatatacacgcatatacagatactcttatacatattcatacatatatatctgtgtgtatatatgtgtatgtacaattgtgtgtatgtgtgtatctgttacattgcctagaacagcccacgctatagtcagaggacacatacagtctttcccaagatttctacaaatccctggtggggttgaacgtgtgagtacttatatcctgatatggtttggctgtgtccccacccaaatctcatcttgaattacagtttccataaaccccacgtgtcacgggagggacctggtgggaggtaattgaatcataggggcagtaactcccatgctgttctcatgatagtgcgttctcatgagatttgatggtttttacaaggggcttttctccctttgctcgacacttcactctcctgtcaccatgtgaagaaggatacgtttgcttccccttctgccaagattataagtttcctgaggccttcccagccatgcagaactatttgtttgttctatttctagatcctttcaccatttcatgggtatcatctctaatttttcatgcacataaagtgagcctgcatttgatttccactaaaatccattctcataaggtattgttttatacagtacactctcataaagagtattttggggagaaatgcatgggtgaggggcagtgatgtgctggatctggctaatacagggccatgagagccagccattaaatttttaggaattttgcaatccagttgttaagcaaaaccatgattaaatattatataaggttgtaattaagttgtacaattaataaaggtagtaagtattagaagctcatcacttactagctgttttactacattttattcttacctatgcccttgaagttatttgtatctactgtatttgtgtagtagaaatacaattaaatgtgttgctattgcccatctctacccaattctgtgtttagtgattatacatgggtaacctgagattggccatagcaagagtatttacatcacagaaattggcaaatgctacaaatctaggcttgatttattgctctgctgattgcctggacctaaaaattaatggataatatgttaataatgtccataagcttaaatgtgtcatgtctatagccactgcattgtcaatagtataaaaactgaagacattttttcagcatttaaaaactttttgctgattcagcaaagaagtcattcacatcattgacaaatgagtgaagttctaatatatgttttctttgtttcccttgtatcttattcattaatatataacattaaccaacattcatgttgaaactacacttgcattcaagatttgtagcctgattttatcaagtgatggttgaattgcaatcttagatcagttatacatataagaattctgcaaaaaccaagaaagtgttctgtaagtatcagctggctatatgacaaagaatactgtaaaatttattattataaactgtttgttacatattctttaggtcagtaaagtttctaagaaacttaagtatgtttccccagagacctagttgttaagcatttaccagtctcccacaagagtttatattacaccaacataaacatattgaatagtaaatgtcctttgatatatatacatgctttcacacctcattggtggtaattgttcttctcatcaggtgcaaaaactaattcccttcatcttctgcaagctgtttagtcatctctttcattggattactagataattgcaggttcccacccaaacctccatgtccttttctcccatcaagagcatgcggatctttcattggtggttacatccctcttccattcccagtcctattgtttgggtagatttaactccattctccagttacaggaattgactctgcaagcttaagccaatcagtgggttccagctctctggccacagtgattggtgcggagttgagcacatgacccaatttgggccaatgagagagaggaaatctcaaaattgtagttgaaaatattaaaagagagctatgagttttctctggacaatgtattataagataggaacaactttatccattttattatcacaggaagagagctaagagctgaagggaaagaaaccaccagaacccaagaatgaggccaaatccatagaacataaacagaatagagaacaacctaggtccatggtaaaatcacttgagctactagatgaagctttacctgaccagatcttcctggggtttaggtacaagtatgaataaatctcctttgtttttaaggcccatttgagttgggttttcaatcacttggaaccaaaaagatccttaacttttatatttgtcttgactcttaagctcaggggccttactttccattccaaggctaatcaagcctttcggtaaaagataggtaatttcttccctaagagagattctcctcaaactaataaagtaaaacatttttaaccccactagacaaaagtagtgtttctaataacttattgccaagcaaaatgaacattctagaactttgcaccatatttgttccatggcttcctacaacttgctagcacaggattacacacacatatatatatatatatactatagggatgtgcatactttagattgagaagtgtggcactgaagcatgaagccaccatttacatttcagggaaaattattttttcaatgatttgcttaaacaagaattcttggttgaatatccatgtgttttatgcggtcacagggtaggatattgagagaactggatgtagaatgcagcagtttgagggaggtgtagtgtgatgatgatgatgctaatagcaaaaactttcatagttcttgctacgtgccaggctgtgttaagtgatctccatgaattaatcctcatttccatacccagtttacaggtgatgaaatggaaatgctagcttaacttcatacaccttggttcctgagtctgtgctctaaccagtaggttgtactgcttctccactgtgtgcttaagacaaagttgggaaaatggaaatgaatttggatccattcataggaactggtgagtccaggtcaggatctgcctttggggctctgagagttgtagagtcacagtattcacaaaagatgcctaactcatgccagcaaagcagacaacagaccaaatacaattcatgcttgaagaggactggagttagaatcagagaggcagccaagagcaccatttccacagagcaagataaggctatcaacagtcaaggatcagacagcaagaagatgtggacatgtcagccaatggagcggaagggctgaagataccagctcagaatggagactaaacaatgagagggcaccaaaggatgatttttttaatgtatcaaataaagaaaagtctgatggttaaaggctatgcacttagatagaggggtactgtactagataatcattgtcatagtaatgctaggtaagaaaccatgccaagactcagtagcatccaaccacaaacattcatttcttgttcacagatttgtgggccagctggggttcagcacatctaggctatgctctgcttgaagcagcaaactgggttcagatccattctacatatctctcatcctcttcggaccagcaggaaagccagggcaggcttatataacagcattgacaaaagcaagtttatactagtgtatttcaaccaaccaaaccatatgagtttggttgaccaaaaccaactcatatggccaacctcaaagacatcggacactgtgtgccatatatgaggatatggcaaggaaggtagatttagtcctgatactatcctaggagaggaagtaattaagactaacaactaaatctactctagtgcattagtccattttgaattgctataaaggaatgtctgagactgggtaatgtatttaatttaattaatttattcatttttgagacagagtcgctctgtcacccaggctggagtgcagtggcacaatctcgtcttactgtaaactccgcctcccaggttcaagtgattctcctgcttcagtctcccaaggagctgagactgcaggtatgcaccaccatacctggctaatttttctacttttagtagagacggggtttcgctgtcatggccaggctggtctcaaactcctgacctcaagtgatctgcccaccccggcctcccaaagtgctgggattacaggcgtgagctactgcatccagcctgagcctgggtaattaataaagacaagaggtttatttgactcacaggtccacagactatacaagtatgacaccagcatctgcttctagtgaggtgacaggaagcttttactcatagtggaagggaagagggagcaggtgggtcacatagcaagggagggagcaagggagaaaggagaagcctccaggctcttaaacaaccagctcccatatgaactaacagggcaagaactcactcattactgcaaggatggcaccaacccattcatgagggatccacccccatgacccaatacctcccatgaggccccacctccaacactggaggtctcatctccacatgaaatttaggggggacacacattcaaaccatatcatacagacccaaaagaaaaacagagtttgttttacagtgatataagggtctaccctaaagaaggaagcaaggtgtgaggcagtgtccttggcattggagaaggagactggggaagtacccatcaaggtgatgaggtatatgagagaatggcagaggagaatagggggaggcggggatgcttttcccaggtcttgatggacatcactagatgggccatggctatttctaaggtagctcagtgggaagaatcactcaagattcaattgaaattgtgttcaggccagttataaactagtaaagatgcaatggtagaggttatagattgagacttaggtttcttccttttctggaaggatcctcagatcgccttactgtggatctaacatagccagcccaagagatgattaaatttgtgttctgttgggctatgtcagggtcaagttttaaaggaagcatgcagtgattcagaaggattgtgtttccttgtcaatttcacctcttgcttcttgaaggagcctttctagtcttttcttggccaccagagaatgcagccatgaacaaagttagatggcccatcatttatgtcaggaagttgtgaatgcagatttgctgagctaattcacccagattatctcagcaaatctgcatgcacaactttctcagttaaatgatctttactacctatgtcgggctgtctgaatctgaaattatacccaatattccttggggctcaggacattatagttagcttttgctggatatcagagctttacatataataaatgtcaacatctgacaccttaaaaaaaaaaaaaaccccaccagatactgttttagagcagtaactctcaaccctgtctggatgttagaatcatcttagaagctgtaatatcacagatgcctggggccctccccagactaattaaatcaggatctcaaggtagaggaagtgcctggacttttttaaatttttgttaagctctccagttgtttctaatatgtagccaggtgtaaaaaccactattttagactctctcatttaatcagcatgatgctgtattggtctggtgacttctcttataaaattcactgtgaaaatataaaatatgttcatgttcattctgtgttcgttgaagaatggaactatttgtgaagatcaacacgtttctttgctctgaaagtttgcaacagtttttagccaacagcaaggtggaggcatattttttaaatcaaaacattaataataaataattatgatgatgaccatgatgatgataaagtgtcaggacacctgggccaactgctgtcagacacaggatgttgtaactttttctcttttcccttcaggaattgtgtgcatttattgataaacatggaggcttttgttttagaatcaaggaataacggggggcagatgtgttgctagataaaatgccagcaggagaaattctttgaccatggatgggaccgcttgatgtctaccttctccttcttagagtgcacatttcttgcatgtgctacaagtgtacaaactaccttgtcttaggggatttttgagctctggatattttcagagctatttcatgggcagatgataaagtataaggtacaactggggagaagcccattctctcttctgatctgagacctctggagcagcactgatcagaaatagccgcccccatttcacagctgagactcagataaagtcagagatttgcccagcatcactcaccaaggagggatggagctgggatttaaacccagatcttccaaacaacaaattctctgctcatttcaagatagaaaaccatggtattttggggaactgggaataaaacaatagagggttctgtggttttttgtttttttttttgtttttttttttttagttaatatctccctgacattagtttctctgggcacttaggagtggctctctgtgttaagaaatctcttcatgttgtttcaaagacatccgcaagccctgtgacttcattctcaagcaacaggccactgctgtggaaaggacatgaaaccagctcatttttgcaacaaagaatggaaaaccttccctgccagaatggttcataccttttagtttttccactggggagtggaaacagtaagggaagaagcagagatgtggggcttcaactccctgtctctaccactgttgcttttccttgggaccagggacttccccgactccccacagttgccttgggaatcatccctccaggaaagaactgacactgcattcattttcctgccaggaagctcttggatggctaggagtttgcaggggatggccaggttggagaatttattttcaaagttgacctcaacttggaaatcctggccctgagctgcggggagtcgtctggtcgtccgcttgcattctgtcctgatttctttctcatgctctgagttggcttggttacagttttacttttcatttttcctccatgtctcccaaatgtagtcttggcacactctcctctattataaacctcattttgccataatcaggggttaattagataggcatcctcagattccactgcaacattctgatcagtgaacctgactggtgccaaggaagtcggtggacatgccagcagggcagaaacacaactctctgctacaaatgcatgtacagtatattatcctaaatttcttagtatgtttgtgaagcgccaagagtagtatgggagatcatattctgaaacaaaaggcaagggttgggagagaaaaaacagctttttgatgacaaagcaaattgttccacattgctgatttacccaagagattattctgcattatctattattggaatggaatgtcaaaatatttcttttcctcaaacatgttagaggttgcaaaactcatttacattgaaaatatctggccatgattcctcagctaaggaaataaccatctccaaagttatctgtggaagtcagggagccaataatgtttggctactgtgacgtttgtttggcttaatgggttccttcctgagaatctgatgtcttttccacctgctcaggctacagtggaattgaaactgacatacttctacccacaggtccctttcttctctgtagattatatgaaaaatgtgcccaattgcaattctctcattatgttcactcacctaacactgagcaaatgtctctttgaggatctgttgtctgccaagtaccccattttctctttcagcctttttcgctgctttttcatcttccagtatccctgaaagtttagagggagaccttattctgtcctgaatgtcccaggtccaccctgatatgcagcctccaggaatcagctctgggtcctattcccctcattctccccacgccacccccatcctccgccatagccccttctatgcaggcccgcattacaatgcagtgagaagaaaaatgacagtcatcgtgcaaaaaaaagaaaaaaaaaaccctaaatttaatgaacatttaactctgtctagggcctcaattgcactgcaaagacacataagtcatgtttcctgttgtctagggtggacaatctaatgaggaagatgcacccatacccagtgtgctatttcaaatcctcggcaacatgtatgtcatcacacccacaaatcagaacaaacaatggcttccagcactggagcagacccctgcagactcagtgacccaggcaacagcattctatgtgcaagataccggaaaatcttcggtgaatggctgggatgatacaggaggtgaagggggcactagagagatgggagagcaggtatttaccaatcagaatggaggtatttcaatctgtaactaagttagatgactgtgttagtgctcaccagctgagcaacagcccttctggaaccgaagcattgggagtaagcctgtctgtgcatctgatgccacctgggtcacctgataaaaaatcagattctatgtcctccattcagattcaaatttgatgattttaggctgagtctgggaataggtacattagcaaaagtcttcagtgacttcaacttggaaatgactgttaacatgccgggcaagagggtaggctttgcagtttggcaggtctgggtcagtactctggctctgacgctggcttaatctttgaggctcactttactcatctgtaagatggttgtaatgatgacgtttgtgaggattatttgagaaaatatttctgaaatgcttagcccagacctgacatagaaaagatagtaagtctgtatctccccattcctcatccaaaacaaaccaaaaggaaaactctaactgaactttctaagatgcattataggaagcaagactcctgggacccaccctatttcaaataagtcaatatttctcaaggcgagaatttacattttaaacaagcacccgacatcattcttatattcactaattaaaaataaatattgctgcagttggagaaaaaataaacagtcacctcatatcacaaaagcggggtgctgctgctctgtcaacacaggcaggttcttctaaacacagagagcatgaatgatggaggctctggaggaccaggggctctagcaccgagtctgctcgtcagtacgctccctgcatcttgcatccactcccgtgggggatgtttaacctcatttaaatacagacatgaacccccttccctcctggcacaccgtgaagaagaaatgagctaatggatatgcagtgttcatgcctaagagagcattctaattaatgacataaatcaatagtcccatgggttgggtagaaggctttcatttattttcttctttaaattttactaacattttatttatttatcactcttttcccaactataaaaatcctatgacaatggtggaacaagtgaaaaataggaaaagaacataaagtggttaaaaaatgttacttatccaggtacaatgactacatcatcaaaagggctttccaggccaggagttcgagaccatcctggccaacatggcaaaaccctgtctctactaaaaatacaaaaaatttagttgagtgtggcagtgggcacccgtaatcccagctactcaggaggctgaggctggaaaatcgcttgaacccgggaggcagaggttgcagtgagccaagatcgcaccactgcactgcagcctgggtgacaagagcaaaacttcatctcaaaaaaaaaaaaaaagaaaaagaaaaaataaaaagggctttcctgtgaaatcaaagaagatgagtatcttcttacaccatgcctagaaagaaagaaagaaacagtatagcacagtggtcaaagacatgagctctcgtctgagttctaccacgtgcaatgtgacctttagccaacttactttacattttttgcctcagttttctcagtaaggtgggtgtaatggtattccctactggataaaggactcacaataaataatacgatataataaaatgtgtaaagctctttaaactgctcaaaagacattaggctattatttcaataatacgttttgatcaagggagaaaaatagggtcagaaaacccgattgtgtataggtgttgtctattctgatgggtcagtttgtaaatatttcggctgtcatcctgggaataatagttgcagctaatattattgagcttttacagtggccagccactattctaaaagtatttagccctcaaaatagctttctgagattggggatataaagtccctatcctattctactgttttctaattttttctttcttacctgaaaagtccacctgtcaaagaaactgattccggctcaaatcacaccattgccatccagatgagcacacctagagggacattttcgtctccgctgttgtttgagggagtgatgtttgtgatgtcacttttgattgtttgctgcatgactaatcttaaatatttgtttaatatgcaaatgatacctcccaatgacagctccagggaaacggcagatgtctttccctgaaaatgacacagcctcactgctgctcgcactcagttactgacactgtgttgcttcaactcagagctttgatatacccagtttcattgcaaacgcactgacttccagcaaaaaaaggccactgttagcacatacaacacctttgtgagaattagaaaactgtgcttcctctggacagataaattagaagaaagtaccaccattaccactcccccaccgcctagtagaaaattagaaaaagctattcccatctcagtggctaacacaggaaaaactacccttctggatgtacctaatatcaaagggtacatggcttggggagtagagaaccagctaccttttgggccactacttaccttcttggccagacatccttgttcagtgcacgacctgcaaaaccatatatggcaaccctgatccagagtcctaagatttttgtgcttctgaatttctacatattgtggaataaaaatgttatttcaacagattggcatcaaagaccctcttaggaaccaagcttgataggaaaatgctttgatgggctactttatgtgcagaaagacccctcatggaagaagatggctttataggtagagtctctctctggttaacaggaatttggtaggaggcaggtggaggatggttaggctgagataagaggagaggaatgagaaacgaaaagggaactaagtaacgggaagatggcacctgtagagtgataagttcctgatggcaaggtggtcagagggctttttttttttttttttgacaaggatgtctaatattccagtttaggttttagggaggttatcacacaaatctcttctgttgccttaaagctttaccaccaatctgacaaatataaccttgactcaggccagtgcttgcaaaacagccaagtgaccccaaaactgatctaattcacaaaaggagaaacacaaatgcagagtgatccgagaagcctaattcatagaagctgctctgcaccatactgctgagagtccttgagggatgggaagagactctggctctcccaccatatatggagtaaaggtagagtcaatttcacttaaatttcaagggataaggtaaccccagcagacatcaagtttacacatgtcagcaatgatcatggagctttggctgtcatctctctacttctgtctgaattgtgatcatcatagttcatagctaccaagtgtctaataggtaccaagagctgaatatgtatgattttaaacttcaaaacaaacttagcgagatgagtatgtccacatttgagagttaatggccttggaggtaagttacatgttcaaattacagaagtgttaggtaacagagctaaaagatgaacccaaatctctccagctccagagacaaactacctttcagtgtcttgtgggagtgaattcgtatctgcttaaactgtcctttccaaccactttagaagaagagcaagttcctggggctgaatgtgggaaatacttatagctggaaacccacacatgtgagcaattttccgttaccagaataaaatcttgctaattttggagataggccaggctaaactgggtaagaatctgaattttaagatggttcttaaggcaagtataagtgtaggatatataggacagttaacagttgagtcccctgtgttggtattagttctggtatgagtttaaggaatgtgagaatcagacccagatggagaccaggaagggaaatgccttcctccagcaagaatggaggctttgttgagtcccaatttcttcttcccagccggcattcccttaactctaggagtacttagcctggtgtttggagagagtaattgctttcatttatgtgaagagcatgcagcatatgcaatgtgtgcctaattaccctgaagcatggcaacaatgatgcttatcattaaataggggctggatcaccttcgttagaagtttttcttgatgtcaacactacattccgtcatgcatgtttagacttcatggctttttaaatcatgttgtagtgtggttacaatgaagataaaagctagaggaaaacactccatgcaggaatgccaaggagcaggagaaggaaaatactgttttccatgtgccagacacactgtggcagaggcagtggcttttcatgttgacaaccgaatatctggcactgttttctttttaagttctgggacacatgtacaggatgtgcaggcttattacataggtaaacatgtgccatcgtgttttgctgcatctatcaacccatcacctagatattaagccccacatatattagctatttatcgtgatgctctccctccctgccccacggcaggccccagtgtgtgttgttcccctccctgtttccatgtgttctcattgtccagctcccatttatgagtgagaacatgcagtgtttggttttctgttcctgcgttagtttgctgaggatgatggcttccggctccatccaagtccctgcaaaggacatgatctcattcctttttatggctgcatagtattccacggtgtatatgtaccacattttctttatccagtctatcactgatgggcatttgggttgattctatgtctttgcaattgtgaatagtctgggactgttttcaaacatcccaccccctaggggatggcatcatccctcgctgataaccactagcccaaatgcaaacatcactgaggcacgagggccttcagacagagggccaaagggaaacctgggaatattctaatggcattccagagggagggcaatggagggttctgggatgtggcgccatactgatattccagagagaaagctgagagatactggacatacagtatcctagtgacattcccaagaaagaaagtactgtggggcatctggaaagcatggcaacatgaatgagacatctttctcctccaatcacaggtctaaccttgatgtcatccatgtgcaggtggaagcaaatgaggccataggttctgcttaaatccctccagagagaactggggaggagacttgtttctccaaagctaggtaaatcctgtagctgcaggattcaaacagcagctcctgggaagaactggcatcttagagatctgtgtctttctgagaaagctaaaattagtttgtaacagtgtgtaaagtcctctggaggccaagaaggagctctccctgacactgagacagggaagttcaagaggtcagaaaggcttcttctaggtgcttctgcaggggctgacccgcctaaccactgcctcactttcaacccacaggggtagagatttcacctcctatcatccatgaagctggaaacctaaaaggccaacaaattaatatactgtcactactaataacagcaaacgctgaaatagctttagccttgtgccaatcaggtatttgaaggatattagcactttttgaaattaaacttgttatttttagataagtgtagattcacatgaagttgtaagtaataatagagaaaccccatgtaccatttatccattttcccctaatggcaacgtattgcactacagcacaatagcacaaccaggaaattgacattaatatagtcaagatacagaacatttccatcacaagaatccctcatattgtgcttgtagagcctctcacacttcctaccccaatcccctccttagcccctggctgccactcatctgttccccatttcaatgacttttccatttcaaaaatggtatataaatgaaatcatatggtatgtaaccttttgagactgcattttttctctgaacacagttctctggagattgatttggattgttgcatgcgtcaatagtttgttccttttatcacttagtagtattccatgatatggatgtgccacatttctttcttttctttttctttttttttttttttttttttttttttgagacaggtcttattctgtcacccaggctggagtacagtggcagtagtgtgatctcagctcactgcaaccttcacctccctcattcaagtgattctcctgcctcagccttccggagtagctgggattacaggtgcataccaccacatccagctaatttttgtattttaagcagagatggattttcaccatgttgaccaggatggtctcgaactcctgaccttaagtgatctcccacctcagccccctgaagtgctgggattacaggcgtgagccaccgtgcccagccagctgtgtcacatttcatccattcccccactgaaggacatctgagttgtttccagcatggggatattaagaaaaaaagtgcaataaacatttgtgcacagatttttctacaaacctgctttcatttatctgggacaaatgcccgggtgtaccattgctgggttgtaaggtagtggcacgtttacttttttaggaaactgtcaaattgttttccagagtggctgtgccattttataatcccaccagcaatatatgagtgatccagtttctccacattttcaccagcactagattggagttggcatactggacagaatcaatatgttatccttgtgctaaagcaacgaggaactttccaggaaactcattagaaggttcctagatggagaagaaatgaatccatcagctcaccatattttagaatggatatatttgtcagattagcaaggcagagaaaatgcaggaagaacggatctcaagagagatgagttttgttggggatgtagtgggagaagttcagaaaagcttgtgttgttcaggacaatcacagcaacgctacccaaagtgctctgtgtctcttgatggtaaagtgaaaagaagagacagcagccaaaagcaaatttcacgaactctgaaaacccagatactcagggatcagttccctgaagtctactcaatcctactgtctgcagaattcttgcaatcaatagcacagtaaatactccagcgttagtcaaccagtggctcaatctctcaaatgcaccggacttgtccacttccatctttctcctccacccctcatttcagccttatcttttccctctctttttggcgccaatatttttatggatgcaacagaacttggtccctgtactgtagcttctattgctccatcagtcttcctcctccattcactcagaaaattctctttcctcgtggtaccaaattgttttcccatctcaacgcttaaaactttgattccaaatttctactatggcaaagagtaactgtgataaaccaaagagatggtatgaaggtatgagggatgattgggtagggctcaacagaagaaaaagcaattggagaaaaaaaaagccacaacaccttcattttgagcatattaaaatagctatttttactgagggattataaatgtgccaggcattgtgttaaatactttatcacagacaatccttcaaacattccaataagatatgtactatttttagatctcccttgaaaataggaaaagtgactttgagagatgaagttacatggctaaggtcataatactgtaagcagggaagccaagatccaaacctaggcagtcttttccagaacccttgtcctgtccaagatttatcaaccaagaaaaattcatttagtatcagctcagatattgagcctgagtctcctgtagccaggatataggttatattgtgtgagagaaaggtaaggaaggactgttccaacatgactggccatggatgtagatcttatctgggttccgggactgtatctggcttccttgagccatcttagatgcccttggatgcccagactaggtctgggcaccaacctgggtgagattcccagcctcacccagcctggtgcctgatatctaattgaaagaaagaggagccattcttatgactgcatagagggacaatatttctacaaaaacctacatattaaaagatcatttggacttccatttctaatcaaatggatgacctaccatccccctgaaaacaactaaaagtgctgatagttagaaattatcaggcctaaatctaaggaaaagcaggaactcagaaagataaacagagtgctgatccactttcgtcctgaaagtatttcccaaatctgatgagcttagacttcatgggggaacaagtgacttattaccaagcctaaagccttcccaaagtgggaagttaaatgcaagattctaccaaatatgggaccccaagggttataatatcagtgtgaggatgaaccagacataggtcccaagccccagagtctataagaaaattttgtttcacaacaagcagagcaaggaggaaaacaccttctctaaaaagacataaccacgggggttacagcccaaaatgagccacccacagggtccaacaaactctaagttgtgaacgagtttaacacatttgcagactctgccccaggtgtccagtagaggcaaaggaaaatgctctcagaagaaggtgaattccccccaatcctcaagggatgaccacatataaaaatccaaggaaaataagcagcacatagtaataaatatttaagcacacaaggacaaaaggcacaatgagcagagcataagagacatagagaaacaaccacgggagattcttggaagatgggagcaatggcaacttcgtgtttcaatctctttcaacccctacccgaaagcagagcagttatatagaaaaactaaaaacacgtggccaacatctaaacaaccaagaaccccaaattacaagagggtggggacagaccactaacagatacaagacccacacagtattgatatctgtagaacatgggaaagaaggaagttataaaagcaaaatatgatggacttggaaaaaagtgaaccccaaggtagccaactagaaagaaccaaagaaacaatgccttaaagaaacagagagtggagaggaggaaatattaagaagacaaaaagaaatgaagaacacagatatttgtacacccatgtttatagcagcatcatttgcaatagccaaaaggtagaagcaacccacatgtccatcatgtcacgcctgtaattccaacactttgggaggccaaagcaggtggatcacctgaggccaggtgctcgagaccagcctgaccaacatggcaaaaccctgtctctactaagtacaaaaaattagccgggcatggtggcgcatgcctgtaatcccagctactcgggaggctgaggcaggacaatcgcttgaacctgggaggcagaggctgcagtgagccaagatggcgccattgcactccggcctgggcggcaagagtgaaactctgtctcaaaaataaataaatgaataaataaataatttaaaaagcacagtatatatgcaatgacgtattattcagccttaaaaaaaatgaaattctgacacatgctacaacatggatgagacttgaggacatcatgttaagtgaaataagccaatcacaaaagaacaaatattgtattacttgactcacgtgaggtacttagagtagtcaaattcagagaggcagaaggtagaatagaggttgccagggcctgagaggagtaggaaatgaagtattgcttaatgggtacagagtttcacttttccaagatcaaagaagtcctggagatggatcctggtgatggatgcacattatgtatttaatactactgaattgtacacttaaaaatggtgagggtaaattttatgttttgtatactttaacatagtttttaaaaataaaataaattttaaaaagaaatgtagaggggaaaaaagagagtaacaagcattgaaaataggcaatggagatcaaacagatggatagcaggaatttgtgtacatgaaaaccaaagcaaagggacagaagaaaccctaaaaatgatatttcaagaaaacattcctaaaattaaaaagaaattatttgaagctacatttttaaagtacacaatgcaaacatgagaatgttgacctggaataattaatatttagacatatcctaatataatatgggacttaaaatattctttcagcatcttgcagaaaagaacatgtaacttttaagggaaagaaaattagatgagtatcaggcattgaaagccatactttatgccagaagaaaattgagtaatatatataagatactcaaaggaagagagcatcaaggattttatatccagcaaaaattgattttcaagtacaaaagccatagacaaacttatcacagctcaagaactcaagaaatactgtttttctaagcctttcctgagtaatctactgtagaatgagttttagacaatcaaaataacttaagggtaaataacataatgattgctaatgagcatcaaataaaaatcaattaaggtaaatagaattaagacaaaatgaaaacaaagaggggaaggaaatattatgaaaggctatatgctctggcaatgtgtatatagtatagctattaagaatgatgagactaggccgggcacggtggctcacgcctgcaatcccagcactttgggaggctgaggcgggcagatcatgaggtcaggagatcgagaccatcctggctagcacagtgaaaccccatctctactaaaaataaaaaataaattaaaaaaagaattagccgggcgtggtggcaggtgcctgtagtcccagctactcaggaggctgaggcaggagaatggcgtgaacccgggaggcagagcttgcagtgagctgagattgcgccactgcactccagcctgggcgacagagcgagactccgtctcagaaaaaaaaaaaaaaaaaaaaaaaaaaaagaatagtgagactatataggttggtcataattcgtagatctgtgtacctgaaatggataactttgctgttaccctaaattttagctcaatgaacttgaaaaaagaaggggataagaagaacatacaccaaaaaattttaagtgttttaagtaatcataatggagatgatatgattattattatattattactattcagggactgttatatacgtaaaattggataaaatgaggaattataattttatcatcctctaggtccttgaaaactaagtttcttggaatggaagagtacttattgatataatagaaatgaggtttaaaataaaacctcagaaatcttgacttagaattagaaatatcaatatgaatccatgagatattttgtatattatgttataatttgtttcttaaaaacttctagagacaacaaccaactcaacagcaatgaatatccctaagtgcccaagttatggtcttgaaataccattcatctaaaagacaccagggcttcttggagaaatagctgattccaagtgtgggatcagaaatatacaggactagcctggaatacagtataattccagataggattacagctgtcaaagaccacaagggtcacatagaaaaggcccagtagcaaactcaaacaggcttgcattggcaaagatgggagaagttgaacttcaacaaagataataaggggtagtgaattaaaattccagtatgttgaagcctatgagttcataatgcaatttgtaaaaagaacaaacaaacaacaacaaaaaaactgataccttttggggatgacaagaaaccaattcattatattgaaaactggtaaataaagaaaaataagcacatattctgcatttttcatgtgaacatactgggtaatcacatagtaaacgaaataaacggcctctgtcaaagtgcttgactgataagtgaaacacaaatcatagcatcagaacattatcgtgttaggctgaataagagccccctgaattgtccaaatattaatccctagacctatgaatgctatcttatatggcagcaaaagggtttttgcaggtgtgactaagaatcctgagatagggaggtgatcttgatgggcaagatgtaatctcagggttccttataggagggaatcagagagacgaaagacaaaacagtagtgaaagcacagagaaatctgaagatgctaaattgctgcctttgaagatgggtgaaggggctatgagccaaggaatccaattcccaactctggaaaaggtaagaaaacaaattcttccctggagactcttaagggagcgaactccttagtttcagcccaatgaacccacttgggaccttgggcctatagaactctaagaataaatttgtgtcattttaaatagctaggtttgtggcaatttgttaccacagccattgaaagaaaataagacaatcaacattttgcaaccaccaataaataaatatgttacaattttaaaagtaaaaattaaaaagaaacagaaaaaaggctgagagattaagaaatactgaaaacaggcaacagaggctgaacacagggatagcaggaatttgtgcagatgaaaaccaaagcaagggaacagaagaaatcctaaaaatgctatttcaagaaaatattccttaaattaaaaaaaaacaatttgaaactacatttttatttatttgttgttgttattatttttaagatggagtcttgctctgctgcccagacgggagtgcagtggtgtgatctcggctcactgcaacctctgcctcctgggttcaagcaattctcctctctcagcctccagagtagctgggttaacaggtgtgtaccaccatgcccggctaatttttgtatttttagtagagatgggttttcaccatgttggccaggatggcctccatctcttgaccttgtgatccatccaccttggccccgcaaagtgccgggattacaggcaagaaccaccgtgcccagctgtaatgttcactttataaaaattcattaaaccatacaattgacttgtgtgtttttctgtatctgtgtgttgccttaggactataattatgacgtttaatgaaataaaatacaggcttcagacagccttcattaaacagaagactattaaatagatgacaagaaatcaaaaatctaaagataaaacatatataaatggtttaaaaaagtcaatgagcaggtttaacttcagattagatacaaatgtagaagaataggggaactggaagacaagtcgaaagaaattatgaagcagcagctgagagacgacccaaacagaccagggaattctaacgtatttataatcagaattcaagcaggtgaaggcagaaagaatgaagaaaagcaaacctatgatgatattatgagaatttttcagaatgattacaggagagtaaacacagagtcaaggagcccaataaatatccagcaggaagaaaagcaaaacaaacaatgaaacccctcatctagacatgtcagactgaaatggcagaatactagctacaaagagaagaacataaaagaagtcagaaaaaaattaccttcaaaagatttacagttagccctacagctgacttcattagtaacaatagaataaagatcattctgaaggcttagtctctgaagatggcaagggggaaaactttaaagagggaaagacttcagattttaatttaatttctgcaggcctgtaatgcatctcattaaaattaccacaagaaggaaagaagaggaaaggagggagaaggtaggaaggaagaaaaagagataaggagaggagagaggaataaaacataaatttaagtgcagagtccttaattcctgtctggccccatatcacaatattcaaggcagtggtggcctaataaatgttttaacagatggatctctgaaacaaaaagccaagattctgtagcatttgccaatttctatggagaaagcacccatacaaagcctgatttcaagctactaccatgacatcactgagcttggatttgggaagttatatgcatagtcagctccctcaatctggtaggaggagatggttccaacaccgttgctggtttcaaggtctcacacgctgctattagtgggccagtccaaaaatcaaatctgtatctctcaaaagtcccaatcctttcctcttgatgcatctaaaaatgtgattaccaccttcttggtatgaagaagcccaggttcaatttagagcgatttcagtgtctggaccattgcgagggaagttagttgcttagtagaggctggtcttgtaggtgatgtccaaagtatactagcttaggagaagccattggtcctctagaagtcataggtactaggcaaaaatcttttcttagaaaaaaacaattatttgacagtgtgctgattaggaggattccaaatctaaataagcccagtccttcaggttaaaagtgttttgatttcctcacttaaccatttacacacaccacccaatatagtctaaccatagtgcaaaaagttatcccacaggcaagtttgtttacatgtttgcagacactgtattggttttcaagtcgaaagccaataacccctatggaacatgccctatagattacaaaagtttactaaaaactgttaagttttaataatagactacaacttgaacacttggcatattctgtaataagaaaaacacaaacttatgtacacgcatacaacttcccttatcttgtattctagaaaatgagaaagattggagtagtcatgattgggcacagtcccatttcatgcaagtttaaacttccttgggttgggactagtttcacttgggccacctcttggtctactggtatgagaaattagaaatgtagagatcctcgggcacccccagaatggcttagtttagagtctactaactgtagcattggtgaaaaacaggccacggggggatagccctatttgaagccttctcataggttgaaaccttagatgctttggaccttagcacttagctaacacacagctgcttcctgccataagctaactgccgacatacaagatgagaagtcttcctaaggtctatgtatcttagacgcccagaaccaccatttgctatgtttttatggatcagtgccaaaaagagaccattggtctagtttctctctatgcttataattactttcattatgattatcccattactctgctcttccactgactcttagttaggtaccctccagccctcttagtagaacgtcttaagtgaaataatcgggaccaagtattgtgggaatgttagcgtcttcttagaaaacccctggcctctatatgcaaagtgcccttctcccctttgcagacaaagagaagtgtgtaggtagggcctctatgtcaaatcgaagacctcattataatagtttccaaatctaggtctgctcagcttatatctgcttattaaagagcatagacagctgctctcaattgaccttcttttccccaccagaatgaagagcagctggcagcttctttagctaaagaagggaaaaatctggtttggctattccactccacagggactcagtatgaacctactgtcaaaatcagggagaagcttccactaacaagactgatggataaaactgaaaatgggcatgtaaatgtctcactagacatactgtaggacactcactctccctacagccccttgtatctcctgcacacatctcttcgacaaccttaccactgtctcagacatgtaaggtacttgccaagcagaaagaaactgttactcttcagaatcgacacttggtttagtgttgtctaggccacatccatcaatagcattctttttgttttaagttctggcatacttgtgcagaacatgcaggtttgttacatcggtatacatgtgccatggtggtttgatgcacccatcaacctgtcatcaaggttttaagccccacatgcattagttatttggcctaatgctctccctccgctatacgcccccacccccccacccacccccacaggccccggtgtgtgatgttcccctgtgtccatgtgttcttattgttcaacttctacttatgagtgagaacatgtggtgtttggtttcgtgttcctgtgttagtttgctgagaatgatggtttctagcttcatccatgttcctgtaaaggacatgaactcattcttttttatggctgcatagtattccatggtgtatatgtgccacattttctttatccagtctatcattgggttggttccaagtctttgctatcatcaatagcattcttttacatccaatcaaataatctaacttggagaaaagtactggccagaaggtaagaggagcagcattcttaatcctaagagatgtgtctacacacacacacacacacacacacacacacacacacacacaccacactctcagccagatagagtcactgcagcagtacatgccgcaaactctattttcttcttatgcttattgtttcaacttttcagaaggtcagaaatgtaaacagaacagtggctctcaaagtatggtccctgcaatggcagcattagtatcacctgggaacttgttagcaatgtaaatcctcaggcctcaccccagacctggtcaatcagaaactctggggataaagactagcattctagtttaaaacacctcccaggttgccaagtctgtcctgcataacccagcccatggatgaaatgagtactcagacacaggtatgcagtgtaagagcagctaggtgactgcctggctctagtggccagagagcagccctgagaagctggagctacttgctttcagtgcaggcacaatgccgaaaacctggagcccacaaaacctgtaggtaattaatatttattgttcccctttcagggaacatcacacaaataatcaaaagtcagttcctggtcaacataagtaaacaagcttgtttaagataaattcccccacactccgttgtacctacttcttgccctctgtctcaggattatagaacagctgcctttagctattcttcccccggggatttgcagaatcttctgacctttcagaaggtttgcatcctttccctatagtttttcctaccactctggccaatctcccatatcaggtgattctattctagtaacagtaatgtttaagaactagtggagtaaatgatgctagaaccttcagtatagccaagctagataaaaaacatttttctggaaaattgattcaacagcacccaagtagagagaaataatctataaaaaatccacacattctttctgtttgcgaccactaaatttggatcactgcctccatgttcgagtgcaagaaaagaaaagccattcacaatgagcccataaagaactgctgcaggacacagaaaagaaaatgccaccatgaacacttggaagaaaatagtggagttttctcaatgtggtttattatagaaagaaaagcaaatatataaaactatttgacaaacagtcattatgaaacaggagcaaaacatcaagagagagactaggttaagctgaaacacagaatgtgataaaaatggagtgtagttagaaaatagggaaatttaaatgtgcaataataaaattaaaaaacacatttaatgttgcaacaaccaggattgacaatgtggaaaaatgagatcacaaatgttggagacaaactgtaagaaactgacaaaatgacataaaaggcccaaacagtggctcatgcctataatccagcactttgaggggctgaggtgcacagatcgcttaggcccagaagttcaagaccagcctgggcaacatggagaagtcatgtctctactaaaaatacaaaaaattagccaggcgtggtgatgcatggcctgtagtctcagctcctagggaggctgaggtgggagaatcacctgagcctgggaagtcgaggctgcagtgaggtgtgatcaagccattgcaccctaggctgtgcgacgagaatgagaccgtgtatcaaaaaaaaaaaaaaaaaaaagaaaagaaaaagacaaaaaagatgacaaggatgagagtagatggtgaacagaaaatcttataatgtgaactattcctgagaaacatatttcaatgattattagccattgtagcagtgcatgcagagagtttgttttttatatgcctatatgttaacatgtcagagagccagaaatgctacagaaacagtaatcagagatacaacagaagatgactttccttaactgactaaagccttgaattcacagattccaaagtctcaacatgtttcaggcaacaatcattaacaatgagaacactcaaattttcacctgggtggcagaagtaagagtaggggtgggagctggggttgggattagaggggttgtcacttcagaaaactaagcctgattaacttggagatagttggggactctacgtaaaataccattcaggcaattcacattggcaatttacttcactatgacttgttccctttgtcagaagagccctgttatttaggtacaagaatttggccttaaaaacccttttcttgatcaggatttattgcctgatgttgaagttcaattaataatgggagaagatttgattgccatagagcagctgcctggatgatgggactatggatgacatttttccacctgtaatttccagattatttcctgtaatgagaatgtgttattcatttacaaaatatccatggcaaaagtactgagtatcaactatgtgcttggcactgtgctttttctttctctcttggtcttattcttccattccttccccaccccacaatcaccaacaaataattatccatgggatccaatatttacaacctcacatttaaagaaaaaagataggccgggcacagtggctcacatctctaatcccagcacttcgggagaccgaggcggacagatcatctgaggtcaggagtttgacaccagcctggccaacatggtgaaaccccgtctctactaaaaatacaaaaactagctgggcatggtggcaggtgcctgtaattccagctactcaggaggctaaggcaggagaatcgcttgaacccaggaggtggagattgcagtgagcctagattgtgccactgcactccagcctgggcaatagagtgaggctcagtctcaaaaaaagaaaaaaaaaaagaaagaagaaaagagtttttttttctatcagctctccatataaaaattccaggataagtttctgattggcctagcttgggtccaatcactgtgagagggaggaacagaaatttaagattgtccagtcctgggctgtatgttctgtaggcaagatgctataattttcaagttcattcaaagtacatgattgtattttttgatcattccacaatgcatacatgtattgacacatcacattgtaccccattatatatttatcaattaacataaaactttagaaaatgcaagctacaaaatcgaaagaaagacacatgactgtaattaggaaaaaaaaaataaggaatttgaaagggagggtatttcctttccccagaagaaccagctcatcactgttaagaagtcacaaactatagaggtcttccactacaatcccaggtccaagagacgccgggatatcttgcatcaccattcttacatatcttcctaaagtctaccatcaagacttaaacatgattccataagcaacatctgcaggactggcagctgtctgaatttgattgatactctggcaagtcaattttgaaagcatatagagctgagaatattatcttgatggtatttcccactacattccaaagttcaagagagtttgggttacctctctctacccttctgatttattgccctctaatggaccagcacaagttaaagactatcttgtaatcagcagcagctagaggcatcggcagctgcctgaatttaatactctggtagccagttttgaatgtgcatagaattgagaatattactatctcaggttccatattctccattgattttacacaatcaatgattgaaacaaggtgagtgctcggcaacctgggaggcttcaatttatcaaaggattgtcattccagacagctgctgcctttcctgatctggatgatttagaggatgacagaataatgaacgatagcttaagtgttgtgatccttcactactgcccttcaggcagcgctcaaaaacaacaacaacaacaaactccgagttctcttgcctggctgttcctgcccctgaaatagggtgactagattcagtaacagttgttttctttaataaaggatgaattaacacatgttaatgattgtgcattgttaacttaccagaccaggaggaaggagagttgactgggccacttagctgacattcatccttttcctgtttagggtgtccatgttttccttcatgtaatcacttctctctgactcttcgttcatatcctttgggtggagttgaattcatttcccattctagggatgggcatgtggctccaaccagacccatcctagcatgcactactgtggttatagtgattggttcagggatggtcacatgattcaagttgaaccaatgagatataaatacacgtcatggttaaaggatcggaggtacaggttctccacagctgtattgaatctagaattaaacttgccatcccacggagtctgagaatgaagccaacacagaggaaagtattctggcagatgaagagaaacatcattctgattacatagtttgaacaccttggtcaggcctcacctgaacctagttctggtcctcaaactttcatttataggaattaagacccattcagggttggttctctatcaactgaaacaaacaaaataaagagctctacacttaggttcaagtccaagccctgccacaaactaacagtgtgacgtggagcaagcctctttattcctctaaatttaggttttctcatctatgaaatgaagtcattagatgaggcagatatttgagctttggcattctagggtattgcactgaattattgtttcaaatatggatttttgtcagaggagacaggcagaacaacccgaatctaggccctcaggaaaaacagatggattggagcaaatgtatcaagaagtctttgcagaaagggaaaaggatatttgaagtgtttggtaggaagagttgattctccacacacttcaatatttgaagagttaattggtagcagtgtgtgtgtgtgtctgtgtgtgtgtgagacagagagaggagttatgtgttctttataacattcaatcctttgaatttcttccaactgctaagtttgattttgtaatattaaaaagatatagaataatatgaaaaaaatggctaaatgtaattatgaccctggactactaggctttattatttttggaattcctgacatgagcttgatgtattattctagccctaatgtccctgaggctagactttgagaattttttacaagagtgaaaatttcaaaatagtttagcaagtgacctaaggctaacatttcataaaacaagagtattttaatagagcaagaataaaaaatagtgggacattttatctttaagcaaagaaaattcttccttagaaaagatagttgccaatctaattcaacatttatatctttctttcaagctttctttctgacttttccctatggtctcctaagcaacatatagttaaatttccctgttaaaaatcctaatagtgtttgtcttttaatagaagaaattaagttatttatatttactgtaatcactgtgtgttagttttctttctgtcatcttaatttatggtgtctgctcttctacatctcttgagggttcccctttctagattctagctaattggtcaaatgttctttcttcctttcatttctttggtgaaatagaaatgtttcctcttttttgtattttaacttatatgtatatttttacaagcataattatgtttccaatcctgttttcttagcaatttcaaaaataaatcaatattctgaagcctactctcacccacgtactaaaaaggcagtctttcatttcttccctcctcggagattcatctcccaggtttcatcttgcagaattttggtgtatgattaatattttgttgtaggtatgcatggactttatctatttgattttatgtcatcccctttctattttattaacttatttagtaactgcattgggattttacacctgcattgtgagcaactatttgtacgctccccctattatttctttggcttttcttagttccattatgtctgtctagaagcattctaatgaaccttgggtttcctggacctatctctcatctctcaacttttccaatgtaatttttatgttattggagagaatgctttagctagatattccatatcacaaagtcactaagtcaattcattttttttcttttttttttgacacaggtcttgctttacctcctgggcttaagcagtcctccctcctcagcctcttgcatagcttggactactgatgcatgccaccacacccagctagttttttaaaaattttttgtagaaatgggggtctcactctgttgctcaggctggtgttgaactcctgggctcaagtgattcccctgcctcagcctcccagagggctgggattataggcaggcatcactgtgcccaacctcagtgcttttacttaatttttacttctgccgtcagcctttccattttaattttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattttaatttttaatgttatcaattatattctaatttccaaggttttcttttttgggttatgaagttattcttatgaattactccaggtttttctgtccagtatggcagctatttaattagctacatgtggtagtcactagccatgtgtggctatttcaatttcagtttaaattagttaaagttaaatgaaattgaaattcagttccttcactgccctggccacatttcaaatgctcaatagccacatgtgggtggagactgcagtgttgggcagttcagagttgtacagcattttcatcatcacagactgacctgttgtatagtgctggtctagactgattagtattagctgctaaaatggttttccttccaacgcaaggcagtcactgtcccccaggtagtgaaaatggctgctgacagagcaggagcatcgccatcttggacaaacaccaccattttacgttccccacgctcctaaccaaaatcggccaaaagcccctctcaggtttattctccaaaataaatctgtctttaactgttaagccacttttcatgtttctttcctctttcactcttagagctgccttgagtggagaagagctacatccatgtgggcttccctgcatgatgggagggaaacttgacttctcattgtgaatgctctgtcttagttgggttcagcacaagttacttggggcagggacccatgtcctctccagctacctaaacttcagtcctaactttatgcagaaaactgacttcacagaaaacctaggagcaaggtgctgtagccagcctctctttcaaatggggaattcgtgtaattgttctgttgttctctaatttataacccttagaccatcccacagaccattgcttctcccagcctgctgtctccaatcttgatttttctccagagctctgttggaagaactcagttttacaactgtctcctctttcatctgtctggggttatggtctcctgaaggctgttaaggaatcaccattcatctgatgccatatattttgtctgtttcacacatttctcaaaacttctggcttgctgatggtgacattttccattttccagcattgccattgatttattcttgctcttatatttcctctgtcaagatgtgctcagtcagccatcttgaactgaaaggagtagccctatttcttaagcttttgtgtctacagaattagttttataaataatcatagaatgtcaggggagaaagaaaatctgagatccagtccaatccattcgttttatagatgtacaaagtgagactcatatgagaaaagtgactcacacagacctttacagcatggtaacggcaaagcttggacaaagagggcagtcacttgtctcctacactggcctctgaccattgtcccctgctccaagaaccctgagtcattataagaggtcaatgttgtccgggcacagtggctcacgcctgtaagcccggcactttgggaggctgaggcgggtaaattacgaagtccggagttcaagaccagcctgatcaacatggtaaaaccccgtctctactaaaaatacaaaaattagccaggtgtggtggcatgcgcctgtaatcccagctactcaggaggctgaggcaggagaatcgcttgaacctgggaggtggaggttgtactgagccgagagtgtatcactgtacttcagcctgggcaacagagcaagactctgtctcaaaaaaaaaaaaaaaaagtcaatgtctcagcccaggcataacctaggttcagcacagtagttgtttttttatgcagatcttttctaagctcctcctaatacaaaagaatgggggactcctattttttaaaaggcattttcaactgaactgaatgaaattaaaagaatcttccactgttggtgggagtgtaaattagttcaaccattgtggaagacagtgtggcgattcctcaaggatctagaaccagaaataccatttgacctagcaattcaattactggggtatatacccaaaggattataaatcattctactataaagatacatgcacatgtatgtttactgcagcactattcacagtagcaaagactttgaaccaacacccaaatgcccatcaatggtagactgaataaagaaaatgtggcacatatacaccacggaatactatgcagccgtaaaaaagaatgagttcatgtcctttgcatggacatggatgaagctggaaaccatcgttctcaacaaactaacacaggaacagaaaacccaacatcggatgttctcactcataagtgggaggtgaatagtgagaacacacggacacagggaggggaacatcacacaccagggcctgttggcgggggtgatgagcaaggggagggagagcattaggacaaatacctaatgcttgcagggcttaaaacctagatgatggattgataggtgcagcaaaccaccacggcacatgtatacctatgaaacaaaccttcacattttgcacatctatcccagaacttaaagtaaaataataaaagaaaaagaatcttcctcttaacctacaaattcatttactccaaaaggtccttttcccaagaacagttaaaaaaaaaatcaaggttatacttcaaaggtataagaagaaaggggcttggaaaatgcaaacagttcccgcttaggaatgaccatgatattgcagaatgggtgggagagcagtggatatgagaaataggcttcccccttccccagcaggttctggggtgggagcttattgtccatcttagtgaaatctttcatctcgagcatctgcctagttgcactcatctacaatctgtttccagtgaagcaaagtaattaattgtttcaaaatgcttttttagactttggaaaactgacctagggttaatggttcataaacctcatttatgcttctattagagattttaaaatgtgagctgatgtgcttctggactggagaggaagagaggccctcatagacctgctgtgaaacctgtagcagtggctgcagccaaggagttatcccttttttttttttttttttttgacatcttaaaggaagagagggggagcaacgcaaattctctgacatcatctctcagagggtttgatgtaacgatgacatattaaacttggagagaaggcgtacactttcccggtcctagaagtttcatcatcgaccctcagccactctacaatggggactggaaccaggctttccagtcctggcagagctcctgttactatgtattcctcgataaaacaccttcattcctgtacttggcctcatagactgtgatctttttagggataccagtaagggctctcaatatctcttctaacatgagcaaccccataacttcattcccgggtatcacaaagacttactttggggattatgaactcacatgcatccagacaccagacagatagcataaataagtcaggaagaaggatggagactggggaaccggaacaggcacatccccttcaaagggaggtcactgcttttcagttctagctggttgctggcatgcagaaatgtgtgccttatgtttccagaggagtcacaaatccagataacaagtgaagtctgacgcttatttggtgctggtgactaattaaaaaatcgagacacttccagctacaaacaacacacatctgtgatttcccccatcccaacccctggtttgagatctctggtttggttctcccagaaataactatcaaaatgcaaaggtagaaaaaaaaattacagaaggagcaggactggaaaagaaatgcaacgatgaaaggattacagaagcaacttttagataccaaatagtcagtgcctatgcaaattctaaacagatgtggttgacctggtgaagttccagcctccagaacactcccctcctggccaccaatagtggtctttgtaacatgcaaactctttgtttatttgaattctgggccaggctaaagtggcagtcgcctcaataaagggggagccttcaggaaggtgggtattcctaggatattctcaaggatagacaccctaagatattcaaaaagattgaatttccaaggtatacgcatacaaatcaattgaaatgtaaccatagcaattataataaatcacttcagttcaccaagtgcctatgtactaatgtcagggtaagtgacttatagaagtcgtcttgtttcgtttgcacaacaaacctaatatgtactataattatcccttttcctttttatttattttttattttattttatttatttttttgagacggagtctcactctgtcgcccaggctggagtgcagtggcgccatctcggctcactgcaagctccgcctcccgggttcacaacattctcttgcctcagtctcccgagtagctgggactacaggcacccgccaccacacctggctaatttttgtatttttagtagagacggggtttcactgtgttagccaggatggtctcgatctcctgaccttgtgatccacctgccttggcctcccaaagtgctgggattacgggtgtgagccaccatgcctggccataattaacccttttgtatagatgggaaaacacactcagggaggggaattcgttttcctgcagatcacaggtgataacacctgaattttgttagaaaatgagctccctcaatctatgtgttattctttgtctcccttgaggacacagagtaggaagttcaacataatgttgaagtggttttcccctcccaacttccaaagattcccagagtgggcttaaaagtaagagaacagatggtggttgggtggtggcggtggtatatcaatttcctccaaatgtatatctggaatatacaaaaacaaactagggtgagcagaaaaatcgcatgttctaaaaatgaaaagactgtagctttcaagatatttatcattttgtgtactctgggaccatatggataatatcaattggcctaagattggaaggataaggaagggagaccacaaaaggctttgagaaagcaaggggtagacactgagagggagagcatgacctggacagtgaattgctcatgtgggttgttgagatgtttatttattttatatttatttttttgagtgtcgttctgtcacccaggctggagtgcagtggtgagattttggctcactgcaacctctgcctcctgggttcaaccgattctcctgtctcagcctcctgagtagctggaattacaggcacatcccacaatcccagctaattttttgtatttttggtagagatggagtttcaccacgttggccaggctgatcttgaactcctgacctcaagtgatccacctgcctcggcctcccaaactgctgggattacaggcgtgagccaccacacctggcctgttgagatgtttaaaaacaactttattgagatatacttcacataccacacaaattgcacatttaaagtatacaattcaatattttcagtatttttgcagacatgtgcaaccatccccacagtcaattttagaacatttttaccacctgtaagaagccctgtgccctctagccttcatctccctgttccccatcccttccctgaaatctccagaaaaagctctagagttggctactcctgggatttccaggagtataagccagaagtcctctgccagttcgtttttcagtttaaacatcaccaatcaaacactgatgtccttgccctctttttcttttcttacccctacctttctgataacttagcattcccagtcctgacttaggagaagggttggatttataaacaattatcccaggcattgttcaagaggtctctatgtttagagtgggtctaaatgcagaaactagtacccagacctttctccaagcaccgtcaaaggcagtacttctgaatgcatcttcacaaccttttgttctattttctgcattatcttgaagaggctacatcattgtgaaaatgtaggaaataagtgatttttgttcaaagcaatgatgggaagtggtcattcttaaatgatgtctattaacgacctacaagtgaattgaaggtgctaggcattgcgagttgtgcaaagagattttaaactattttggggaagatagaatatgaattgtaactggaaggaacatgacatgggaacagagcattttcttaagaatcaaactaattgggttcaaatcctaatcccactacttaccaactgcacaacattgggcaagttagctaagcttctctgagtctcagtccccttaccaataaaatagaaataatgtcactgtattagtccattttcatgctgctgataaacacataccagagactgggaagaaaaagaggttttaatggacttacagttccacatggctggggagacctcacaatcatggcggaaggcaacgaggagcaagccgtatcttacgtggatggtggcaggcaaagagagaatgtactagcaggggaaatgccagacgcttataaaatcatcagatctcatgataactcactcactatcaggagaaaggtatggggaaactgcacccataattcatttatctccacctggccctgcccttgacatgtggggattattacaattcaaggtgagatttgggtagggacacagagcccaaccatatcagtcacctattctatatggtgtttcaagattaaaatatgtgggattgacaagcaccacaacaattattatttctactactactaccaccactaccaccaccatttaagtgagcatttatttgtcaagaagttataagtcacttaatatgtattatctctctaacccatccaacaacttggaaaagcatacaagatataatcctcccttcacagatgtaaaaaactggctcagataagtgaaataacttgccacaaaccatacagctggtgagtgtcggaactaagtattaaaaccagacttgttggtcacaaagatgacatcacacccattattgtcataattaattactactggaacagtgcaaggaggaatccagaacatgaaagagacatttttctttcaaaagctagaaatccatcttttaaaagtcaggcaaacactgtaaaatttaaaataggtaatttcacattttgatggctgtgttagaaactaggcaatatcaagtacagggcttaaatgccagtgtaaggatgagagactatgtctagacagctggtataccagctccaacacatcgtctgtgttcacccatccaccccacaggccgaaatgaatttttaggaagagatgctattcagtccctctgtaaaggggcttccagaacataacctgccattcctggaacaatgttgtaacatcccgggcagagaaactctgtcctctgctcagcaacaaaccttgggatttgcccagtttcttgtccttgggttcttgcaaagtcaccataatttgaatttttataaatcaaatcctatttcaaatgcaattgaagaacttgcactttaaaagaatcctgtcttgaatcctcaagaaaatggaagactgccgttgaaactgaatagctattcctaaaattatccattttgcaaatttggaatttggttcccaaccttgtgaaaacaacctgtaaacttcgaaaccaatttgaaattcaagtttgtggctgggtcttttgggcactccttatcaccttggctgataagcatttaaatatattcattaacaaaaatcattgttgtcacagttaactacattagcaccttttaattgaattagaaattagatgggggtcatgaatatttcactaggattcactgccagccttcccaatttccatcttaaaaaaaaatactgtcacgtagcgtaaacggatgaattcacaatgttcttgttcccgccttttcttatagttttgccacaaaagtcatcccggtgtcgaaaatgaatcagaaacaaatttttaactttcatgctgctcttctgtgcatcttggcatgatgcaaagagttttctgtccttaggaaactttatataaacatttactcaacacaatccagaaaccatcagtcccattgcatgctgagaaggctggggtttttgaggtagagccagattctcaatatcagcacaactgacttttggggctaggaaactcagtgggaggcctgtcctgtgcgttccagggtgcttagcagcatccccggcctctatccactgaatgctagtagtgcacatgacacgctccatcccctgtgtgacaactaaaatagtctccagataatatttgtttgtctctttgtttgttcgagatggagtcttgctctgtcacccaggctggagtacagtggtgcgatttcagctccctacagcctccaccttctgggttcaagcaattctcctgccttagcctcccaagtggctgggattacaggcacacaccactacgcctggctaatttttgtatttttcagtagagaaaatgtttcaccacgttggcctgactagtctcaatctcctgacctcaagttatctttgcctaggcctcccaaagtactcagattacagacatgagtcaccgtgcctggtcatgtctccagatatttggatgtccaaatcatatcccacccttgggggagaagtttgctccccagcttggaaccactaagaataatatagattcaattactagccctgcctcttgtgtttggcccttctctgggcctcagttttgttttgtatatgtgaaatagaagcgatcatcactacctcactaggttgctaagagatttaaataatatcaagtgaataaaaggcatagctgagggcgtgttcattaattaatatgtatgtagtaataatcatagtaacagaagcagcagcaacactagcagaacttgcatcatgacgtgagggaggtgaaggaaaggactagctgctcctcttctgtttatactacactccactcatggaagtgcccatgttactgggctgaaccacatgaaccttccctgccggaagaaagacccaagagggcaccttcaaaggcagcagtagcccctcgtccgcgaatctttaagctggtttgactcaccctccatgccacatgtgcggtggatggtcaaagcaagccccagatacgtctccagtggagacatctgagacagcatggtgaggtttaaaaaaggaaattggatttggagtctaagggacctaaattccaaacttggctgctgattctgggaagtgttgggcaagttccttaatttctgtgagcctcagtttccttagctttaaaatagagtcagtgaaaattctcccacagactggttgtaagaactaaatgtggtaacgcatgcagaaagcccagtgtgatgcttgacacacggtaagtgctcaattatctgtagtaattatcatttttatgatgaagaatatcatgatcctggcccagcatggtggctcacacctgtaatcgcagcactttgggagcctgaggcaggtggcgggtggatctctctttttttttttttttttttttgagacagagtcttactttgtcgcccaggttggagggccgtggcacaacctcggctcactgcaagctctgcctcctgggttcacaccattctcctgcctcagcctccagagtagctgggactacaggtgcccgccaccacacctggctaatttttttgtatttttagtagagacagggtttcactgtgttagtggcaggtgaatctcttgaggccaggagttcaagaccagcttggccaacctggcaaaaacccatctctactaaaaatacaaaatattagccaggcatgatggcgtgtgcctgtaatcccagctactcaggggactgaggcaggagaatggcttgaacccgggaggcagaggttgcagtgagccaagattgcaccactgaactccagcctgggtgacggactgagactctctcccccacaaaaaaaagaatatcatgatggtttacagcaaggtttctccaccttggtgctatacacattgtgagctgaataattctctgttgcgggaagctgctctatgcactgtaggatgtcagcagcatcactggctaatgagatgccagtagcacttgtccacagctgtgacaaccaaaagtgtctccagacatttccaaatgtcccacggagacaaaactgccccccttgaggaatactgctctacaggaagtggattcccttcctagtctaattggtcactgtatcctgggtggatgccacctcttctgggaagaccccctgccttccttatgcagaattcaccgctcccttcattgcctcgtaagtgtttgtttgcttatctgtgtggtctgctagactgggagccccacaagggccagcttcattcagatctgtgtctggagttggcacagagtggaaggtagtgaacagagcaggaaaggttaaacaaaaaagtggttaaaaaatcaaaagaggacgggcgcagtggctcacacttgtaatctcagccctttaggaggccgaggcaggcagatcacttgaagtcaggagttcaagaccagcctggctaacatggtgaaaccctgtctctactaaaaatacaaaaattagccaggcgtggtggcctgttgtcccagcaactcagggggctgagataggagaatcacttgaacctaggaggcagaggttgcagtgagatgagatcacaccgccgcactccagcctgggcaacagagcaagaccccacctgtctcaaagaaaaaataacaataataataataatcaaaactaaaaaataatagatgttggcatggatgtggtgaaaagggaactcttttacattgttggtgggaatgtaaactagcatagctactatggaaaacagtatggagattccttaaagagctaaaagtagatctaccattcagtctagcaatcccactactgggtatatacccaaagacaaagaagtcgtatgaaaaagacacacgcacacacatgtctacagaagcacaattctcaattgcaaaaattatggaaccaactcagatgcccatcaaccaaccagtggataaagaaaatttggtacccatacaccatggaatactactcagccataaaaggcaatgaaataatggcctttgcagcaacttggatggacttggaagccattattctaagtgaagtaactcaggaatggaaaaccaagtatcatatgttctcactgataagtgggagctaagctatgaggatgcaaaggcggcatacgagtaatataatggacttttggaattcagagagaagggtgaaggtgatgaggcatcaaaaactacatattgagtacagtgtaccctgctagggtgataggtacatcaaaatctcagaaatcaccactaaagaacataaccatgtaacaaaaaaccacctgttccccaaaaagtattgaaataaaatttaaaaaaattaaaaaataaactgttattttctgagcacctactgtataccaaagacaaagcctaaactgcttgcaggcatgatttccttcaatcttctcaatgggttggtcaagtatttatttttgtgcccattttactgatgaagaactgaggcttagaagaaactcagttagagacacatggcaagtatttgaatgggcttagggtttgaacccacattctccccagtttgtgctgcaccctagaggtctcccatctgccaagggctttatcaaatgcattccttgtcccatggatgagatcaggccaggcgcggtggctcacacctgtaatctcaacactgtggaaggccgaggcaggtggatcacctgaagtcaggagttcgagaccagcctggccaccatggtaaaaccctgtctctactaaaaatacaaaaattagtcaaatgtggtggcaagcgcctgtagccccagctactcagtaggttgaggctggagaaccgcttgaacccgagaggcggaggttgcagcgagctgagattgagccactgcacctcagcctggacgagagagcgagactccgtctcaaaaaataaatacataaataaataactagagagatcagaaaattggggtggattgcccaaggtcaggaaatgagctgacctgcttgaagaaacaatccattctggatccaaagaggaggcactgggcatttttttacttttactgaaaaggtcgtattggaggcagccccagtgacaccttttgacaatttcagaaagttccacctgcagtttggaggcaaagctgaagccaaggcctacatcgtcccagcccctctctccacctccagctcaaacaccagctggcccttagctcttggaacattagtctgcagggggaacagatcctggtgcatgaaggaggcatctcccatcctagacttgaccactccccagtgcagctgcttctcgttgtttcagagattctgagaaatatgttaaataggctaagggagacatacaaagtggacagcagactccaaaaggttaatatcttccttttcagatggttcccacagttgccatggatatctcctacaggaggctttgcaagttccacatgaaggggctgaaattaataaactcctttgaactcagaggaaacaaaccaggtggggctaaaaatgctgcagcctgtttgtatccatcttggacaggggggcctagaagagcaggtgtgtgtgcaaagggcgtttgggtgtttatctgtgggtatgtgtgcgtttcaaccacacatatgcgactgtatgtgtgcctttggtttgtctgtgtatacacatgaaagagggtcagaaaaggactagactgtctgcatatcccaaagggcaaagatttatttgatgatagtttccccaactaggcggcaatatattcaaggtcaagggctgttttttatttgtctctgcaatcccattagcacctagcctggtgccttgtggatgttcagcaactgtctattgaacagtttcatctgttcatttaacaaataattttgagggcctggcactgtgctacgcacagaggttattaccacagtgactaagacagagattctttcttcatggagcttaggagcatgagacaggtggacgaatgggctgaaggatgaattctcaaatgaaaagtcatataagtacctttcctgtggttcatgtgtgtaaacgtgtgcacgtgtgtatgtatgtgcacacaggtatttataaagagacaaaagaattacttgaaaaatgaagtgccagtgaggaacagagtccatgtataaaaaataaagaacgtgggccgggtgcattggctcatgcctataatcccagcactttgggaggctgaggtgggtggatcatctgaggtcaggagttcgaaaccagcctggccaacatggtgaaacctcgcctctactaaaaatacaaaaattaaccaggcacggtggcaggcacctgcaatcccagctactcgggaggctgaagtgaaagaatcacttgaacctgggagacagaggttgcagtgagcagagatcgcaccactgcactccagcctgggcgacagagcaagactgtgcctcaaaacaaaacaaaacgaaacaaaaaatgaagaacatggacaccggcgtcaacacgtcctgcctctgttgctaatcagctatacctccttagtcaatcagagccacagtttactcacattgaatatttttggcacacctaccatgtgtgaggtacgttccccgccctgggacatagcaaggagtagagcagacatcaatccccaccgtcattgagtaatgattctaaaactcagtgagtgccagaatggcaagaggctccaaggtggcccagggaagcagggaaggtgtctgaaggaagtgactcttccaccgagacatgaaggatgtataagaatcggttaagtgacaggtagaggggaaagagtcccaggcagaaaaaatagtgtgcacagaggtcttgaggcaagagcaattatggcacgtttgaaaagctggaggatattgaatacagcagcagcactgtgtgtaaaggggaggaaaggctgtatgaatgggtgtacatatgtgtccatgcatgtgtgtgtgtgtgactcagtatgagtgtgtctctgtatgtgtttccaggcatgtgattatgagtgtgtatctgaataagtgtgtgcatgtgtgtctcggtatgtatgtacatgtgtggtatgtgtgtctgagtgtgtctgtgtttttaagcatagtgcgagtgtgtgtgtctccatgtatgtgagtctgtgtgtgcatgtgttcccatgcaagtgtgtgcaagactgaatggctgtctgtgtgcatgtgtgtctaagcatgtgtttatgcatgtgtctgaatgagtgtgtgagtttgtgtgtgtgtgtgtgtccaggcatatgagtgtgggtgagtacacatccttacaaagaagtttgcagatactacgaccagaaagccacagataaaggaataagacttcctatgggagttctgtaaccacagagcaaaatcaatattctaaccgaattgcttttatagataatgtattatgtgagaaaagttttaattaaagtgtggcctctaagaaggttgctccaagactcacagatttcactgttctgctcagacagagctcagggcaggtggggagcaagctgggtattatccaacaggcagccctcccattccttgtcctcctctgtggctgccattttcacctgccttgttataaattcattaaaaaaaaaaaaaaacggccatgcacgatggctcatgcctgtaatcctagcactttgggaggtcgaggggggtggatcacttgaggtcaggagttcaagaccagcctggccaacatggtgaaacctcgtctctactaaaaatacaaaaattaactgagtgtggtggcgggtgcctgtaatcccagctactcaggaggctgaggcaggagaactgcttgaacctgggaggtggaggttgcagtgagccaagatcacaccattgcactccagcctgggcgacagatacagactctgtataaaaaaaaaaaaaaaaaaaaaaaaaaagcatatttaggaaatgctgttcattaatgttccagaaaactatgctaacatattgatagtcaaagaaatgcagacgaaaacaaatcatattctttgcataaaagagaaaaaaatagaatttaaaataataatatttgcttgcagtaagggtacagtataccaggtacgtttgtgataggagtgtagatcggttcatattttctgaaggatatttgaaccatagtatctgaaactttaaactagacatacctttggattcagcatttctgcttctaggaatttagccaaagaaaataatcactcaaatggggcagattaagtgtaaaaagttgctcatcaaagcatcatgaagatgcaactcttgttatgatggtgtgatctttcccataattggcctctaaaggctgagaacaaaaggtcataaacattccacattttaagtatagtaaccaccaatatttggccagctttctccctgaaagtttaggtttcaggtagtggtgtgctggtaaatgtttaacaaacagctatggagtggaggtggagatggggggttgtcagatgatacaaatttccatggtgtaaatactcccaccagggctgattctgcgcttccaatgcgtgcttgctgaatgcagagttttgaagagatactaacaattggccctcacgagccaatatgagcaccttcagcatacgatgggatagaggagccacttctgctgaagcaatgctgattccttgcaatgcatgctccacagcacatataagtcagggagggagagtgaagttatcctttggagaggcgcagcgttggtgcagagagattctccctacttccgcttacttccccagaggttctactcctcgttgcaaaatgagggatgcacaaagcaaatagctcactaagttgggaggcatttataagaaggggctgccagactctctctctctgcttgctgaccagtttagtgcttcctgagctaattaagaaggcattgggacacaataatggtgcagactgaccacaaggctgataggagacaaggaccactttctttcaagtcccagctttgcaagtggaatggaagatggatgaggggaaagggcactctaaatagcgtgtgaaattgacattgtccaatgatcaagactgaatcttcagaaccaagctcaaacagagacttttaatactaggatgtatctgtctgaaccacactagtgatttccttgaggaagcctgctaggtaacaggataggaaaaatttgaaagggcagagttaacagcagctattggaaaagaatacatttttctggttttacctcaatgacttgaggcttgtcaatcaaattggtcacacttttgaaataacctaagtatccatcaagcaggaattcagtataatacagcacatccatttattcaaacagcatgcagatattcaaagatgttaatacccattgtgtgtgtgtgtgtgtgtgtgtgtgtgtgtgtgtgtgttatctgtatcttaattcaagtaccaccaaataatcactgatatatgcttctttgaggtttttaaaacttaaattttatagtctcatttttaactagacagttaataactctgtgaattaaaaacatctcttttccttgggtctactctgatatagtcaacactggagaattcaaaatcacagtatagtctttctaccatagttgctaccaagaaaagatgactgcaataaatgaaaagatgaccacaataaataggtgagtgggaataaaaagtgatttacaaataattatgtacaatatgaccttgcttttgtaaaagaataaaaaagtgtataaccatatatataggaaaacatctggaaatgtacacactaaaatgtcaagagtagttgctctgggtggggtatggtatatagacctttatttaatcatttgctcaacttgccattctttggttaatacttattaagttctcactgtgtatcagagacactgctagccacccatacttccctgttttatctagtattttacagatcttttgccttataattaacatgcatcaaaaaaatcaggacaggaaaagagagagcttttattttgctgaaaaaacgaagtactcagcccacagtacttagaactcaaagggtacttagtaatggtggccatgattgtatcattctgtgaatcttggctcttcctctgctatagcttctagaacaatcgttgtaacaacaacagtgataggcggttccaagatggctgaataggaacagctccagtctacagctcccatcacgagcgacgcagaagatgggtgatttctgcatttccaactgaggtactgggttcatctcacaggagagtgtcggacagtgggtgcaggacagcgggtgcagcgcaccgagcgtgagcagaagcagggtgaggcatcgcctcacgtgggaagtgcaaggggtcagggaattccctttcctagccaagcaaagctgtgacagatggcacctggaaaattgggtcactcgcaccataatactgtgcttttccaatggtcttagcaaacggcacaccaggagattatagcccgtgcctggctcggagggtcctaagcccacggagccctgctcactgctagcacagcagtctgagatcgaactgcaaggcagcagtgaggctggggtaggggcacccaccattgctgaggcttgagtaggtaaacaaagcagccaggaagctcaaactgggtggagcccaccgcagctcaaggaagcctgcctgcctctgtagactcctctgggggcagggcatagccaaacaaaaggcagcagaaacctctgcagacttaaatgtccctgtctgacagctttgaagagagtagtggttctcccagcacggagtttgagatctgagaacggacagactgcctcctcaagtgggtccctgacccccgagtagcctaactgggaggcaccccccagtaggggcagactgacacctcacacggccgggtacccctctgagacgaaacttccagaggaacgatcaggcagcaacatttgctgttcagcaatattcgctgttctgcagcctccgctgctgatacccatgcaaacagggtgtggagtggacttccagcaaactccaacagacctgcagctgagggtcctgactgttagaaggaaaactaacaaacagaaaggacatccacaccaaaaccccatctgtacgtcaccatcatcaaagaccaaaggtagataaaaccgcaaagatggggaaaaaacagagcagaaaagctgaaaattctaaaaatcagagcgcctctcctcctccaaaggaatgcagctcctcaccagcaacggaacaaagctggtgttttgttttgcatgactttgatgagctgagagaagaaggcttcagatgatcaaacttctcccagctaaggaggaagtttgaacccatggcaaagaagttaaaaaccttgaaaaaagattagacaaatcgctaactagaataaccaatgcagagaagtccttaaaggacctgatggagctgaaaactatggcatgagaactacgtgacaaatgcacaagcttcagtagccaattcaatcaactggaagaaagggtatcagtgatggaagatcaaatgaatgaaatgaagtgagaagagaagtttagagaaaaaagaatgaaaagaaacgaacgaagcctccaagaaatatgggactatgtgaaaagaccaaatctacgtctgattggtgtacctgaaagtgacggggagaatggaaccaagttggaaaacactctgcaggatatcatccaggagaacttccccaacctaacaaggcaggccaacatttaaattcaggaaatacagggaacgccacaaagatactccttgagaagagcaactccaagacacataattgtcagattcaccaaagttgaaatgaaggaaaaaatgttaagggcagccagagagaaaggtcaggttacccacaaagggaagcccatcacactaacagctgatctctcggcagaaactctacaagccagaagagagtgggggccaatattcaacattcttaaagaaaagaattttcaacccagaatttcatatccagccaaactaagcttcataagtgaaggagaagtaaaatactttacagacaagcaactgctgagagattttgtcaccacctggcctgccctaaaagagctcctgaaggaagcactaaacatggaaaggaataaccagtaccagccatggcaaaaacatgcccaaattgtaaagaccatcgaggctaggaagaaactgcatcaactaacgagcaaaataaccagctaacatcataacgacaggatcaaattcacacataacaatattaaccttaaatgtaaatgggctaaatcctccaattaaaagactcagactggcaaattggataaagagtcaagacccatcagtgtgctgtattcagaaacccatctcacatgcagagacacacataggctcaaaataaagggatggaggaagatctaccaagcaaatggaaaacaaaaaaaggcaggggttgcaatcctagtctctggtaaaatggactttaaaccaacaaagatcaaaggagacaaagaaggccattacataatggtaaagggatcaattcaacaagaagagctaactatcctaaatatatatgcatccaatacaggagcacccagattcataaagcaagtccttagagacctacaaagagacttagactcccacacaataataatgggagactttaacaccccactgtcaacattagacagatcaatgagacagaaaattaacaaggatatccaggaattgaactcagctctgcaccaagtggacctaatagacatctacagaactctccaccccaaatcaacagaatataccttcttctcagcaccacatcacacttattccaaaattgaccacatagttggaagtaaagcactcctcagcaaatgtaaaacaccaaaaattataacaaactgtctctcagaccacagtgcaatcaaactagaactcaggattaagaaactcactcaaaaccgctcaactacatggaaactgaacaacctgctcctgaacgactgctgggtacataacaaaatgaagtcagaaataaagatgttctttgaaaccaacgagaacaaagacacaacataccagaatctctgggacacattcaaagcagtgtgtagagggaaatttatagcacttaatgcccacaggagaaagcaggaaagatctaaaattgacaccctaacatcacaattaaaagaactagagaagcaagagcaaacgcattcaaaagctagcagaaggcaagaaattactaagatcagaacagaactgaaggagacagagacacaaaaaacccttcaaaaaatcaatgaatccaggagctggttttttgaaaagatcaacaaaattggtagaccactagcaagactaataaagaaaagagagaagaatcaaatagatgcaataaaaaatgataaaggggatatcaccagcgatcccacagaaatacaaactaccatcagagaatactataaacacctctatgcaaataaactagaaaatctaaaagacatgaataaattccttgacacatacaccctcccaagactaaaccaggaagaagttgaatctctgaatagaccaataacaggctctgaaattgaggcaataattaatagcctaccaaccaaaaaaagtccaggaccagacggattcacagccgaattctaccagaggtacaaggaggagctggtaccattccttctgaaactattccaatcaatagaaaaggagagattcctccctaactcattttatgggaccagcatcatcctgataccaaagcctggcaaagacacaacaaaaaaagagaattttagaccaatatccctgatgaacatcgatgcaaaaatcctcaataaaatactggcaaactgaatccagcagcacatcaaaaagcttatccaccatgatcaagtgggtttcatccctgggatgcaaagctggttcaacatacaaaaatcaataaacgtaatccagcatgtaaacagaaccaaagacaaaaaccacacgattatctcaatagatgcaggaaaggcctttaacaaaattcaacagcccttcatgctaaaaactctcaataaattaggcattgatgggacgtatctcaaaataataagagctatttatgaaaaacccacagccaatatcatactgaatgggcaaaacctggaagtattccctttgaaaactggcacaagacagggacgccctctctcaccactcctattcaacatagtgttggaagttctggccagggcaatcaggcaggagaaagaaataaagggtattcaattaggaaaagaggaagtcaaattgtccctgtttgcagatgacatgattgtatatctagaaaaccccatcgtctcagcccaaaatctctttaagctgataagcaacttcagcaaagtctcaggatacaaaatcaatgtgcaaaaatcacaagcattcttatacaccaataacagacaaacagagagccaaatcatgagtgaactcccattcacagtggcttcaaagagaataaaatacctaggaatccaacttacaagggacgtgaaggacctcttcaaggagaactacaaaccactgctcaacaaaataaaagaggatacaaacaaatggaagaaattccatgctcatggataggaagaatcaataatgtgaaaatggccatactgcccaaggtaatttatagattcagtgccatccccatcaagctaccaatgactttcttcacagaattggaaaaaactactttaaagttcatatggaaccaaaaaagagcctgcattgccaagtcaatcctaagccaaaagaacaaagctggaggcatcacactactgacttcaaattatactacaaggctacagtaaccaaaacagcatggtactggtaccaaaacagaaatatagacaaatggaacagaatggagccctcagaaacaataccacacatctacaaccatctgctctttgacaaacctgacaaaaacaagaaatggggaaaggattccctatttaataaatggtcctgggaaaactggctagccatatgtagaaagctgaaactggatcccttccttacaccttatacaaaaattaatttgagatggattaaagacttaaatgttagacctaaaaccataaaaaccctagaagaaaacctaggcattaccattcaggacacaggcatgggcaaggacttcatgtctaaaacaccaaaagcaatggcaacaaaaggcaaaattgacaaatgggatctaattaaactgaagagcttctgcacagcaaaagaaactaccatcagagtgaacaggcaacctacagaatgggagaaaatttttgcaatctactcatctgacaaagggctaatatccagaatctacaacgaactcaaacacatttacaagacaaaaacaaacaaccccatcaaaaagtgggtgaaggacatgaacagacacttctcaaaagaagacatttatgtgccaacagacacatgaaaaaatgctcatcttcactggccatcagagaaatgcaaatcaaaaccacaatgagataccatctcacaccagttagaatggcaatcagtaaaatgtcaggaaacaacaggtgctggagaggatgtggagaaataggaacacttttacacagttggtgggactgtaaactagttcaaccattgtggaagacagtgtggcgattcctcagggatctagaactagaaataccttttgacccagccatcccattactgggtatatacccaaaggattacaaatcatgctgctataaagacacatgcacacatatgtttgttgtggcactattcacgatagcaaagacttggaaccaacccaaatgtctgtcaatgatagactggattaagaaaatgtgacacatatatacacaccatggaatactatgcagccataaaaaaggatgagttcatgtccttagtagggacatggatgaagctggaaaccatcattctcagcaaactatcgcaaggacaaaaaccaaacaccgcatgttgtctctcacaggtgggaattgaacaatgagaacacttggacacaggaaggggagcatcacacactggggcctgtcgtggggtggggggatgggggagggatagcattaggagatacaccgaatgtaaatgacgagttaatgggtgcagcacaccaacatggcacatgtatacatatgtaacaaacctgcatgttgtgcacatgtaccctagaacttaaagtataataaaaaatatttaagaaaaaaacaacagtgatgatagcctgtattgatatagtatttgttacatgccagggcggggttctgaatactgatttggctcaaaataactctatgaggtaactatcattcccattttacacatcaggaaactggaggcagaaatattgttcctgcaataacaggtctcctccctccataagtgcaacctggcctgagacttggggcactgtcttcaccccaccccatccctgaaactgctctgataggaacaatagacctatacacacaggcacacacccagaaatagattgggatggttctggcctgggttattgtgggtgactcagacggtcagagaaaaaggtaatgtaacgcagacaaatgtgagataataagtctgaagccaatgaaacaaaggagagggagagcacatactaaataaaaagtcatgagtccctgcagcctggaaagggatttagagtttactgttaaaaaaaaacaaaaaaaaacaaaaaaaacaaaaaaaaaacaacaacaacaaaaagaaaaccctccttgaaattgtcagcactttgtactatcagagtacacttgggaatcgaggggctcctgtgtccatgcctgtggcatctttatccactgatggaggccaggaaggagggggtctggtcattccatcctgctggggtcaggctgggagcaggagagctgtttctgagcctcggtgtgtccacggtggatccatgcttattctgggtcccaaggaagaggctgggctgaaacaacaggaatgtgtccctgtagacagcccagcaagaagtggtgtagggtggggcagaagatgagttccaggatctcagagtaaggatttgcatggaggctggaaaatctggaagaaaggcaaagtacacgcggattgcagatggtcggggtgaatgggaaggcttcagccaaacaggatagatggcagccagaaaggaagtgtactgggggcttgaatggtctagaaaagcctgctagaagatggggcaaaaaaggtcagataatgcaaatatccagggacaaagccctctgggggaggaggagaggttttgagcatggagtgatggggatggtttaaaccaggccaggagcctttttttttttttatttctaattttaatttttagagtcagggtctcactttttttgcccaggctggagtgcagtggtaagatcatggctcactgcatccttgctctccttaagcaatcctcccacctcagcctcctgagtagccaagaccacaggtgtgagccacagcacccagctaaattttttatttttagtagagatagggtctcattatgctgcccaggctgggcttgaactcccaggctcaggcgatcctcctgccttggcctcccaaagtgctgggattatggacatgagccactgcatttggctcctgggggcatttttgtatccaaagaacacaaacagatgatattaacaaaagcaaaaccaactaattcagtcttcatacttataaggtcaatattattatccctgatttaaagaggaagaaactgaagcacagagggtttgggtaacttaacctcaggtcacccaaccagctagtgacagagctagaattcaaaccgaggtcacctggctgcattgcatgtgctcttgacaaagattctcaacttgatctgactgtagtcaggcttctcagagacctctgtccgaacaggtcctgaccttggtctttgtccttattccaggcccacttttagcaagaatcctgttgagtcagtttattgaaaatctcccaccctcagtatcttatcaccctggtccaccttcaaaagaaaccctgttaggtcagcttagtaaagaattaccctatttcttagtgagcttccacccaccaacctccaccccacatcccactccttgcctgtaaattgcctgttttctgattttatttggagtgggactcagtatttctcccctacttcaaaaccccgttgtagtagcttcccttgaatagtctttcttgaaagtctaaagacatctttagcagatgtcattaataatttgtttttaatattctttttttttcagctcactgtagcttcaacctctcgagctcaagggatcctcctgcctcagccttctgagtagctgggattacaggcttgcgccaccatgcccaactaatttttttatttttagtagagacagggtctcactatgttgcctaggctggtctccaactcctgggctcaagtgatcctcccacctcggcctcccaaagtgattggattacagatgcgagccacagtgcctagcctgtttttaatattcttttttttttttttttttttttttgagatggagtttttcccttttgctgcccaggctggagcgcaatggcgtgatttcggctcactgcaacctccgcctcccgggttcaagcgattctcctgcctcagcctcctgagtagctgggattacaggcacccccccatcatgcccagctaattttgtatttttagtagagactgggtttctccatgttgttcgggctggtctccaactcctgacatgagatgatccatccgcctcagcctcccaaagtgctgggattacaggcgtgagccactgtgcccagacctgtttttaatattcttaaccactacacatactcctctaatgttagacaaaaataaaactcataagaaggactccagtaaatgccataagtcattagggccaagcagcattgccctggatcatttctaattgggtatcaaaataaggcaagaaggggagagaacaattctctgttttgtcctacaccatagagtagcttgggcttacaatggcaaccatcaaagctagagggattctttggagcccaggctgggggcagagccaccagcagaagagagctctatggcaggaatgactagtgcctagaagagtagctcagggatgcctgaaagctaaaggagagaactcattcttgagaaaccctggaagaaccactgagaccccagctgcctgcagagacatttgcacgaggccaagactactgatgggagcaggtggggccagcagatgctggggtattccgattgcccagcctggtgagcttgcaagaaattgtaaatatttccctctttttcgtgactcgttacagagaggcgagatacaattttcttggagtgggggagcagagttgaacaagtccagtttactccgatttcaagaatgtttctattaggctaaagaagattcaggatgcttcgaggagggaaacgatttcaaggtgaccttgtggaaggagccggcactatgaaatgtttttgatcgagtggaacaagataagctgttcatgttgcggaagggttcaaagccctggacaccagctgaaataagaaaattcaatttctggcataagattgtgttttttctgccttctagaagaatgtacacatctgcccctcttctctccctaatgaaagcatcgtgttcctctgcagtcgttccgacacaaacggggtcgtaaaggcaggtttgcatggcataggtgataccactggcaggtactcagacacagagatggctgtttcagtccagaggcttctaggaaacttcacacatggccagggctgggaccagggagcgacccagggctattttgatatcattgtgttttcttttgttctcccacaaaagactcctccatgtttatcgaaaacattgctgtccagtagaactttctgcattcatggaaatgttctatgtctgtaatattcagtagggcatctccaaccacatgtgactcctgagtacttgaaatgtggccagtgtgacaaagagattcaatttttaattttatttcattttaattaatttaaatagcctcgggtggccagcagctatctcattggatagcacagtgctgaaagactcagtggaaagggcatgatcctcacgcccacctagattgggcttgaattctgcctctatcatttgctagctgtgtgaccttgggcaggtttcttaacctctctgaccctctctctcatcctcacctgaaaaatggggatgatgatatcagtgttgcaggattttggtggaaatgagttgcatgcacagaatacacagcaggccatgtgcaagtagtaaatcttagctgtagttattaattcataagtatgtctgtggcttcacaattgacttgggatttctcagttgtggacacgaactcttgctaacaatgacggggcaaagtggaggtaaggaatgaggggtcttctgtgttggaggcaatggggatcctgcagggctcaaccagcaggatgagctcagactcagggccccccaacaggcagaaggtggacttgaggcattgttgggcgagcaggaccagccagctgcccttccccgcccccaccagccgggcctccctgattaccgccaaggtgagaggaggcccctctcctaagagggcaaggatgaggagaagcagacagggagggagggagaggagagcaaagatgtgagttcattgcaaactcaggaaagactgaggacagagagacagggaccaagaaggaaacagatggaagcagggacaacagaaagcaaaggagcagacaggaggccatgcacagagccaggggcagggaaccgcaagggtgaggcgggcagagacacacaggaagccagggacacagacacagagaccaagacacagagacagagacacagagaagacacagagacagagatatggacatggagacatagagactgagacatggagacagagacatagatagacggagacacagaaacacagactgagataaagggacagagacacaaagatatagagatggagacacagagacagagacacagacatggagatatagagacaggaagctagagacacagagagacagagacacagagacagaaacagagggagagagacacgggaacatagacacatgaaaatagagatacagagagacagaggcagagacatggagacagacacagaaatacagaggcaggaagacagagacacagagagatagagacacagacagagacacaggaacacagagacatgaagacagagacaaagagacagaaagacacagagataaacacggagagatggaaacacagagacagaagacagagatagaaatgcaggaacatgaagacagagacagagagatacagagaaagagacagagacacagagacagaaatggaaagagacaccgagatgcagagatagagagactgatacagagagagagatgcagagagtcagagacagagagacaagcaaaaagaataagtgggatgggggacagggcaagacagagcaagaaacataagtcacacacacgcacgcacgcacacacacggacagagatgggaagacaggctgagagagacaaagcaaaacatagacagggaaataaaaagatgagagaagagtgagttaggaggaggcagggaggaaaagctggagaaggcatggatggagtggcacagggggaccgcagagacccacagcaagacggaaatacatttcaaaaaagaaaagcaagaaatggaggggcatagatgtggctgagtgccaaagggagactggttggcaggggcggggctgggagggaggggctgggtgggcccgcagcagcggggcagaagcagctccacctaggctgggggcttgcatggtgtatccccgtgaggtttcccaccgagccctctttgttcctccacctcctcctcaccatcaggcagagggcttgggaacttgggggcagccaaggattccagagcccccctcgcccgcgctccttccctctaactcgggagtcgttaatcttggagggcaggttggtcttttattagctatctccaagggtcagcttagaagtatctgagaagatactggttcagaatgtcatttgtcatctggaggcctgacgggtggccgcatcgactcagccccctcctgtcctccctggaatttaggaaagcgaaagctgctcttaacctttcccttaaatggagctttaattcctctctccttctctgtttgctcatcagggcagcgctatgggaacaataggaagccacaggcaggaaggggggattgctcctcccagggaaaggtggggtgtccctgctccttgcaatgcctccctccccacttcccagccccccacatcagctgttctcaagcttggttgtatgtgggactctcctaggaagctaaaaaaatggctgagggggccgggcacagtggctcatgcctgtaatcccagcgctttgggaggccgaggcaggtggatcacaaggtcaggagttccagaccagcctgaccaagatggtgaaaccccatctttactaaaaatacaaaaattagcagagtgtggtggccggcgcctgtaatcccatctactggggaggctgaggcagggaattgcttgaacccggagggcagagggtgcagtgagctgagatcatgccactgcaccccagcctgggtgacagagcgagactctctcaaaaacaaacaaaaaaagatgctgaggcctgggctcacccacagaggttgaaatttcattgctctgggctgaagttcagacattgcagcgttcaaacctgtcctcaggtgatagtaatgagcagctaagacgaaggtctgctgagctagatgatcccctacctgccttttcatcatcatccagtctcaaaccaggcaacacctcctctgagaggccttccctagtaaccttcccttgaaacaatgcctgatcacaatcccccattcatctgctgccaagcattagcagccatctaaacagtgattaagagcctggcctctcaagccagcacatgtgggttccgatccccaagccactcctccatagctaggagatctcgggccagtcacttattctctgtgcccccaattcccccttctgtaaactgggaatgataacgctttcaaggattctagtgtggattcaaggagccaacaaaggcaacgtgcatgggagagtgcctggcacagagtgagccctatattagtgtttgcaactgttattaccttgctttttatctcctcttgtttagctcttcctgcaagcttccttatggactaggccatgattatcatcttcatcgtccccattttacagatgagaacactgaggcatgagagagtaagaaacttgggcaaggggctaggtttcaccatgactgtttgactgtggccctccagagctagtaagggtagaagcctgtgcaagctggtaagaggctgggcagttggcctgttttaccctggcctgtagggcttgagctttcgtggacatcagcacagagaaagaggtgttccagttggaggaagcagcttgttcagccataggaagcagcctggggcttctgggaaaggtactggctctgggtggtgttgggagtgggaagaagttggggggagtggaggcagggctggcaccaagagctctggagggaatgtcaaagatggagagttgtgttgaggttttggttctgcgtccacatggagatggagaatgactggaacgcaggtcccctaacttccggtccttgggtcttgcccatggaccctggtctagcgcttcgaaatcgtagacaattgggatccgtgtctgaagttggttgggtgagatagttctggggtcaaacccctctaatctgggctgcaaactcaacacctccactctccagctgcatggccttgggtaaggtccatgacctgtgtctgccttggtttcctctcctgtaaatggaggtgaggaacctccctcagaggatgtggtgaggactgactgagacgaggcatgaaaagcatggagcaccctgcccgcctgagtaaacaaaatactcaccattgctgacactgacaaccatctcctgggtgggaaggatgaggagaaaaatagaacagctggaaatgattatgattgggatgtggcacaacaaaggaaggaaggaagagaggaaggaaggaggggagggaggggggaggaaaggaagaaaggaaaggaaggacggatggtgggaggcaggaaggatgaaaggagggagggagggaggaagggagggaggatggaagtgagggaggaaggagagggaaagggagggaggcagggacggagggaggaaagaaaaaaaggaaagaaaggaaggagggggaaagggagggagggaaggaaggaaggaaaaaggaaggaaggaaggaaggatggaaggaaggaaggctggctgagaggttttcacagatgaatgattttcagtggtaaaaccagggaagtcctaggcaaatagagatgagttagttgctctaaggaaaggtctaaagcagtacactttaattcttcaagcgcaaagtaagtcaaaagaaaagcaaggaaattgagtcaagctacagcacaaccaattgaggttagatctcatacaggacttcctggctactgaacaacaggcacgggtgggcgcgccctttagcaactgggaagaaagctcagagttcaggaggcaactaggagaaacggcgaagcgcctctctggggatggaaggtccgtgttggctgctggttgccctctgtgaccgggtcagctctcctgtgacccatcgtcctcggcagagccagcagtacatttccaaatgccagacatcagaggctcaggaaagatgctcagcccgattccgacagagcaggttaggggcaggcatatgcttggtggcacgcagcctaatctcagagaaagtgttctgatagaaagattcatgatagccatccgggctgcagacaccaggccttaacttccaattccaagagccctgcggtgcacgcctcttacccggcggctggcattgcagcaggtctcaggccaggcagatttacagcatattatcagcaaatgaatgtcacagctggtctttgtgcttcagaggaaaggaaaagaaaggaggacagttcagaaaaaaaggaggcttcaggatccagatgattctgaatccctttctaaccttctgtgtagacaggctggagctacagggtggggtgggcataagaaccctgcagccattgtctacagaaggcactgaagtctgcaggggtgggtgagcgcaatgcagcaaaccagggtgtttccataacaaaggggagcatgctggcctccccactccagcagaaagggctgggaggagagaacagtatctcaactctgcagctcaaacacacttcctcatctgttggagcacggtggtccaatgtgtctctgacgcatggcctcctggggaccacaagggggtaaaggaggtgactttagggtagggactcccaggatcacagcctcttctctaattccaggcaggaggacagggccataaaaaaacacaagttctgttttacttttctccaactggctataatgaaaaggttcaaatattcagaaaagttgtaaaagtaatgcaataaatagcacctagattcaatggctaatatttcgttagcaatgctctatcatacctgtttgatgtatgtgtgtatattctttctgcactatgtgaagttgcagtcatcgtgattcattacccctaaatacttctgtcttctaggaaaaaggcattctcccttctacaaccacaacaccaattatcacacctaagaaaatgaaaattctatatcatctaatatccaaattcaaatttcctcatttgtcccaagaatgcatttaacacattttcaaaaatgcattcttgtgacacttcgatcaagatccatgcactatatatttactatgtcgttgtagcatcttttaatctggacccgccacaaccccctctacatttttattacactgattttatgtagagtccagttgtcttgcagaatgtcccacattctggatttgccagattgctttcccatgttgtcgtttcacttttttctctgtctcacatattttctgtgaactggaatttgagcctcgatatgatcgaggttcgattctagttaatttcgtgaattagatttatgctttaccttttcagcaaggaacctttttagagggcactctgcacttcatatggcattacattactacattcagtggtaaataacataagggtgtcacgctatcaatgaagaaaagtgtgtcacttggttaaggcggtgacagctggtcacctattgtgaagacacactttaccctcctttactttacaaagatagccatgattgaggttggaactaggcaacacctcttttctccaccaatctttctccaaatggttatagcatctattgctaacacctgcctgaaatacttattaaactgcaagtttaaaaatgatacttttcaccactgataggtgtatatattcacaagaaaggaaatcagcatatcaaagagatagccccactcccatgttggttggagctgttcacaatagacaagatttggaagcaacctaagtgttcatcaacagatgaattgttgaagaaaatgtgctacatatttacaatggagtactacgcagccataaaaaagaatgagatcctgtcatttgcaacaacatggatggaactggaggacattatgttaagtgaaatacactaggcacagaaagacaaactttgcatgtttccacccatttctgggtgctaaacattaaaacaattgaactcatgaagacagaggagaagaatagttaccacaggctgggaagggtagtggcagagggtggggatgattaataggtataaaaatatagttaaataaaatgagtaagacttagtatttgatggcacaaccgggtgattacagtaatttattatacattaaaacttttaaaaataactaaaagggtctaattggaatgtttgtaacatagagaaatgacaaatgcttgaggtgatggataccccatttaccctgatgtgattattacacattgtatgcctgtatcaaaatacattaggtaccccataaatatatacactactatgtacacacaaaaactaaaaattaaaaaatgatactttttctgtctttccttctgtttctccttctgtattagctggtataagaattcttggctgggcacggtggctcacacctgtaatcccagcactttgggaagccgaggagggcagatcacgaggtcaggagttcgtgaccagtctggccaacatggtgaaaccccgtctctactaaacatacaaaaaaaaaattagccgggcatggtggcatgcatctgtaatcccagctactcgggaggctgaggcaggggaattgcttgaaccagggaggtggaggttgcagtgagccgatatcgagccactgcactccagcctgggtgacagagtgagactccgtctcaaaaaaaaaaaaaaaagaattcttaaataagttctttcgttttctttccctcttctttctaaaagtccctataggcttagaaattttagccattcaacatataacagacaacttctgtcatttctcaaactaaaattctcccaaatttggctattgcgagccccacaaacctggatttggggctcttttgacacatttccatcatttttgacacatctttgctttctgaaacaattggatgacccaagctcacttcatacatctctaccacagacccggagtaaatcattcctccaaagaatgaggctcctttcagcagggggtggcatttttaaaccaaaatctgggcttcagatgtgataagcacagattctgctgccagataacatgggtttaaatcttaatccaagtagggcatggtggctcacggctgtaatcccagcactttgggaggctgaggcagcagaatcgattgagcccaggagttcaaaaccagcctgggcagcacagtgagactctattaaaaaaaaaaaaatagccaggtatagtggcacatgcctgtagtcccagttactcaggaggctgaggcatgataattgcttgagcctgggaggccaaggcgcgcggatcacctgaggtcaggagttcagaaccatcctggccaatatggtgaaaccccatctctactaaaaatacaaaaattagccaggcgtggtggcacatgcctgtagtcccagctactcaggaggctgaggcaggagaatcacttgaacctgggagggagaggttgcagtgagctgagattgcaccactgcattccagcctgggcaacagagtgagactttgtctcaaaaaaaaaaaaaaaaaatgtctaattcagccacctactagctgtgtggtctcatgtaaatcacctcacagttctgtatgtcaattttctcatctgtagaatgggggtagtaacaataatatattccactttgttacattgttaaaaggattaactatgttcctctttgtgaagccattcaaacagtacttggcacccagtgagtgctatacagatgtttgttaaatatatatgtggccttacaacttatgaagacgggggagagggtggaaaagaccctcaggcatcctgagacagagacagaaaattctttttaaagatcttattcaacttggatgaacataagtgaaaatatcattatgtttatttttactctctttccatctattaatggcaagtcacactgacatgggaactgatttgacatgtggagtcttgaatcaaaatttccttcctaataatgaaagtaaatttttattcaagtaaaatagagatgcacaacaaagcttccttttaaaataagcgtattttttaaaaaatcaaatgagatgatttttaaaaaatgactaattcctaacagctatgaaatgcaatatgtcaaaaatgaatgatgatggaatgacagcaatcaaggtttgggcaatactctaataaagatgcctgggagggaatccttattcctattgtttggaaagatgtttcattttttaaattaaaataattattttaataagctctggatgcatgtgttataaggtccaccaccatctgagtccttcaaggctgaagatccaataggagagcgcaggagatctccatgagacaacagaaatgaagttgaaaattcaccttaatcatattttccccacctgcctttcagtgaggagatgtgggtggaggaagggctgaaatttccaggagggctgctcctgggagaagatcgtatagccctatgtggggtgctatacatgcccccacatatatttctatatgccttggtcataaatgcttatcccttggattttgcataaatgcaaaaataaataagtgaagaattaaaaaataaatgctcatcttaaacacagcatcggaagccatagaccgtctgcattgcgggttctctatatatagaatgagaattccctttccatccacaatcacctttgacttcttcgtattaaaacctggaccccaaagagcagcaactacaaaatgggattcattgaccagcagttcacagaggtccaaaaacaaacttagttaagagccgagggtaggaagaggcaagaatcaaggatggccatgctcaagcagagagaggcaaaggaaagcaaggatggagtctgtgtgtggtgtttgctgtattgacggacgttcagttttatgctttgacctccagtcaactcatcagccctttcatgagtatctatcacgtgccaaaacccagaggaactcaaaagaaacatcctacagcattacctaatgattccaaccattacatgtgctcttttcactgatagccctggctggaaactgaggttttaatcaggtggcaatttcagggtctttagagaaccatcctatgagaagtcactgcagggtgactatttcttggaatttgtagatcatgaaaatgggagtagtgccctagcctaggctctcccctcctccccttattctttccttcagtcacttattctcatgcagcttcagaagatggaagttctcacaccgccgtgaaaatgatcagctggaacgggaccctctccagagtacatttgagggtacggtagatgtaaagtggtagtgttttctcaaccaaaaattgagacatgcgatctgccaaaaataagtccctgtggggacagagagacaggctatttttaaggtgggactccctccgaaaatccggggtggaagctgatgacaattgtagtggggtgttccctctagtgagttttgcacaagtgccatttagcgtctgtctctgtgcttttctcacatacccaaagcatctgccagcagttgtgtctgcatgtgctttgcaatagacagggaagggagatgcgagcccagaactctttcctgtatgtggaatatagaactcccaggcataaacaagccccatgaagacagaatacgataaggaggttggcagttgcagtgggatgtcctgatttttctctcctctggatccctgccctgaaataatcagaagaaagcttctcaagttgatgtctttatagagtaatacctggagaaattttttaattttaaattttcttaaaatgccaaaataattaaggataatagagtccctgctgtggaataagaaccattcaattagttgaagtacactcctgtcaatcttgtaaacaaccggggatataaaattaaggacagccacaagagaatgaaaactgtgaagtcaggatctgagggtgctgtttctgcaagtgggcattcaacaaacattagttcataaatgaatgaatgaatgaactctacctaagttgcaaattaagagcctacatattttctttatgtcttttacattagatttgtgaagaacaaatctgactgattcagtccagactatgcagtaattcatcttggatcacatgactcactccatccattcagctgtggccacaaggatggattctacagtagaaatagcactctaggatcagggatgggtagggaacttccaaagaaggaaatatggatagagcaggcaccccaaaacttgatctcagccttcagttctttgctaagggcatgacaaggattattcgttcagtgtggctaagggaattatcctggtctggtttgcgtgatcttcggtggctcccatatggttttagtatatgttggaatggttatgttttgcttctgttctaaagccctaagtttgcttctgaattacccataatagtgcagatgcttgctttcttccaatgcattttgttgcaagatttgagctcactctctcgcaaccccttctcctccccttctccctttccctttccctcttgcttcctctctttggttctcctccctgccacccaagtactttgctgccgcacctctgtactgtttctcattagagtctttcctgcagaattaatattcttctgtggaactcagggagggctggttattgtgtttgggtgagaagggttcgttattcttctttgaaatctgagctataaacaggctccctgttgcatagggaaatgtagccatgatactttttgtataactataatgctattacgtattcccccagccctagaaaatgcaatgaatgggcattatggtttaatcactcttttcccagtgttatgtgtcctgcacttatacataggacacttaatataaggttggttatctatacaccatctagtcatgacaatgagaaataggtctgagtctcatgtttacaacagtataacaggttagtaaggtagtactctatcaaatgatgttggatcctcctaagggcacatacagaattgtacttcttcactcttttgatgttagacatgagcatgtgacttgttttgtccagtgaagcatgagcagaaatagaacatatcacttacaaatggaaatgttaccagccaatgtgtgatttttttttccatctactttttacctctaccacgctggcaacactccaaagtagacattccataggcctggatcttggagctaggagaaccttcagtaacttctgatagaccttcctctaagccacagcaatatgggttgtttgttactgcagcaaaacttagcctatcctgactgatatatatatatttatatataatatatatatttttatatatgtaatatatatacttttatatatgtaatatatatattttatatattatatattatatacatataataaaaatatctcacacataaaaaaatttctttcatgaatttatatatctaccatccatctgttcaaatacatattgtgcactttctatgcaaaaggtgtttgaataaaagagaattgattgtaggaagtgatatcaaataggacatgtgagatatatatatatatatatatatatatatatacacacacacacacacacacctatacatatatatacacacatgtatatgtatatacctgtaatatatacctgtaataggattgactatgcgtaaggcacagtgctaagtattttgaatgaattagtttatgagatttttttaattaaaatactttttttgagacagagtctcactctgtggcccaggctgggctggagtgcagtggcacaatcatggttcactggaccttccaggctcaagtggtcctcccacctcagcctttcaagtagttgggaccacaggcatgcaccaccatgcctggctattttttttaaaatgttttatagaatcagggtctaactatatcaccccggatggtctcaaactcctgggctcaaatgatctttcggccttggcctcccaaagtgcccagattacaggcatgagtcactaacccagccttaactttttttttttttaatcataagaaccattttatggtttaggaaaagaaacaaaaaactaagaaaaaacaaaacccgagcctcatagagtttctgtctctcacccagcattgcatagctaataagtcacagatttgggtttcaaaccaggtgtgtctgcctccaaactacttaatcactatgctatattgcctctttccaaacactaagatagttttgtgtttcctcagaaaaccatgagaaagcaaagaaaaataaaaactctgccctttcagatccttgcagccagccaggctctccgggtttggtttgacaggttgtcttcccttcaaaatgaaaagagaggcacatggacagaaataaaggccagctgttcagtggagcgagatacctgtgtgcacgccagcagagccaggcgattatttcaggagccgctggagttggcggctccgttctcgcctccatccaccctggatgcgtaggccagggctgacattacccaaataagggagaatctccccagattgcatgtttgtatacagacttaggaaaatgtgagagattctggttagaacacactgataccatcattaatcaacaaccagggagagaaattgaagggatgaaaaggtaggttcttgtacaagaaaaagatttgtgggaagagattagaaatattgagaaaccagagaatatttttgcaaacgtttttccattcttaaagtttcaaaagttaaccaataaaggcagcccccaaagaactcatgtatttattcattcatttgaaaaattactttctgaatgtttgctgtgtaggtgactgagatgtgaagatagaaacaacattttatggaacaaacacttagataaaacctactatgtatcaggcatgattccaaatgctttacatgtgttcattcattccatactcatttaaaaaattccagagaggtagctatgcattatctccattttgcagaagaggaaactgaggcacagagagttatgtgttatcttgctcaaaatcatgcaacctttgggatttttttttttaaatggagtcttgctctgttgcctaggctggagtacggtggtgcaatcttggctcactgcaacctccacctcttgggttcaagcaattctcctgcctcagcctcccgagcagctgggactacaggtgcgtgccaccacgcctagctaattttttgtatttttagtagagacggggtttcactgtgttagccaggatggtcttgatctcctgacctcgtgacccgctgcctcgccctcccaaagcgctgggattacaagcatgagccacctcgcctggccagcctttgggatttgatccctggtgggtctggcttccacactgtgctgatagcatactacctcacagggtcttggtcttcaagctcgcatgtcagtagagaagagagaaagaaataatcttttttttttaaattttattattattatactttaagttttagggtacatgtgcacaacgtgcaggtttgttacatatgcatacatgtgccatgttggtgtgctgcacccatgaaatcatctttttttagagtgtgaagcctgttttgatggagagatctgaggagaaagaattcagttctacttgaggacttcagggagactcttaaatgcttacatgcatttgttagcctggtgggcaagtggagaaaagggccccttaggtggaaggagtggtttgagcaaatgcagaggcaggagacagcctaggctcctcaggaaagtgctgaggcatggaatgtgcaaaggaggacagcaggagataaagcaaaaaagggtaccaggtcagaggaaggaggtgcgcctcttccaactaggcactgcaggggttgagcgtctgccttctgcaatgctgatgcaccagtggaaaagcatccgctgctttgtagatctctcccagctgtgctgttggaaaggcacccggcagctgagtgcagggctggctgggagggtaggtagcagagctattgagagagggccctttaaaatcagacccctctgagcttgaatctcagctctcagttaccacctgagtggtctcaggcaactgaccaaaccttccagagcctcagctgccaaatgggttgctgcaagggctacatataaaaagtggttattactagatctggatgtcgatgttccacttaagaggatgttactatacagtaggtgaaggtagacacatggcagtactgccctgccatgaacagggttgtttctcccatctcacagtgaaaaggaatttgtttgccctgatttatccatgttaacacacagagcttcctgaaagaccaaatgcaaggtgaagttgatgtgcagtcagcagagccaatcaaattggctgatgtgggaaaccagctcacactctccatctcaatcaagcgctctaatccagagatgttccagctttaaagcacacacaaatcactgtgatcttgttaaaaggcagactctgactcaataggactggggaggagcctgggattctgcatttcccaccatctccccatgctgctattccattgaccgccattggcatagtctggccccaatccgcaagatcactttcatcatcctaagacctaagttatcaagcccaagagtgaaaatgcaacccaatgcctctcattaattggcttattctctcatccttccgttaaatattttctaagcatctactatgttccaggtcctgggaaaatacagatatatacaacataggccctgtactcaatcagcttgcccaccctatgcacatggagaaggaaaagagaaggggactggccatttggggggtactcacttcacatatgacatctcagtgaattctcccaacattctatgaaattgcaaccattcaacccacattagagactaggcaactacagcctgccgagtaaggatagctcagggctggggcgcggtggctcacacctataatcccagcactttgggaggccgaggtgggtggatcacctgaggtcaggagttcaagaccagcctggccaacatggcgaaaccccaactctactaaaaatacgaaaattagccggatgtggtggcacacacctgtaatcccagctactcaggaggctgaggcaggagaatcgcttgaacccaggaggcggaggttccagcgagccaagatcacaccactgcactccagcctgggcaatagccattgttggcattgggatttgaagccacatcttttgattctgagatcactgcctcgtttatacttaactgtaagttgttgattgtgttctctttttatttactttgagcttggctgtgtctctttagttttagagagtgaacttttttccctcataaatttaaatgctgacataaggaggaaaaatcctgctgtaattgaacaaaaggatgtttacaaccttctttgagtcatagagctcctggcacatgaaatttatgactgcaaggaaaggggaaataaaaagaagggggaagaccaagacagatgtaactgtggaaatggtgtgctaatgtatgggttgacattctgacacttgcacattcagttgggtaactttttggaggccatttcaccagctaatgaagatttacttaataaactctcaaacttgccagagctagactctttaaaacaaccctataaattacaaagatggtggcatgttcaagagaccttgcagttgttaaaggatggaatgcagttgccagagttacaaaggtcattgtctaggaatcttgtgcccgtctctggagggctgagggacctttcaaaggactggctccgatgtgtgcaccctatccagataaatgcatacagatgttctttgaacttgatcaactcgcttctcagcatgaatgcaaaattgattgggccaaatcagagctcgtgccagtgaaggctggctgcatacagaaataaaatcagccacctcccatttacttagaagtctctggcttaaaatacattggaggaaaatgtgcgcttcacgttagagcaggagccaaattgcacagcgacaaaattattcccatcatcatgacagcctcagccaatcgtttccttttttaatgtgctgaaaggaggcaagttggcatcattaaaagtatttttttctcaaaaatacatcatgaaatatggagaaactagaaacagaagaagggggcccacgcataaatctaattctgagaccggactatggagattttctgttctggttgcactacgaaggttctaaggaaagaggttgtattttttgcctcccgcctctcttgatggcctgaggttgatgtggatgtagattttttttcctttaattcagctcccgtttttcaagcagtgcccctttcactgaatgattatccccagtaacctttgatcttcactcttccttgatgaaaaactgcaactatatcatgtctttttgatgtggtctttcttaagtactgagtcaaggtgatcattgatcctgcacgccttcatttcctcttcccaaatgagtccagtgttcccttcacccttccttctgtcttttattacctaacgaagttctagaagccaagccaggatgctctgatgtgaaaactgcctaaaagggaaaggttaaccctgaagccagtgctcagccagcctgtctgagagatccctgttcctgagccataaagcgatgcttcttcatacccatttttgtccttcagcttctttctgtggagaaaaaaattttttctctaattcagacccagcaaattggtgtgctcctaacttagtctcagaaattctgatttccagatgtcttatgccctttaatatctgtttcagattaccaacctcaccactgagaactgaaagcatgtgtttcttcttctgtgctaagttgcattttgttcttttttcaaacctcatccttagaaattagactttgctgtctttggttgtttctagtacacaactgagatttcctttccagcaccgtgacttaatatccctttctggaatattacttacggagagaaggagtaaattcttcaagattttgaatattctataagactatgtccccatttttacttcagaggaaatcggtcaccattgattttaaggatgaaagttgcacagatgaagagggagcatattattcaaatcaaagcccagtaattcagggatgatcaaaggtttcatctcacatgtcaagtcaaataaatgggtagtgttgtctggcacgctgtggtgagaaaattctgaggctgggttcagacaggatgagaaaatgtggtgaaaaagttcagtaatgtccgccatgggtgatacgttaggacatctattcactttttaaaatgctaactcttgcataagaaaatccacagtttttctgatatacctaccagatatattttaaagaagtttcaagaaaaagtcaaaatttccagggcaaactatcaagtggtcttcccctaaagcagacacttctgtcaaaaggttttattacacacgccaactctgattgataaatgattgtcaggacggctgggttaatctccataactgattagtaatgtctaccacagatgaaggcatggacgtggtgctacatgtacccagtattttctctcctggtttagctcaatatgccatttactctgtcttaggaaactaataaagcaatgaagtttttgaaggcatcccacagagtcagggcatgggttaatctctcctctgttagaggagaagcagaaataaactgaatcaagcaaaatgttaacaaccctgcacccaagatttagaacacatactttctcccatcgcatatggaatatttacaaaatttgaccatatattggccataaagcaagtatcaatagaatttgggccacattctaaaaccatataggaaaataaaagtaaaaccccttctatggtttgaatgtttgggtcccctctaaaattcataagttgaaacgtaatcctcaatgtgatcatgttgggaggtgaggcctttaggaaataattaagtcatgagagcagagccctgatgagtggattaaagccataataaatggccaagttcagctccctttgcctctgcgctcttctgccacatgaggaataatattttccccctccagagaatgcaggatttcaggtgtcatcttgagcagaaagaccagacaccaaacttgccagcgccttgatcctggacttcccagcctccagaactgtgagaagtaagtctctgttctttacgaattacacagtctcaggtattctgttatggcagcacaaaatgaactaagacaactccttttaaacaatttgatagctatgtgaaaaactcactatatatttgcagttttaaaaacatgcttctgaataattcatatactatctgacgtaatttatttgtgcgttttttgcctttcctcatatgaatgcaagcttcatgaagtcgaggagctatgttcattgtactacccacagcatatatacagatctaaccttgtttcagtaggggcatgctgaataaatgaatgaatgaatgtcaacacttaagatattctatttatgaagtacttgaagggaaatgtgtaaccttaagtagatatattagccaggaataaagatacaatatgatttaaacatttaccttgggatattaaaaaataaacagtaaattgaaaaaaagaagagtcttttaaatgagcacagtttagtggaacgtaaataacaggaataagaagagaacaaaacaattatcagggccatttggtattttttttggcaaaatctataaattttcaaggaacaaataatcctatttcttataaaacatttttaaaagaatagaaaaagaagaatggaggagttgattttgtaataaaatatagcctttatatcaaagacaggcaagaaaagttatgtcaatctcatttatagatttatgtgcaaaagttttaaacaaaatattggtaaacaaaaatctagcagtgtgaatagaaacaaacagataaccataaccaaatagagtttgttctaggaatgtacagacagtataacattagaaaatctattaatgtaagttattatgtaccagattcaagttgaaaaataaccatcttcatgtagacagaaaaaacattcagtaaaatttcacattcattcatgtgttaaaagaaaaatgttagcaaactaggaatagtaggagaaattcttaacatttgaagcaaatttgcacttgatatgactgtctatatgtgaaaatcaagactatctagggcaaactatcattttttaaaaaaaacattatgaatacaaagtcaaataaaattagcatatttgaacactatcaacaataagttagaaaacatcattttaatgtcttattcataatagcaaacagaaaataagcttttataggataaatgtattgaaagacctgtcgttatagggacaaatataacatttaattaaaggatagaaatgaagatcatttggagaggaacaccaggttcatggaaaaaagcactatgataaagatggaaatgctccagattgatctatacaaccaatacttcaatcaaaattcaagcagatcatttttcataacacttgacaagcagacccgaaaattcacaaagacatgttgaagccaagaacagccaaaacaattttgaataagaagaacaaagatgaaacacctgtaagatgttaagactggttataaaacttaaataaaagagtgtggatctggtgttgagagagactattagaacaatgttaaaaatatccacgaaaacaatccagaataaagatgatgtttgcagtaaacaaaactgaatatacaacaaattcctaaagtcagtaaggaaaaagacaaaactgagtagaaaaatgggcaacgcttgtgaatagcaattcatacctgaaggaacacaaatcttccataaacattttgaaaaggtgcttagggaaatgcagtttttaaaatcatctcatagccattgaattatcaaagtttcttcataaggatgtggaaaattcatgttttgatacagctggtgggagtagaaatttatacaaccattttgtaaaggaatgtggagttatctgctttgttacgttggttctaagacgttcctcctccacctccacacgtactgtcccccactgccacattttaacattgcctaaatccaaatccatcttacagttgctgctttcttaatattttaaacaacattttgggtgcaacttacattagatggcctgttaggtttcataaaataagtagtaaatttgaagatgttcacccttttggatccagccatttgattcctagatgggtttctagaaaaactcacatctatacacaaagacatatacaatgctattcattgtaaaatttgattttcttttaaaagttttgctctaagaagctaaaaaattggtttctttcatgcttatttcagtaagaatactgttgcctacacacagagaaaaatgtattacttcccataagaggtcgagaagagttgtttaatttcctgactcaataatgatctcaagatctcagatttatcctatttctctgctttgccacagttggcttttagacccatttatttatatttgctcacttcctgatcacaacttccctaccttaacaagtgcaggggcttcaaatgatctcattattgctgctattgttttattttaattttgaaataattgtaggttcccaggaagttgcaaagatagtacaaagaggtcttgtataccaatcacccagtttctctcaatggttgcaccttccacaactttgaaacaatgtcagaaccaggaaactgacattgctacaatgtgcatgtatataattttaggtcatttgatcacatgttcagattcatgaaaccgccaccacaattatttaaaaccaagatggggagctattccagcaccacggagatttctctcatggcatccctgtacagtctcaatcatctccctaattccgaacatcacctaattcctggaatttttgttttccatctctaacattacatttgatagtaagacatagcaacttactttgcaaagcagcaaaaaataagatggatggatggataaatggacaaaaggatggagatatatggagtaataaggcacatatagcaaaatgttaaagaatctgggttgagggtatatggttgttcagtgtacaactcttgacatttgtctatatacttgcaaattttcatcaatataatatgggaaccaaattgatctaaatgtccaccagtagggaaatgaataagtaaattatagtatacactgtaagtatactatatgtctataacagatgattctatagcatttaacaagaaggaactagatcttcatttaacaatatggctaaatatcaaaaacagtatactgagtaatgaaaaggtatgtttcagaataatgtacatggtgcaactgaagctaacacctacaaaatatcagaaaggtaaccacccctttgaagtttttgttgcttgttttcataaatgattatacaacaacatcatgggtgacacctggatattgtcgagaacatgggtgcatgctatattctttttacttttcatatttgagatgcattactattaatgaaaatttaaatcaaaaaagaaacgccacataggtccacatacggtggaagatactggctcaaaattagacttcagagaagtgtgagtcaccttctacacattccttttatagtcgctcaaattatgggacacatttgccaattactttactttaaagaacaaggtactttgggagaaaacacattattctgaaacgacctcaatcaatgctagctttggatgtttatagaggtcccacgacagaatcagtaaacaaagaagcaggtaaatttaacacatttagtaattattcctgggagtatggccttaccactgcaagtgttggttaccatgataaatgaaacctgtaaagctacttgaaaatgaaacagactaagagcttgtattttgtagtcaataagcagatgtacacagaacagatgtttttttaaaaagctgttcatcatatgaaaaaaagctcatcatcactggtcattagagaaatgcaaatcaaaaccacaatgaaataccacctcatgccagttagaatggtgatcattaaaaagtcagaaaacaacagatgctggagaggatgtggagaaataggaatgcttttacacagttggtgggagtgtaaattagttcaaccattgtggaagacagtgtggctattcctcaaagatctagaaccagtaataccatttgccccagcaatcccattactgggtatatgcccaaatgattataaatcattctactataaaggcacatgcacacatatgtttactgcagcactgttcacaatagcaaagacttggaaccaacccaaatgcccatcaatgatagactggaaaaagaaaatgtggcacatatacaccatgaaatactatgcagccataaaaaaggatgagttcatgtccttttcagggacatggatgaagctggaaaccatcattctcagcaaactaacacaggaacagaaaaccaaataccacatattctcactcgtaagtgagagttgaacaatgagaacacatggacacaaggaggggaatatcatacaccagggcctgtcagggggtggggggctagaggagggataacattaggagaaatacgtaatgtagatgacgtgttgatgggtgcagcaaaccaccatggcacgtgtatacctatataacaaacctgcactttctgcacatgtatcccagaacttaaataattttaaaaaaaagctgttcatacttttcttatcacaaaatttaagataatgtttcctccagggaaaagaatgagttttgatcttttgaggacctggaaatatgctatttctttttctgggtggttatgacagttgtgtttgctttataattatacattgagccattcacatgtgttgtggatatctttgtattttattattattattattattattgagtcggagtctcactctgtgacctaggctggggtgcagtggcacgatctcagctcactgaaacctctgcctcctgggttcaaacaattttcatgcctcagtcaccaagtagctgggactagagttgtgtgccaccatgcacagctaatttttgtatttttagtagagacggggtttcatcatgttggccaggctggtcttgaactcctgacctcaagtgctccacctgcctcagcctccccaaagtgctgggattacaggcatgagccaccatgcccagctatttcgttatgttttacaataaaagaaaaggtgtcctaaagttgtgcaaattagtacttgcgggttggaatacaatttcttgtgaactcaaaaattgctagttctcatgtacttcggatgaaagtgaaattagcatgctcaggaaaattgtgggaggaattgtaccaatgtcagtttcctggttttgagtcaggaaaatgactcaaaagtgtccccctgttatgccagagaaaatcatatagaaaatgcatggaaaaatttgaatgatttactgaaatgcaagaaaagaagccttatatatacattataattctgtatataatttcaaatgtatgtgtaactaaacaacaaacttactatgatcactagatatgaagcaatgttatcaatgtctcacaactgtaaaaatgtacattggttaaaaatttttaaagggtgaagaatcttctagtagagaaaatgatgatcaccatgcatttggggccaccttatttgtggacatacacagctttccacaattatgatagctaacacaggatttttctcttttagattgtgtattgcaaagacttgtaaaaaaaaaaaaaagtcatatcttgaaagatctttacaaatcacgtttttccttttctcccaggtagagcaagagaaggaggggagagtttgatcctcctgaaggaaagattgcccccctaaaaacttggagataaagaaaaataatggagttgtcaaaaagatttcactctccccatggtcctgatagatatttgtcaactcttgtcagaatggcttgtcattctaatgctttgctcttccctgaaaaacaagaagctaccagcacgaaggcagaagagcaatgactaagacagaatctgcacattcctaaatcattatgcaggagggtgatatgccaagataaatcagggttgaatgggaaagagctaatgtttggtgaggaaatatttattatgggtcactattgcatcatttcagaataatgaggcaaggacagggagaggggataagtaaattcatgtgatggaaaatgaaattttaaaaacatatttacaattcatggaaggccaaaatattttaagtcctgggacagttagaaacttccttatttcacacaatgcctttgaaaaccaataagaacaacaacaaaaaaatcaaggggtccacaaaacaatttttagacagaagtgttgtttatttgatagtactaaacaaatataaattgagcatcctgagagcatatttgcatagcctattgttaggctactctttggtgatatccagaaaaaagttctttctggtattgattacatgaaactggcaccttcctataggacaaccaatcacaaggtgtgaaagtgatgtaaaatctttttgacgcacctgcaaggttcaccgtgggtgtttgtggaaactccttgtcaaaactctgttttacatgctattagtatacatagtcaaacacaacactgaaagaatcatgggtggcccagatctaggagacacatctgacagtagggagcttgggacttcaaaaagtcaaaagactagattgataggaggcagtgcttaatgcatagtaggcagtccataaatacttgttgaatgaatgaagtagactagatggaggtctaggagtgggccacttaaggtcatagatacatatgaaaccaagtatgcagggactcaactggcttctggggattggaaaaattccaggggtctttccactcactccagagagggggaagaagactagctcagcaaaaacaatgatgcaattaatctatgactagtactaaggggtggagttttccaatataagcattttatctcttggattaaaaacactgaatgggctgggcacagtggctcacgcctgtaattccaacactttgggaggccaaggcaggtggattgcaaggtcaggagatcgagaccagcctggccaatatggtaaaatcccatctctactaaaaatacaaaaattagctgggtgtggtggcacgtgcctgtaatcccagctactcaggaggctgaggcagaagaatcgcttaaacccgggaggtagaggttgcagtgagccaagattgcgccactgcactccagcctgggcaacagagtgagactccatctcaaaacaacaacaacaacaaacacacacacacacacacaaaaaccactcagtggtttcccgcttttcgtagaagaaagtccaactctttactatgattgtgcttggtcaacttctccctgaagcagatcttgaggatggggagaggtgataagtaaattcatgtgatggaaaatgaaattttaaaaacatatttacaatccatggaaggtcagcatattttaagtcctgagacagttagaaactaccttatttcacacaatgcctctgaaaaccagtaagaacacaaaagcatcattgagtccacaaaataatttttagacaaaggtgttgtaaattcgacagtacaaaacaaatataaattgagcatcctgatggtatatttgcatagcctagtgttaggctaccatttggtgatatccagagaaaagttccttctccttttggttatgtgaaactggtaacttcctataggacaggtaggaaagactttggtgcatgtgattgatgaaggaagtgcttccaagagatctggttagagaaggagaaggtaaggaagaatgtgacttcaggccatgttctaccctcagcctgaccccagagggagcggtggagcataaattgcacctgagtttgttctgcctcaagacaaggaaactagggacttgtgctccccaccagcaggttaactgctatgggatattccagggggtgccaactcagttctcaggataggtgaggtggttccaatagacccagagcgatcttctgtagaaggtcacatgtgccagccattagcagcaaagctggcggaggtatgcacagagctattaaaagggattggaggagatttggaaggggcaaaatatatgtctgctacaacagtcatttacaagcctacatgatgttgttccaccaagctctctatcctctgtccccaaggtcttatattagccaaggttctccagaaaagcagaaccagtaagttacgtctatctttctttctttctttttctttctttctttccttctttctttctttcattctttctttcttttctttctttccttcctttcttctttctttctctctctctctcctctctctctctctctttctttctttcttgtgggagatttacaataaggaactggcacacatgattataaaggttgagaagttccacaatctgccactgggaagctagagaccccagagagctggtggtgtaagttccagttcaggcacaggagaagacagatatcgcagctcaaaaacaggcagagagagagaattctttttcttcctttttgtcctattcaggcctccaactgattggatagggcccatccacaatgggcagggctttatctaatttactcagtctaccaattgcaatgttaatctcatccagaaacaccttcatagacatagaatatctagctacatatctgggtaccccatggcacagtcaaggtcacacataaaattaaccttcacactctcattagtttctgcactcaagccacaaagattctgtgcctggagtatgaatgcatagattgagctcgctcaagacaaaagaaggtaatgctagccaggagagtttagatgctgaattctgaaaataacgtcataaaaaggctacagtgacctcattccaaagaagttagtttttgattctttgtttatttgtttatttacttttttcttcagtgagtcttgtcctttaaagcacaggctacagactggctttttattttactgagctccagaagtcagaggaaaagatagaggcctttttcctgcaacatgaattctccaaagagcttatcttgcccccaagggggtgaaaattggctcttttggggacagggtgaaaaacaatcttattctttttatgtataaagcacagatatacatacagcgcattaacagatacacccagtgtatctctggttttaaaaatttcatggggaggccaggcacagtggctcatgcctctaatcctagcactttgggaggctgaggtgggtggattgcccgagctcaggagtttgagaccagcctgggcaacacgatgaaaccccgtctctactaaaacacatacacacacacacacacacacacacacacacacacacacaaattaaccgggcatggtggcacatgcctgtagtcccagcaactagggaggctgaggcatgagaattgcttgagtctgggaggcagaggttgcagtgagccaggattgggccattgtactccagcctgggtagcaaagtgagactctctcaaaaaaaaaaacttttttttctcattgggggatgattaggaataaatgtttaaattgactctgggagaagggaaacaataataatgatttgaagaaattaagaaagacaattctaaaaccataggtatctaaagctaaaaggaagcacctcctttatctaagaccttccaacgggcacctcaaggacccggatgctccaaacttcctgaagttcacacagggatttggtgagagagcctggcatagaccaggattttttctgtcctagaccaatgcacattccacgtgtttcatgcaaaacttcatgtatctgtgagcagggtccaagtctgtgcatctcattaacccacatccccacaaaggtgacgctttggaaaggaagtaaattatctacgtggtcaaattacacacctttgtaatccttcagaagagatatgttgtcttgctctctgaatggtgagacaaggaacagtcagagcagagagagaatacctagagagctgcaacatcggggcaaaaatgtatcaggaatcagaagcaacgcagagctcagagaagtgggagagaattagtgcagcgtaggaaattagccttcttcctgactcctcatacactcttcatgtctaaagttgacttcttctattgctgcttttttttttttttttttttttttttgagacggagtctcgttctgtcgcccgggctggagtgcagtggcgcaatcttggctcactgcaagctccgcctcctgggttcacgccattctcctgcctcagcctccctagtagctgggactacaggcgcccgccactgcgccctgctaattttttttatttttattttatagtagagacggggtttcaccgtgttagccaggatggtcttgatctcctgacctcatgatccgccgcctcggcctcccaaagtgctgggattacaggcctgagccaccgcctgtaatttgctgcttaaaatccatccagaagctgagggggtagggggtgaaaacatggaaaaagataaatgaaaatctagtgaatgataatgaaggttttatttatcatccaataaatcattgtcattagactcacctatgtgagtctagttttacaattctctgactgttccctgtctcaccactcagagagcaagataacatatctcttctgaaggatcccaaaagtgtgtaatttgaccacattgatcatttacttcctttccaaagtgtcacctctgtgggggatgtaggttaatgagatgcggagacttggactctgctcacaggtacatgaatttttgcgtgaaacacatggaatgtgcatgggtttagggttgaaaaaatcctggtcaatgccaggctctctcaccaaatccctgtgtgaactttaggcagtttgagcctctgggtccttgaggtgccatggaaagatcttaggtaaaggaggtgcttatttttcactttagatacctatggttttagaactatctttcttaaagacaagctcacctatgtgagttagctttaccattctccccagcgtctgtttcattcatgcatttatttgttcaagcatttattgagcacctgctatgtgccaggcattgtcctccacgctaacattggtggcaggaaagcactaagatacagtaataaaaatcagatttggtcctaactccaggcaaattttaaatttcacagtggagctaagtaaaataggtagacaagcctacattttaattaaattaccttccgttccatggctggcacgtgacgagcatattttctgactgtgcagggggaaatgggctgtgtcatatgtgcgagttccactctcctctggcaggcttcttaatccatgtttgagggcagtcaggattaaatgaaattatgggaacaaaaaacgaaaaatgcaaaaaaaaaaaagttttaattggcttactctgatcttcctgctgtgattgtatcaacgagttggcagcttgtcagttgcagttgccaggcaactctgagcggtaaggcgaacgtgtcagcctgtgtttcccatcttgtttgagtctcccagtgtctgggactgacgtctggttctacctgaccctccacaggggtctgggatgctccacgcagccccatgaataagcctctgacctgctgctcaaagctgcctcatggggaagtaattgataaaacttcagcccttattcaacaacttagctctctaactgtgaccttgctggaatggccccagggaccctgtctgagtcttcccagcccctcaggtacatcagcagaacaggtgtgaaggcagagacaggagaaacagaatgcctgcatcctcctcccctggtgagctacacatacttggaagccccattctgatgtcgtctttcctattcacactcatcgagcccacagagaatgggctttgcagtcagacctagctgggtccatctgttacatacaagccatgcaactttaaagcatattcttagccccgctgtgcctctgttttctcatctctaaagtggagctgaggtggaaaggtccttgagcctaggcgtttgagaccagcctgggcaacacagcaagatcctgtctctacaaaaaaataaaataaaacaaaaattagctgggtatagtggtgtgcacctgtaatcccagatactggggaggctaaggcaggaggatcacctgagcccaggatttcaagactgaggtgagctatgatcaccctcttcactccagccttggcaacagagtgagatctcatctcaaaacaaaacaaaacaaaacaaatgaaaaaaaataaataaagtggagctaacactacttctatcccagggtgttgatgaagttttactgaataaaaacaaatgtaaaatgcttagttcaatgctagcatatagttaatgctccacattttagcaactgttatccaggcatccatgaagaactttgaggcatttgtagaatcccggagctgaaaaggaagttagctagtgattgctgagtctcctcataccttaagtcaggaatctgagacccagagaatcaagagtgttgtacccaaagccatgtcatggggattgaaactcagggctcagttgccaccacaaaactttgccaggattgggtacaaaaaagaatcctcctgtattaaacatatcttgcaggcaatgggtaatagtatttgtgttgagtaatcagagaggcattcaacggacacagctacccagaagacagcctgtttggtctgagaaagtatcatgtgcttcagacagggccgtgtctcacagaagatgtctggttatttccctgctggctgagagaagatgatccacccactttaccatggcatccaagatgtttcttgacctggctatggctcccactgccgtccaattcccctcctccccattcatcttcctgttgatcctcagacgtgccagggagggtcctgcctcagggcctttgcatgagctgttccccttgtttcgaacacagatatccatacggctccctccttcacgtgcttcaagttgttgctcaaagatcatgccctcatggaggcctttcatgagtttcttatttaatactgccaccctctcaagcactttctctcctctttccctgattttccttaaaggacttgtcaccacctgcctcactgcctatgtgtttgcttgtcggtcatgcctgattgtagaggcaggccccacctttacactctaagctccatgagggcacagattttttgcatttggttcattgccgtattcccagtgcctagaactgcacctggcacacattaggtgctcaataaacatttctggaatacatagaaacctctctctgtgaggtttcctctgccctgcacctgccccatgttcattgtccttacccctactcacccttcatgaggcagcaacaagcgtaccctcctttgagaagacgtctgtcctcacctcctccaactggaatggagaccttgccatgtgcctccatagaatcctgcacctccttccagaagggcagccatcaaattgttgcaataactaatttgcctggtatcccaccagaagcttggcctgttctacaattagaggggcagtgaaagaaaaagaagtcttcctctgattaacttctctggctggttgtcagagaccaagcttcctgcctcccattccctgccccaatcccaaagcatttccctctagactgagccacttcagggcagggcttcatgtcatccatctttatattcccagcatacagtgcagctcctgacatggcataagggcacagcgctgttgctcaaataacaatagtcagggctcaccttgagccatgaaattggcctataagggctttccaaccttggcacttgagacgtttgaaatgggaattctttgttgtagggggttgtcctgtgccttggaaaatgtttagcagcatcgacctcaacccatatgccgaaaatacacacaccaattttgcaaccaaaacatctgcagacattagcaaatgtcccttgggggccacacttgtcttcagtttactgtgaattaattcattaaatcctcacagcaatgctataagggggtactgttatgaaatctagattacaaataagtgaggctcagagaggttaggcaactcactgaacatcacacagctaggaactggctgaatcaggatatgaactgggcagtctgactccaaagtttaggcaattaacctaatgaattaatgtcaggagtcgggtgaggaatggggatggtgtgtttattacatgcaggcactatttttagtttttaaatggattgcctcatttaattgtgtctagcctttaacacagtcattgttatttctaacattgtacagaggagggaattgaggcacagaaagcacctgccaactggaggcagagcggccagaattcaagcccacgcagtatgactctaaagcttacggtggtgggaggtggggggctgtttccactctgctccaattctgcacaaagtcatgctgccctttactcagctttccctgccaggacagcctggcacagtccctgtgttccctctgaaatagcttcactgctactcactctcagtgggcctgactcccggggcaccgagccctgagggtcacgatgagtgctttcaagttccaaagcggtcttatacacaaagccaaccgcaccgggggaaactgccagaggcttccccagggttgggacttccaaagtgggggcagtctttgtcttcaaccaaaccaggcttcacagaaaagcacgaggagagcccagaggggagatcttaggggtgttttcagaatatcatgaaagtcttctctgacaaaaaaaaaaaagagagaactatgagcaccttccccaatcccctccctttcagtagttaccgaagcagagatggtgtgtgtttcagaggcatctcctgacatgattgccctgatgtttacaataatgatcagatcattttcccacagccatttcatccaatgagcccaaataggattactgagaaattgcaaggtcttgcaggaaatttctcttctgaccttgggcattgttaggatgactcacaggaagcaagatcccctttcattgttagggaggacaattctgcagcctcttctccaaacagggtgatcccaaagtggtaaggaagagacattctgaatggcaatcatttatcacctgtgcacccagacacaaccacccactgtgcccacatgatggggagacatggcgtgtgactgtttctgtgagtctccactgtgaagcaatgtcagcttctcttatgcaataccctcagcttcagcgagatgcagagaaaaaggttatactagagcacaatcagttctccttcaaagacttttttctttttctttttctttttttttttaattttttaagacggagtttcgctcttgttgcccaggctggagtgcaatggtgtgatctcggctcactgcaacctttgcctcctgggttcaagcaattctcctgcctcagcctcctgagtagctgggattacaggtgcacaccaccaagcctggctaatttttgtatttttagtagagatggggtttcaccatgttggccaggctggtctctaactccttacctcaagtgatctgcccgcctcagcctcccaaagtgctgggattacaggtgtgagccaccatgcttggtcttaagacttttcttcttaaaaacacagcttgataagtagatgaggatagtgaagaccatatgagaaaagaaggatgagggcagatttgtactgtcagataccgaaatgcacactttaggtacaataattgtaatgataaatatgtatgggcaagaattggcaaaaggatcaatgaactaacatatatagctccaaaacaaatagtacacattctttctttctatcccttctttcttctacacctgcacgcacatacatgggcacacacatgtacacaataagttcagcactgtaaatcaataggaagaggaagattcatccatcagatcaattaatgtacccttgggaaaacataaatcactctaggtatttcaaacagtagggactttaatacagggaattgattacaaatgtgtagaaaaataagaggagcaaagtagagattgcccagggattaacacctgtaggaagccagtacattctctagagctggatgatgaaaagaggtattatcaagaagtcaagagtttacaatactgctgatgctgtcgccagaagcagaaaaacagtttctacacttttcccatttgtgaatctcatgtgatcgaccccactggtcaccatcgacccatacccagccgccaaggaactctggaaatatagttttcaggttccccgctgtggtgtagagtggaatagacataaggacaggcatagggctgagatttgacagaccatgtttggcaaagaggatttatttgataatgctacagaaggcagtgagctggtaactgagcaaaaacaaacattttcgcttcttgctgtaaagcaaaatcaatcccaagttgtgcaaagggttaaacatacacaccaatattcaaagacagaaaggaaaagaacagcaaaacagaaaaatatgaggaaaatgttatgatttaagggtgaccaataactttctaaatattgaggcaatgaaaaagttatgaaagaaaaaattatatattagaataaaaataatttctaatggtaagagagatgattacgaatcaagtaatctggaaggcagatttacaatatatattaaaatgagcttaaaacccaatgtattaccaaataaagatgaaactgtaaacaccagtaattctactggagaaacatgtgcatacaatggaatactatgaagcagggaacaggataaattttagtataaacattaacatgcacgaatcttaataacaattttgggtgaagtaaatcacagaagaatacttatagcactgtgccatttatgtaagttcacaaacatacaagataaacttcgttgcttacagatgcatgaatatgtattaaaactaaaaaatcaagaaaacaatgaccacaaatgtcagaactgtagctacaccagaaggcgggaggaaaatagttaagagagatatccaggagatttctaaggtacagaagtgctctatttccttagctgagtggtacatagattaatatttactaattattatttaaattatacgtacacatatttattttgatatgtgtcaaaataaaactgaaaaacaaaaaatacagacataaagaaaaatttaaaccatgaggtaatttgaatcaataatcaacaatattttggatcaaagaaccgtaaatttaaataatgagatgaaaattgattaataatcaaattaacaaagattctagatctcataattctcattgttagcatgagtgcgatgaaaaatcctattctcttggtgggggtataactcggttaaacattttgggaaagcaatttggcagtgcctatcagaagaatttttaaatgtccatgccttagggaaatggcttgaaattcgaataaagtttttatggctaaaatcatggtcattttagtgtttctataatagtgagaaatttagaaacattatggaagtaagtaaatcatgatagatataatgaaacattacccagcatttaatgatgattacaaagagattgtcattatcacagggaaatgcttatgtcacattatttagtgagaagagcaaactgcaaaactttatacccaatatgatctcatctattaaagaaaaacaagcatactggaagggtattttctttccacacagtcatgttacattgcatttcagcttttagcttggcattattccaagaacattctctcatggcgaggagatgggaggttaggtcatttccaacgaccattcttcatttctctcctgacttacatagtgatagagaaagaggaactaacagttatttcgtgttgtcttgggcaccatgttactcctacatattatccgtgtgagatagaaaatatcactcccatatgaacgttggagaaacggagtgggcttaaggcacctgcttaagagcacacagctagtaaatggcaaggtggtacgtctgattcctaaactgtttctgtaaactcccttccttcccatacggtagaacccctgaggcaagcctctgggatatcacagccttaataacttggctcagaaatcagtctgcctgggctgagatactgcctctacttactagctatgagacttcaggtaaattttatttaatttctctgggcctcagtttctgcatcagtagaatgagaataataatgccttccttataagataagatgcatgtaaaatgcttaggaaagttccaggcactcagtagaagttagccaacattgctgtctctaatagggtctgagtaaataatgacttgtttgaggttatttacactctcacttgcccagagtctcctggggaataccatcagcgatgttctggtccaagacataatttcacagatggggacaccgaagaccagaaaggtgaagtgagtaagccagtccacccagtggtaagtgatcgggggtggtcctgactattactgcatattctttccatcaatgtacagcatttccctgactgtcaccccctgtgaccagatgccaggaggaccagaccacaaccttgaaaaacacagccatctcttcatgcacacactattatttatgtatatattatcatttgctttctcaacaaccctgggaggtgagcaaggtgtttctccttggtcccataaggaactgaggcaggaacctcagagttctttgcacaacatcatggaacctccaagagttttgtgtcttggctgcattagatgaccaaattcagatctgtttcttataggcaggaaagaagttgggctggtgaattttcctgatttctctctctctctctctccctctcttttttttttttttttaacagggtctcactctgtcatccagactggagagcagtggtgtaatcttggctcactgcaacctccgcctcctgggttcaagcgattctcctgcctcggccttccgagtagctgggattacaggtgcctgccaccacacccagctaatttttgtatttttagtagagacgaggtttcaccatgttggccaggctggtctcaaattcctgatctcaagtgatctgcccacctcggcctcccaaagtgctgggattacaggcatgagccactgcgcccagcctgatttctctcttaaaccccatggtactagctgttattcaccaacatctgttattcatcaacatggacagggaagcagcttcctccagctcttcacttgtggggctagcccattaagctctccccagagctcaggtggccaaatatggggactgtgacagaggttaggccagtgggacagaagtgatgccatccttcttcttcccaacatcacccctgctgtctacagccttgaggttacaattcctgccttacttatgcatgatgttagcctgtgatgctttctgatgcctgacagcaaccaaaactcccatgagcttgtggtgggggtataaattgggaaaaaatccttgcaatgtctcctaaggctaagcgtacacctccctatgatctagcagttccactcctaggcatatactcaagtgaaagaagtgtttatgttcatccaaagatattgatgaatgtgtttatgactgctttattaacacaggcaaaattgcaagaaacctaaatgttcaacaataggaaaatggataaataaattaaggcaatatttattcaatagaattttgtgcagcagtaaaaaaaagtgaagtacagcttcatgcaacagtgtggatgaatcttgcaaatataatgatgagaaaaataaggcagaaacaaaagaacacatactgtagaattccatttatataaagttcaagaacaggtaaaaccattctattgtgctagaagttgaatagtgtttactgttgtgggcaaggctctactgattattaagggaggaaaacttctggggtgatagaagtgttctgtttcttgaccttgaatggaggttctatggatgtaacatgtgaaaattcattatgctttacattttaaaaatgtgcactttgctctatgtatatacaatctttaaaaaaacaaatcctgccagctggatcactaaggattcattcaccaagaactcagaataatccctaagcaaaaacccctaagataagcttatcttttaagtcaatcagtggattctgtatataccaagtgaatttttctttctctaagacccaacctagcctgggatacatctctcttctcagaggtgttgctgtcattgtactccctgagctgctgctgtgtgtgtctgtctgcccctcagaccacatgccccaagagcagagactatgcaccattcattgcctttccccagtatgtagcacagcgcctggcttagacatgcagtaactattgatggggtgtatgaaggagtgaatgcacaaaagaatgaatgaacatggcacacacaaatatgatctatgaccacaatctagaaagctcctgcggggctgtgagctgtggaatcattctttaggcagcatgatatgagccagtggttctcaccctggggaaattttgtaccacaggggtcatttggcaatgtccagagttaattttggtgaccacaactggggatgggaggtgatggtattctacctggaataatgctaaatagcctacaatgcacaggaaagcacacctcttacacacacacacacacacacacacacacacacacgagtcatccagctcaaaatgtcagtagtgcaaagattgagaaaaccctgatatagaggaacaggagctaaacgcaggaagaaagccttgagttcaaatgttaattgcctacttattagctgtgtgaccctgggtaagttgcaaaacctctcagatctttctcctttgcactaatagggctgatccctaccttaaaagtagatgagaggattaaatgagctaaactatgtgaagtgcctggctcaaaacaggagcccagtgagacttagagaccttctcccaggagcccaagagactttctcttctccactctgtttctgatcccccttccccagagccataaatgggcaatttttagtaagaaaaacagctgtcaagcattgctgcttcttcctctgcttaagaaactattgaagagcaaggctgcctgtgaagaatgcattttatttgccaggtacatcaatagcccctgttcctaatgaaatgcgttattaatagataaagtcaacatattcagaactcaggcccacgttgcatcccaatgtaatctgccattctccctgccttgcaggtgtcctctaagcctgcctctgaaaaaccgattctgattttccccactttccctcgcttttctctaagccccaacaaacacaatgagttcccaagagatacagagaaacgtcacacacaatactagcactgtgtgcaggtggcagagacatcgtgaagaaagaacccagccttgttctttgcaaatgggaagtagaatttcccgcagggctcaatctaaggcttgctacatttgttccttcctcccctttatgtatttatgagagcggccggcccctaggcaatcctaaggtggatgcttatgggtgctgattacgatgacgttttgctgtccttggtgctgaaaaagtcttcaagtgctaaggattatgcttttccattactcatattggccagggactataaaatgggcattaatatacatgttaacattatttagcaaatgcttagtatagaacatttgggaaacacacagaatgaaaacaacaaaaataattagtatttactgagagcatgctacttttcaggcatcattattgacttcatcttgtgagctatgtattacatattccctatttttcagatgaggaaaactgaggcaagaacagtcccattcacatgaactttcagtgacagccacatcaacaacataagaacacctgggctcctacaaagaccaattgcactaccggctctggctccagtctttcttcatcttctccacaacttggtttgtcttggcccccacaggtacctttccctctcctgaaccatcatctccagtctttctactatgccattttctcactggcacacaaatatgcctcaggatttctcatcttacagagaagacacaagactcttggccatcacatccaaacctcgaataactttctcattcatttcctccttttcaaggagaagttccttgaatgagtggtttttagtccttttttctaggtttacaccttccattttatattatttcctcaaatcaccaccaccccccgaaatggaccaagtcaaaatcaacagtgatcatcccattaacaaatcctatggttgcttctttgagcacttgttttagttcccagcaaatctgacatcaataactactcccttcttcttaaactacttactttttttctctttaccattgtgtcaccacaaaatcctagttttcctcctaacttcatggcccagattctcagtccttttcctggacctttctcttccactccccttaaaatactttgtcccagggctcagttttgggaagccttcacttttccaactctactcctcttccagtgagcaatctcatccattcccatggctttaaaaaccatccatatgttgatgcttgctaagtttttatctccaggttgaggcaattgtatatatctccaggcaatcattcaattgtctctccagtcactacttggatgtcttataatctcaaacatcacaaaattaaaaagtacttttgacgttccccccaaaatcacctcctaccctagtcttccccaactcagaaaatgccacaacttagtttctcaaaccaaaatcctaggaatcatcttttatttcccctcatggttcacaaccaatcctccaatcaagttccacagacttaacctacaaaatataccccaatgtcatccacttctttccatctcccatgccactaccctagcatctccaccctctcttcccaggatttttaggaagcctcgtttttccaatttgagctttgattgagtaggtagtacacatattcaaaaatttaaccatattggccgggaacggtggctcacgcctgtaatcccagcactttgggagtccgtggcaggtggatcacttgaggtcaggagatcgagaccatcctggctaacatggtgaaaccccatctctactaaaaatacaaaaaaaaatagctggatggggtggcatgcacctgtagtcccaactacttgggaggctgaggcaggagaatctcttgaacctgggaggcggaggttgcagtgagctgaggtcgcgccactgcactccagcctgggtgacagagcaagaccctgcctcaaaaaaaaaaaaaaatctaaccacatcaaaatatatacacctccatcccccattgctctggtcccacctttacacttcacaggtaaccaaattttcacttcatttttaaagactccttcaagagtctttatggaaatacaaaatgtccattcctcctgtgtttttacagaattgttaaaacatcacgcattctattctgtttcttgctcctttcactttgccctacatcttggagatcttcccacatagatgttgaagagaacattctctttagttgcttagcattccatcatgtggctgtgacaacatttatttcactggtaatctatcctttgacaattgggttgtttccaatatttttctatttcaaatgatactgcaatgctcttgtatatactattctcatacatgccattatatctgcattataaattaccagaagattatggaatcaaaggaaacatgcaaaaaccacttaactgatttctctgtttccactcttgacttctacattacatttccaagggcatctacagtggtgtttttcaaaatataaatcacattagtctgctccccagctcaaagccctccagtggctttctgctgcatgtatatggatttaaatgcctgattttagtctccaatatctactttttttgcactttacctacttggccactcatcaggctccagcaatttgttatatttctagagcacacctaactctccttgccttgacacttgctcatccctctacctggcacactcttcaaccagatctttacattttccctttctatcaaccagatctttacatttcccccccgccccccatcttcggatcagcttaaatatcacctcctcaggaaggcttccatgatacatcatctgaagccctccaccctcaccctcactgctgattctattccagtatatcattgtgttttattttctttattgctcttcctctttctatcccaagcccttaaaacagtgtctgataacaaatgtttgttgaattagtgacttaacatctcagtaaatttacttccagcatctttccaaaaagatattttttacataggtgagatgaaataatgcaaataattttctttccttttatcatctagtgttatatttaagcatttctccaggaaattaaaacttctttgcaaacattctgttttatgaattcaggacaacttatcatagggagagattacaactttttatttttttatttttttttatttttcatttttaattttttgagacagagtctcgctctatcgcccaggctggagtgcagtggtgcagtctcagctcactgcaagctccgcctcccgggttcaagcgattctcttgcctcagcctcctgagtagctaggactacaggcacacgccaccacgcccagctaatttttgtatttttagtagagatgcagtttcaccatgttggtcaggatggtctggatctcctgacctcaagatgttcccactttggcctcccaaagtgctgggattagaggcatgagccactgcacccagctgattataactattttaatcattcactttgttaggtagataggtttctacaatttttgttatttgaattaacacaacaataagcatatttaagcaaaaatatttgtctataactttgaactggatttactaggttcaaagggtaaaatctgtttcagcaaccagatactttttatcaaatagcttctcagaagattgcaataacttacaaccttctagcagtaaatcacccaatcttcagcagctttcatattttcttcagtatttactaatttcataggtaaagtggttcatttcttaaattgtcccttcttataactaatgaagctgaatatttatttagttcgtctttgactgatttataacaacattatatcaacacccatttccacaggcttacaaagagtttggctgtattaaaacccaagacatcaagtaatatggctgtgaattttctgccatgggaaaaaaagtagtaaaccacctatgggattacagcataagtacaacttgcttttctcttactttgggaaagatgaacctcctttatagtacaattttcaggaaatgcattgcacttcccttgttttccacataggatgtaatttccagcaccactgcaacatcttccaagggaggcatttttaaatcactgacagatattgtgaaggttccatcatggaggttccatatagcgacttttgttttgcattttcctggccatacttctgtttagaacctaccattaactttgataatttaattttacccctttcctaagaataaaatccatgcacatgtcagtatcagcaaaataacatcacttctctcttctatagcttcagctaacctttaagtgaatcttaaaattttctataaccatcttccaaaactaggcattttatccaataatataaaattagcatgttatagagggtgctgcacaaatagcctacactgattcacagatgactttaaaaattcagtgagccaagaatcccacattattgattcatgctaacaaaacgatgaagtacagctaatctttaaaacacatgctgggcagaatgacatttataaatgcagacagaccgaaaccaattggacataattctttacggattaaactgatggctgcaattagacctaagaaggtgagcagtctctctgctgggaactgagactcagcctcctgggtccaactccaattttctctcatccttggctaaacatggtattccactgttccactgaccggctagttgagtagagttccccatgactactcaggttaactaaattggtttgtaaaatatgacatgttaccactttggcttgcctctttgacttttaataacaactgccccgaagggggctatgattaggatcatcatagcatgatgctatcagtgtagaataccagatgagcccagcaaagagcctgtagggacagaatatggatatatccctttgtatctgccctgtccctctccctctccctctctctctccctccccctccctcccgccctcccttcttccttccttccttccttgtctccctccctgtctctctctctctctctcttttgacatagtcttgctctgttgcccaggctggagtgcagtggtgcaatctcagctcactacaacctccacctcccaggttcaagcaattctcctgcctcagcctcctgagtagtgggattacaagcgcctgccaccacaacttgctttttgtatttttagtagagatggggtttcaccatgttggccaggctggtctcaaactccggacctcatgtgatcctcccgtctcggtctcccaaagttctgggattacaggtgtgagccaccacacccagcctaactatgtttttctgtttaaagaaatatctgggcttgactcatagctcccagtcctagggaacaattctgtctgccatttcagagtagtttcaagattaggctgataaacatcacccaaagaacagaaattcttatagtcacccaaacaacagataactcttatagtcttaaaattcataatgattctgcttattagaaaagcttattagaacagtgatagggtgagaaatattttgcagccatgcagtgtgacagaaagcacctacgctgggaaatcaaattctgtccctgtcacttagttacacagtgagggctccatacatgttattatgtcctagtttccccactctacctacaaccagcagggttattttgagactctcttgagatggctcagggaagctcttaaaagagcctaaagcacatagtcttaaaagaactgccatccacatttgatggtctcttggctcgctctctcttcttcatcttctcaccgcattcttttccttctttactctttactatgcgcttaacattttgggaaccagcaagaatacacccaaagagaaactccaggagcggggcaatttcagggacatggaattagcatttctataatcgttaggactctcttgttaaaaatgagtaacaaacaaacaaaaaccttgaattactctgagaaatggaggtaaagttctggtcacatagaacacaagttttgtcccaagggcataaaatctccttgacaggctcaaactcagtttgaaaattcataattattcagtttaacagagggagaagggagactgatggatggaggatgatggcatgtttacttgttgcagcagtggggtagaacacaaattccaacttttcaaataagaccttcatggagtaagtctcttctactaacgggctgtggaatttggggcaactaactgtattagtcctttttcatgctgctgataaagacatatccaaggctgggtaatttatattttaaaaaaaagaggtttaatggaatcacagttccacgtgcctggggaggcctcagaatcatggtggaaggcaaaaggcacatcttacacggcagcaggcaagagagaatgagaaccaagtgaaaggggtttccccttataaaatcatcagattgtgaggctcattcactgccatgagaacaatacgaggaaaaccacctcccatgattcaattatctcccactgggtcccttccacaacatgtcggaattatgggagccacaattcaagatgacatttgggtggggacacagccaaatcacatcactaacctaacctcattgagcctcagttatctcatctgtaaaatggagataaagatgaccatagtaaatagaactaaattcatgactcaaatgatgtcatgaagattcactttcttttttaaaatatcaataattattttatgtggtatacatttaaggggtacaagtgcaattttgttacacacacatattgtctagtagtgaactcttggtttttagcatgtccatcacccaaatactgtacattgtacccatgaggtaattgatcgtcaccctccccacttccactctctcacctttccaagtctccaatgtctattgttccatactctacgtccatgtgtacacattatttagctctcacttacttctgcatcttttaaccctatcttttgccatgcaagctttgttcttaggatcctaggtgctcccagcttctccagccttcccctaggttaaagtccagctaaaatgcaggcgcttcacccaaagtcctgaggctatttgattggcctggggaatgcgggtgctgattgaagcctgagagtccttttccatccagaatcctggagtcaacccttcccaaactgtgtgggatagaaaatggaaatgggctaggcgcgatggctcacgcctgtaatcccagcactttgggaggccgaggtggcgaatcacctgaggtcaggagttcaaaacctgcctggccaacatggcgaaaccccacctctactaaaaatgcaaaaaaaaaaaaaaaaaaaaaattagccaggcttggtgatgggcacctgtaatcccagctactcgggaggctaaggcaggagaactgcttgaacccgggaggtggaagttgcagtgagccgagattatgccattgcactccagcctgggcaacagagcgagattccatctcaaaaaacaaagaaaatggaaatgataaatgtctagagtgatggatatcccaataaccctgatgtcatcattacacactatctgactgtattacaatatcacaaatacctcataaacatgtaaagctatgtacaactattacatattcaaaataattaaaaatgaaaaagaaagtggaagtggtggattcccaaacaaactaggaagctgtaaccagaagatgaaaaaaatgaatgcaccagaggcaaagcacagttgtttgccatgtttgcccagctgaaaatcaacggcaatgttttttgtcagtcattcttaaccctggttgcagattaaaatcacctgggagctaaaaaaaaaaaaaaaaggatggctgctatctgggcttcaacttcagaaaggttaaatcaaactccctgaatgtgggaactggacagtggtggtttaaaagcacccagatgatcctaacattcagccacggttgagaacggtgtctatgtagacttgtgtacacatccagaagggatgtttaggtgggggattttcttctgaaacttctatacaaaattagaattcccatctaagaagttggaaagactgcaaatttagaagacactaggatcttgtcagtgttgctacttctcaagtaattacagaccctcagagtctgaaagattcgggctaacaatgagttacagcctccattcaaaatatgaatcaactccagggcagtctgatgtccagttttttcttgtacgtctctaataattgtgaactcatgactttatggggtaacatagtctattttgttttttgtttttgtcatagctgtgacttcctaagacctacatacgagaattctgacccaaagctctaaaaaatcacctctctctataatcaatatgacttaaaatgtactctttgttatctggcacacatccacagctagttagcaatagagctggaagttgatccaggtttactttgaactacatatacatatatatatatatatatatattttagatggagttttgctcttgttttgttgcccaggctggagtgtaatggcgtgatcttggctctccacaatctctgcgttctgggttcaagcgattctcctgcctcagcctcccaagtagctgggattacaggcatatgccaccacgcccagctaattttgtatttttagcacagatggggcttctccatgttggtcaggctggtcttgaactcccgacctcaggtgatccacccgcctcagcctcccaaagtgctgggattacaggcatgagccattgtgcctggcctaaactacttcaatattacaccatctatagtaaaaaaaaaaaaaaaaaaaatggggaggaaggggtgttaataaaactgaaaaagctggaaaacaaaatgatgtaagtaaacccaaacaaatgtgttatggcaataaatgtaaatcttttaagctcccacttgaaagtcagagactctgagattggatcaaaagttaaattcccaccttatactgtttgcattagctaagcctaaaacaaaatcacatatttgggttaaatgcaaaagaagaggcaaacaggtgccagtccagtacaaacaaaagtcaagccagaggcagcaattgaatgtcaggcactgtagaattcaagcaaaataccttaaaatagaacaacaggattgttttatactgataaatatccaattcacaaggcaaatcaacagtcataaatgtttacttgctgaaatcattaaacacctagagctaaaattactagcaatacaagagacaaatgacataaacacaatcaatggtgtgagattttaacactcaagagtttttgacagattaagtagacaaaaataaataaggatgcagtggatctgcataatataattaatgctgactgaatagatttttaaacattatatcaagaaaataattgaacttcttgtaagagataaactaatacaatttccaaaatatatatcattttaggtcacacacacccaaaacaacaaagtttggtaagtggtagttcaggtcacgttctctgggcatatatagaaaatactaatgtataaggatatataggaaatgtatataaaatggtattctgtgggcatccatattagaaaacacttcaaaatctaaaaagtaaataaatcaaaaacccatccaaaatttcaaaaagctaaaaataatttccagatctttcaaattgaaaatctgtctcctaaataacatggtagtcaaagagaaaattaaaatattggttatagattacttagaaattaatgatctgagaaaaacaatatacaaaaatgtgataatccacaatttcagcctttattaaacaagaaaaaatgaaattcactgaggaaagcacagcaatgaattttcttcaaagggagcaagtaaaaactaagaaaagcataaggaataaataaagggcggattttaaaatcccaataattagaaaagcaaataatctgtatagttaatatataaatctaaatggtgttttgtttgtaaacagaaatattaacaatttagaagttagaataatagctaatgtttattgagcacttagtatgtgcctcacagtgattaagtatgttattaacaataccacaggctgggcgtagtggctctcacctgtaatcccagcactttgggaggctgaggcgggaggatcacttgaggtcaggaatttgagactagcctggttaacacagggagatcccgtgtctacaaaaaatttaaaacattagccagatgtggtggtgtacatctgtaatcccagctactcaggagggtgaggcaggagaatcccttgagctaggaggtagaggatacagtgagccatgatcaggcccctgcactccagcctgggtgactgagcaagaccctgtttccaaataaactaacaaacaaacaaacaaggagggccctattattgtcttgattttacaagtaaagaaattgaggaagacagagaggaccacaatgggcccaagagcacccaagcggtgagtaacagaatgacctaagctcctaaccaacactttatataacctctcaatatgaagaatgagggtaaaagccagaaattagtaattacaaggtaattgaatatatatactaaacatataatttcatgctaaataactctgaaaatcttaaggatatttatggctttcttaaaaaataaattataaatattgactcagttggaatttgagtatatcaaaagtttaggagaaattgaataagtcatataaaaatcatctctgaaggaagtactaggcctaaattattctaaatgttcaatatttcaaaatttggaaaaataaataattcccatgctaggtaacaatttaggaagaaaaaaaatgtgtcctgatttctctaatgaggttggcatgagtctgttgctgcgacctaacaaaatccaaagaaggaagaagctctgatccaatcttacatattgatatagctataaacacactagataaaatacaagcaaacctaattcggctatgcttttgaaggataattcaccacaaccaagtagattttattccaagaaaccaaggatgatttaatactagaaataatttagtattcagaaatctattcacatcatttatcacaccaatgggtcaaaggagaaacatcatagtcaaatagtacaaggtctttgacaaaatgcaataccatctcttatttagtctttaaaatgcagaaatcttggaatagaggagtatttcgctaacattgtaaagaatagttctcatgtatcaacagctgacactttactgaactgtaaaataccagaaatgctcctgttaaagtcatggacaaaacagaggtcttgcttttcaacagttttagatactgaagaagacaaggaggaaaactaaactttagtttaccaccagcttggaagcacaggcattgccatttgacctgggcttggattttggctgcctccctctccagtagttgagccctattttggtaaatcagtaagtcagtttcttctgcatgaggaatggtaaaaggacagtgaggattaaataagcagacacaggctgggcacggtggctcacgcctgtaatcccagcactttgggaggccgaggtgggcggatcacgaggtcaggagatcaagaccatcctggcttacatggtgaaaccccatctctattaaaaatacaaaaaattagccgggcgtggtggtgggtgcctgtagtcccagctactcaggaggctgaggcaggagaatggcgtgaacccgggaggcggaggttgcagtgaacagagttcgcgtcactgcactccagcctgggcgacagagcgagactccatcccaaaaataaaaaataaaaaataaaaataaaaataaaaataaaaataagcagacacagagagaccccttggcacaatgcctgatgcagggcagcgtctgaattcacaactgcttccaggctcagaaatatcagttgtttctttactagaaaacatggtaaggtcaactgataaatgattagaagtacccaagagtttaataaaatatccagaggccatctaaatacatacaaatagcagtgaaaattggttagaagttagaagtgtctcaacaggcctcttgctgacaattggattttgtagactgttgtctttactgcaaggccctccccatcccattgttgcctcatccccaaccagccattatcttataattattgtttaggtttcaaatcattcatcactccttgtggaagctttttctgacccccaagccaaaccccctaccaagtgtacttttaactggatcatcttctttgacacacttgccatagcagaagttttatatttttgtagaattattggattaatatttgttttctactcaaggcttaagttctgagtacactatgcagctattaaaattatgtttatgtaaaagaatttaatgtctacatatgaatttatttttcaatgcatcatataaatcagtatataagcactcaatcttcatttctaaaaattacacattagtatatgcataaaagataaaaagatactcatcaatatattaacagtaatactagatttttattatttaaattttctttctcatattcattaatgcttttaaatatttaacataaacaaacagtatttcttctttaaatgatagggatttgccaaatatctaaatttttaaaacacttaaaatagatacttttcaatttttttttaacatcaggtgacaggtgtttaggtggctggtcattgatgctgaccacatataaatatatatatatatattacctagaattgtcttctttcaaaaatttatctttctgactggtaaaatgttattcctaccgaagagagcaaagaattgagcacattaaaaaagaatcagcaatgatggtaaaatctggagaaatattttactctcattaatataagaacaagcccatatctcagcccccacacaattaaacatctagcaccccttcacttacacacacacacacacacacacacacgacaatagcaattggtcaccaaatgcacactgagcatctactacgtagctcagcccagagctagctgttcagagggcttagtccctgcccttgatgaggtcattggccaccgagaccaacacattgagaaaagaaaaccaacagcacaaaatggaatctgaacactgacaaacaagtgttagacagtagttttgcacattttcagagttacaccttcccacccatcacgggctgccagcagaactcccggtggtggtgtgaatcaactctatttccatcgtagcagtataaatagaggaatgacttgaggaactccccgtgctaaccaaatacattcaaacacctttattggggtctgttcttttgccaccccctagctggggtgttgtcttctagtctgcaaccacagagcagtgcacctgccaaaacttcttcaaatggtcttcttccatttggggcatctgattctgctctctcctctcccacaggaagcctgggtcaaatgcccatcctcctttttctcacagtctcctaaggtccttttgttactgttcttgacaccctatattctactttcttcttgccctctctgattcaccgaccagaccaaagctcttcgtagtcattttttatgtatctcagtaggtccaattcctagctctgtgttctagacatactttgtgcttggcaaatatataccactttcaatcaatgaagaatgaataaatgaaattcatctctggacacctttacaaccttgcattccttgcctttgcttaagctgttccatgcatctgagatgcccttttctcaactcatttccatatgttcaaatcctaacctccatccttaaagttctagaatgaatgccttctactccaggaaaactcccctggcctctcggccatcagtgacttccccctcttccaactactacagttctttatcaatttcccacattctacccagacttagtgttattcatggacatatttttacatgcccctccccattaattgatatactctgtgatgtcagagactatgtgtctcctctatcctggtcctcctcccagtgaccacattatagacaataaattaataatagacttattatggacacatgcaggattagtgccttggagatgtcagccctttgttcatttcttccatggctggatttggcaaatttgaacagaaggagatatggtaaagacaagctcttggatcttattaggaactcaaatatttccattcctgccattttttatgggatgtgttttaacttggcctaccaggaaatgtgtgtgatttactataagtatccgaatgaacttaaagtgtcaggagaaacatgagaccatcatctgagtggggggggagggtagaaattgatgaatgaaattcttcctggaaatacattcttccaggagggggatgcaatgacatctccaccttgtctcatcaaagcatacttctgaagagagaagacttggtggacacaggtcaggagagctggctgaccttgctctcctctaatttttgagctttcccaaacacactatttttcttctcctgcctgggcttgatcttggcggctcatgcagcaataaggggagttattttggggagacagttgatgcttggcgagtcctcctacagatcagcaatagctgtttgaaatgttaaatgcctcccagatggagatacttagcatttgtaggaggaataatttggaggagaaaaatgcatttgtctttttggcatcctgtggattgcgttacagaagacagagaacactgtgaatcctgccatccacatgtcagtgttttcctggaattttgctagtcccaggtgactgtgctgctgctgctgctgcttctggggacatcaaggtttggatatgccaatgctcaagggaaaagtatatgggactgagtctcagaggtcagagagcttccagagtgcccaggaaccatcagggcttagcctcccggctaccattggcaaatgcttcaatcatgtagaccagatggtttttacttttgggtgtggtcttttatacacagggaggctgaaaaatgtagtgcagactagcagagagaaccagggattgagaggcatgagttctggccttgcttttgccactaactttctttgtggcttcaggcaaaccaccttgtctcacaaagcctgtttccccacctttgaggtgaaaagattggattagatcatctttaaattcttccctaactaaagaacaatgctatggtacttgttgtcatggcttatgaagaaggtgacattatggcagaagggtaactttgagttttccttcaatatgagcttccaggtgctaaggaagagaagacttcattcaattgttcatcatgccccattattcatggcaaggatagagtgggtcattcacaaaaaatactgaatcaatgacccttttatttatttcttggcacccatgagagctctgtggcccatcagtaagcttcatcaaaaagttatgcctttgagtaagcagccacttttagcaccagagtgaatttgagctggatagaaagctcagttctgaaaaattgtaactggataattgtagtgtaagtgttctcacaccacactgagatgtgcaaagaaaagtgtgcctcctttatcttctatgctagcctcacacacattttagaaatcccctcatcccctcaggtaggtgggtgggtggatcaggggtgctacatttagttaaatccagtcagctttgtcctatgcaatgatgaaaataatctctataggaaattcatgctcttttggataatgctgtctttccaatttctctcttctcctcctgatcattcctgagatagattctgggtactggggagagcggaagaaggcagccttgggttcttacatgttttaggctcccctgtgccctgcagcaatgcactgtgcccctctggtcattggtcattttatcaggatctgatggaaaagctggggctgctaacttatgggctattttcctactttgtctggacacagattctgacttgacctcacaatggctgtttggagggctggacatacctgattccagtgtgccctgctctgggaaccatataacatagccctcagttgcagagtaatgtatcccaccctggtaaaccccctagatggaatctcagctacctttctcctcttccatcatgaggcatgggtaaatagtttgattcattctaccatacaagattttagtgtcacttgggaataataatgcaacccctttccctctctacccttctctttctctgcatctccgtatctctaactttgtgtttctcttccctccattgttatgctactatcactttgctatggaagtctcaatgttggttgaagcagcttgggaggtgtctatttcccgaatctcaacctacatccaaggcttgagcctcagaagagataggaaggacccatgcacacctcccagcatgagagcatcctcttttccttatctcaatccattctgagccagaaaaacacgtgatttccactttttcctatcctgtgatggttttgcctatattttatcctcctgttttctgaggtaaatttcttttcctcttgcttttcctggggaaaatggtacaatggttgcctggaaatgcaatgtttgtggtataagataaaaacaaataaataatattttaaaatattatttccattacaaaatcatttcttaaattgctgaaagagatttgcttgactgaggttgatacactttcttctctgtgagccttccacctataaaacaacatggttagacctcacattcattaaaatcctttccagttcttgtgtcttagtctcacttaacaatgagatgctataagaggctcacaatgctctccagataattttccaaatgagtcattctattcccaaaccagttagagtatatttgtttggcatcttaccaataaaaaaaaaaaattgagcttatcaatcttttgcccagctaaaccctactatgagtcctgagacttaatcatttactactaagtagctacggatacagtttatccaacaagactagaaaccacagaataacccatgaagaatccagttaacacaggaagtgactttcaagtcagaaaaaggaggagaagcaaaccaaaatggcagctgacaagaggaattaagttctcctctaactggctaaagcttgagactggtggcttctcataaggtgaaatgggaaagcccagattccagacatatcaacacagaggtcctggtatatcctattgtaacaaggaattaactaaaatggagcagggaaacttcctggcggattccaagattctgaaagtgaaaaggctgaaacatgatatctacacacaaagtgctctaaggaaaagaatccaggggcagtggttgaaggcttgatgattgatctccaagttgaagttgtctcagttgctctaacatatgcacataatctcccccactttatacacaatccatacattgtctaggattttgtttgtttgtttgttttttgagatggagtctcactctgttgcccaggctggagtgcagtggcaccatcttaactcactgcaacttccgcctcccatgttcaaacgattctcccccctcagcctcccaagtagctgggattacaggcactggccaccacgtccggctaatttttgtatttttagtggagacggggtttcaccatattggcaaggctggtaggatttttttaaacaaaaaaaaattgtagtaattatgaatggcacattttagctattctaagtagggatgagaaagtgaactctgccattcagaaaaatagaataaaaacatctttctgggaggatgtattgttgaattgttatgttccattctttttgcctatcaggaaatatttattatggctgctgtatgtagtgtgccaggcacaatgggatactgtattatgcagcacaggttcagtccctaaccttgctgctaaaaatcaagtagaagaggtgagaaaataaaccaaacattccactaactgtactaagtgctaacataggcgatgtagataggtgtctggattcggatttctatggaagctctaacttatccagtggtgaggaaggtgagaagtcaagaaagtttccaagaggaaataaatttcaatggacagaactagtaatcccaattggcctccataaagacactttccagcaaaaggagataatagcctcccacatttggattcccagatttcagccccaatggcacttgagttgtcagactcaaagaagtaagacatagtgtgttttcctcaacctctctccacctcctacttgagcccattcctaatctatcggtctctacttataaatatctactaaacttccagcagctctgcatggctgcctttaatgttgacacagagaacaagagggtgatgtttcttggagcttcccaaactacaaaaaacctgctaacacttgaaaaccacaaccctgacaaacacatcatagtctgggagttccagcactgagccaattttatgcatgcatttatttgtttgtctaaagggaaggactttcttcaaccactaaaagagttcctcaaaattccctagttcccaatgcaggcagacatgaataatgtatttaaggctgctttttttttcattccttgtcttccagcagccctcaggggctgccatattgagtttcagcactcacaatcctggtcgcaaggaagaacatgcctagaatcatgcattgagtggccaaacgcaccccagggcctccagttttatccccttaacaagggacttgaagagtctgctgaacaaccagctgacgctaactgacctcacaggaggctcataacaggaatgttatctgtcaggaactggttttcttaaaactgattttacctagcaagcaaagaatcactcatttttaaaaaaagggaacatcctgaggttgtaagaaagacagttatggcttcagattcagctcttggatttgcttgctatgtgatattgggtaagtcacttaacctttccgagcctcagtttactcatctgttcaatgggaaacattgctttcttgtaagcgtattattttaaaaataagtcttatatttgccaaaacaatgtgtacacattgctttattaaaaaatcaaagagtgttgaaagtcttaataaaagtcttttaataaaaaaaaaaaattcaactctcatcacccctgaatcttactccctggggtagctgctcccaactcctctggctgattattttaatattctacagatttaaatactgcagatttctccattcttagatccctccaccacctttttttttttttttttttttttttttttttttttttttaggttgcttgtttgggtctctctcttctgcattggaaatcctccccatggtctggtcagcttgaagatcaggactctaagaagccatttgtgagttccatgcacatggggtctggactgttgactgatgaaattccttgtaggatgatgaggcagtgagtcagcctattcattgggagctaccatatttcaggatcttgacgtcttttctcagggatatgtcagtttctccagataaaaatcctctaaacatttggatgagaagagagaagggctgaaaggctcaagtcttgactcatttctcttcccactgtctactgtctctgttgaccccttaagtcctgagtctttttggtttattacccacagaaatcccatttctgtgtggtgggggtgagaggagagaagggaggtagttgtctgactgtgtcaggggagggataggcccctgggagccacgagctctgcacacgttgctagatcccacctgctctcatcttgcgtatacctgggtgccttaacatgcctggaatctaactctttattctgtgacgtcacttgtcactacttctctcctttccactttcctctctccccttcttgctttattcctttctttcttcccttctccctcacttccttcccttgctcctttcttcctttcttcctgctaccttttcaatggagggaaatgagataaactcaacatgactctcagcttttcaccccttactttataaacagaagttctgttggaaggcctaattgagaggaaggatgaggaatctcttgctgaacatctggcataatatttatatgctcagttacacttatttctgcatcatgcctctcagcatcaccttggacattccctgacatgcccaaaggaaagaacgtgtggcctgagacataagatttttaggaaattcctagagctcagggtgcatcctccaagagagggtgggagggagggagggctctgaaatgccctctttctccaggtcagtcaattaattcaattaatcctcaagacaacttcattaggcagttgctatgatgatcatttccattttatgcccttggtcttcatatctatgcactgtattaccatggcctaggacagtcactcatttggggaagaaaaaggtgagaaatagcccttgaccttctgcctgtcaacagagtttaaaaaatacaaccatctttccctgtggaagccttcccaccagaacctacacatacatagaattatcctagcgtgatctcagacacagacacacacacacgcctgcgtgctccagaaagtggtaactaataagtgaaaccaaggttccgaggtctcctggtgcctgagctcccctgcagggctcccaatcaatacaaggtttgctgtctgcaacttggctgatttactaagattacaaatgaaaaccagcccccagagggtgcagcgttgctgtagcacagaaggaaagcgtaattcttgcttacactcggctttgtgatcggtttctcccctggtagctagtcttgtaacttctttttagagatgtcaatcttataaaaaacacacacacacagccccagacttctgcagatcaagactttctcatctcactggggtgttctctccccgctaaccacaggatactctgtttctctgtggctgtttcaaatggaacagctcttttggtagtttaaaaaatgtatattgaatagtgataataataactatcattattattgtgcttattgttatcatttctagttcctgtgtctaattctgtgtcagatgttgtgcaagacaccatgtagccaatatctctacaccttccccaacccacacagtttatgtataagtatcatttcctgacaaataaggaaactggggctcagagatggtaaacaacatcctcaaggtcacacagccagttaagagggattcaaacccagttaccctattgactgtggtagctctagaaccttcattcctaacactaagaaaggatttcaaatacagggtgactgccttaaaaaccaggctgtcggccggttgcggtggctcatacctgcaatctcatcactttgggaggccgaggcaggcagatcacgaggtcaggagttggagaccatcctgaccaacatggtgaaaccctgtctctactaaaaatacaaaaattagctgggcgtggtggcgggtgcctgtaatcccaactactccagagactgaggcaggagaattgcttgaacctgggaagtggaggctgcggtgaaccgagatgaggccatcacactccagcctgggcaacaactctatctcaaaaaaaaaaaaaaaccacaaacacacacacacacacacacacacacaaaaaaacaaacaaacaaaaaaaaaaaaccaggctgtctttctgggttctgttgatgaatctgcctcagagacaatacctggattccaacatattcctcggtttctggatccatcatcttcatagctaaaagaaaaaaaaaagccaactgccttcctcctgggaaatttacatctcttaaaagggtaacaaatatctcacattttccatctataatatgagccattgtcagagttctccttccatgggtccactttatgctccaatgacctcatagctccccagatgtacaatgtagggggcaagaaagcctggctctctccttaaactaaggttcgttagaagatccaaaaataaaacttttaggccagctcaggaggtgaggactaggctatcttgtcccccgccccactagagggaacacactggtgatctactttgaaaatcaggcaactggctcctgtaagtggcaggttttgtaagacatgcctcagcaaatccatctaattcatctgagaatgctcttagcttcaagtaatggaatggccaacaaatacgtccctccttcctcataaccagaaggctgctgaccttagttcagtggtctaatggcctgaggccagcatctctgtgattctcatggctttctcctcatggtctgctctcgttccaggcatcatgtccagaacctgggtaacataaaacaggaaatacatatgtgtgtgcctgtgtggatgtgtgtgataatatatagagtgatgaattcagggagtataccagatatagctgtccttttttgtttaaccaagaaaccaaaaacttctggaaacctctcccagcaaactgttatcatattcttggccatatctatgtcatataactactcttagctcccaagaaatctgggaaatcaggagttatagttaggtacatttctaccctgaataaaatgggatttttttaataaaaaagaagagtaaatcaatgtcaggtaaacatcctctgaatgatcagtgcaaatctgtttgggcaccctgaattccagttgtctccaagcatctcaggtgctccataaggacttcttcctatcaggataaacccccaattttccctcaggagttctcaaatatcaataatggtgaaggatagctgaggtacgcatgaattattcatcaaggtttttactctttgatttttctataggagttgatatacaatgtatctttgttaataactagaatctgatttgtgcatctgatggtttaaatattctgccttaggacataccaatcacccagcatgtaaatggagttcagccatatcctagtgggattagaggtagagaaacagccacatctcaaggagcccctcacatacatgttgattctaattcagtgtctgcctttcactctttgtccgcctggacccgtgtaacaggtctgctggaaatccttcatcccaaatactcagccagtgttgaacccagaactcttgctaaagtaaacaaggaaaatatggaaggggattttttaaataatcttggcatccaacaggctggggttggaatcttggctctgttgcttaattactttttgacactagtcagtttatctgacctctcaagacctcagtttccccaaatgagcagtaagaacatcaatatttacttcaaagagtgattttccaagttagataacatttttaacatatctagcatggtccctggcacatgatagacattaacgaaacattattcctattagcatccttttaagaaagcagagttgaaatataattgaaatgccaggggttcagtctaggtcctgctgctcatagcacagagagctaatcactgagacgatgagtattgccagggaagaaggctttatttgagtgctgcagccaaggaaacaggagattagtctcaaatccatcttcccaaccaggtaaaatagggctttatatagcagggaagaaatgtggggaaaataggaattagggaggagctagaaagaggtcaataggaagcaggtggtcattaggcactcatgacaggtgaggggtgtggcatcttattgtccagatgtggtgatctggtgagtttccgttccttgatactatctgggaagcctgatggtcagtttcctgagaaagaaactcagttaagataaatgtaagtttcaagctttaagactgtgagggacagacaaggtggctcacgcctgtaatctaaacaatttgggaggccgaggtgggtggatcacctgaggtcaggagtttgagaccagactgaccaacatggagaaacctcatctttactaaaaacacagtattagccagatgtggtggtgcatgcctgtataatcctagctactcgggaggctgaggcaggagaatcgcttgaacctgagaggcggaggttgcagtgagccaagatcatgccattgtactccagtctggggaacaagagcaaaactccatctcaaaaaaaattttaaaaataaaaaataaaaataaacaaaacaaaacaaaaaagattgtgagggtcaatttctatgtttattcaagaaaaaccaataacataaattctgcgggaccattgggctggtttcagtctctgctttctatttatcagttccttaattatggggaatctggtcattgatctttctgtctgctttatgctgagaaggggtgatgagaatttagaaggggctaagagccgacctactgacttacttctgggggctatttgtatgttcagcagggcaagaggcaagaccttttcccaggtaagatttgtctcttggcaaattttagaaagaagtttacaaaactgcttatgactcaaaggaatttcctttgccatttaagagatcacactctagcctgggagtcccagcttccaaggctccgaagctgagctgcatcttcagcactggcctaaatgggtgatctcttttgaagatctgtgtaaggacacctacaaccaccaaaaaataacattataactaatcttagcccttaaaaatcagtccttacattctgatgtgcccacctcttctgcaattgtctctaggcctggagggattgaatagtttttatttctggccctgtgtctcatgaaatcagttcattttgacggtcaccttctcctggtctgaaaatggggctttgattggtatcaatgttcaagatttagcagtagtcagtgcctttttcaggagtcaaagtcctgtaacttaatggcccaaggactttaaaagcaacacagaggccgggtgcaggggctcatgcctataatcccagcactttgggaggccaaggcaggtagatcacttgaggtcaggagttcgagagaagcctggtcaatatggcaaaatcccatctctgtcaaaaatacaaaaattagctgggcatggtggcacgtgcctgtggtcccagctactcgggaggctgaggcacaaaaactgcttgaactcaggagacaggttgcagtgagccaagatcacaccactgcactccagcccgggtgacagagcaagactctgtctcagaaaaaaaaaaaaaaaaaagaagtaatttagaaagttacatggatacaaaaccttaaatcttagtttttttaagcaatttgaaaaaaacaaaactaagaatgatgacataggaattatctaggtaaaacataaaaactggcctaaccagttaccaaaaggcaaagaaagaccttctgcagtgtgattgcttctccttatgaaaagcctacttagataacctgaaagtcaaatccaatgaacactttagacatatcaagaaaatccaaatgtacagaatcaaattatactgggggaaaacattatggttctagaccctcaagataaacatttcagcgtcaggcagttagacagcagcaggtagaaccagaggtaaaaagttacagtagctgacaaaaaagttgaaggagaaagttatcatctcagtccttttcaagtggaggaaaaaattgaaagccactagtaagacataatgaaattacacttctgaggtgggaatgtgagaagttttcaaaaagaaacagattatagaatcaaaatcaaaatctcttgtcaaatcagtctcttgtcaaatccccttgttctaacatagaggaccaatcttaactttttcatatctctctcctctatgtactggttcctttctaccttgtttataaataacctttctaagtccatgattttaatgaaactttaggtaacttctgaattttcgacaaaactattcttttttctcaataagagcacatcttctttggcacattttacagacagaattattatctattaactagagttcttattcttagtaaccttgaattccagtaaaaacctgaaaaacaaaaaaattctgaactatcagatattagcattttctagatgagaacatatcacaatttttaaaaacatattttcccatatcataaccctttcttaatcaatcagaaatgcctcccaacccatgagcatcattttttttttttaattttaagttctgggatacatgtgctgaaagtacagttttgttacatgggtatacatgtgccatggtggtttgctgcacctatcaacccgtcatctagattttaagccccacatgcattaagtatttgtcttaatgctctccctccccttttcccccacccccgacaggctccggtgtgtgatgttcccctccctgtgtccatgtgttctcattgctcaactcccacttatgagtgagaacatgtggtgttggttttctgttcctgtgttagtttgctgagaatgatggtttccagcttcatccatgttcctgcaaaggacatgaactcattcttttttatggctgcatagtattccatagtgtatatgtgccacattttctttgtccagtctatcactgatatttgctggaatgtgtgaagccattcctgctgtctggtacccacggaagacattcactcatccacacccagatgtcaaatttcaaaggctcttcttccttagcgattagtaacacagttggagcaggcagtggtggagccaaagagagagactaaaacccacctctgaccaaaaatggtcaagcagctgcttagaagtgcttccaaaacacttctagcccctgcagctgagccacaaacaacacgttcccagttgggcaaccaaaatctgttaccaaaatgccaggagtaccatctaggttctgttgctcaccgtacagaaagtcaattactgagacaacagatattgccaaggaagaaggctttaattgggtgctacagccaagaaataagaggtaagtctcaaatccatctccccaaccaactaaaattacaggtttatatagcagggaagaaatgtaactacatgtgggaaaataggaattagggagtggtaaggaagagaagctggttaacaggcagcaggggttcggttaggaaaacaagaattggggaggggtaaaaaagcaatcattggctgggtgaggtggctcatgtctgtaatcccagcactttgggaggccaaggcaggcagattacttgaggccaggagttcaagatcaccttggccaacatggtgaaaacccgtctctactacaaatacaaaaattagccagatgttgtgcctcagctactcaggaggctgaggcacgagaattgcttgaacctaggaggcagagattgcagtgagctaagatcacgccactgtactccagcctgggaaacataactagactctgtctcaaaaaaaaaaaaaaaaaaaaaaaaagaaagcaatcatgatgaagagtctagcatctcattgtccatatatagtgatctggtaagcctcagttccttgatactatctgtgagggatgacagctggtttcctgagaaacgaactcagataggacaaatgtaagtttcaagctttaagactgggagggtcaatgtccatgtttatatattaaaaaaaaaactataacatcaattctctaagacaaattggtcaggtttcagagggagattaagacattgaactctatttttttctttttcttttttatagaaaatctggcaaacccaagactcaaatttcagggaaataaaaaggtcttcggaattcactataactcaagttcaaatcccttctcttccatttggtagctgtggtaaccttggctaatttatttaaactctttgagtttctgtctctttgtatgtaaaacagggggaaataatacctgccttatttagttgactattcattccacaaacacacacaagtgcctactatgtgatagacacagggatacaaatattaacaagacagacatagttttttgttttttttttttctttgcttttgaaatttaaagtctagtggatgaatgttcggagtaactttaagcacttccaatttacagaaagtctactaggtgccggatcctttatttcgatattcacagcttccctaaaggtatgtggaacatcatccatttcacaggtgaagaaactgagtttggagaatttaaagaaatcacccaagagcacacaatgaatggccatgtcaaaatttgcactggggaccacgggacaacaaagcctttgataatgctgatctggatgaagcactgggcacaataatgggtgcatggaaaacgcaatctaattaaatgtgcttcagagaattgatactgcattatcactggaatctttggctaaacttgctaaactttggcaagtttagccaaagactccaacaatatcatgacaatagcactcacctcctcctgccttacagacataggtgcacacagagatttgctttcatcggtcttacagatgagttgcagaatagtcatgtaacagaatcaggcattatgtaatagcagaacaaacacaaatagcccatgagaccagcagcttggcataaattactaggagccatgaaaggcacagctgtatctaaagcatatgattacacagatgcacccatacacagagaacctatcaggaatgcatgatgactgtctttagagttccttaaattaggcacacaagaaaaatgagtctacaccctgccaagacaatgaatgatggtaataataacaattacatttattgaacaattaatatatatcagacatgttgctaagcaatttacattcattgcctcagtttcactttcaataatcctttgggttggatactataattatttgtattttacagttgaagaaactgaggctcagctgtccaagtgatacatttgataattgacagagctggggtttaaaagaaggtccacctgagcactatacttttaatgatatgtcattacaagcttgagcttcacttttatgtgtgaggacagacaagcctcaatattccccaaacctgtcatcattcaattcccatctccctactatgcatcttttgctcagttcttttctctgtctctgtcatcaatggacatatccccgaaaaagagcaacattcctgtaatgtgacccttgatcacgtgttcccaaaacatcttcaaactgtgcctggccttgtccacatctctacacctttgaagtcattcccttacagaggaatcagaggcatagagggcttctaaagacaagacaagacaagacaaaacaaaaaacagaaaaaacccaccttggttcaaatctaggcttcccttctccctgctatgtaaattggagcaagtcacttaacctctctgagccctagtgtctttatctgtacaatgaggatactagtacatatttcctaggaactctcattagaaataagtgaaaaattttatgcatgaaaatttgaaagatatggatgtgcctaacacacaataagcaaaataactgctattttccttctcttagttttgtatggagaacacatacttatctttgaaaactcagatcaaagcctcctccttttctcacacgtgggttttgtcactccatcctctgtgctctgggaactctgtgtctctaatcagcactttttacattgatttttatctgtttaccagactatctttactattagaaagcgagctcctccagggaaaaggctttgtcttatttctctgtgtatccacagagtctactgctgtcctaccactgtgtagaataaaccatcgtttgtcaattgctgcattaaattgcattaacactcacccataaaaccacctggagggggtgtgtcttggagagcagagctcactgttcttttgcttgtgttttgtgtattgtctcacatccagcataacaacatacagtaaatctgagagaaaccaagaataattgagcaatatagcttccttcttttgagcttctaccctatgctatgcactagctgttttacgtatatcatctctaattctcatagtgatcttgcaaggtcattgtgacttgaataagaggatgagatattaaattatgtttacagtcagtctcctccctactccctgcctgtaaaagggaaaagatcttggtccagctcatgagatcttccttactagaaagtataagccaatttgactgggccacggggtacccagacattcggtcaaagattattctgggtgtgcctgtgaggatgtttgtgaaggagattgatatttgagttggtggattgagtgaagtatctgccctctctagggtatacaggcttcatccaatccactgaagacttaaatagaaccaagaaactgaccctcttttaagtagaagggaactcctcttgcctggctgtttagagctgaaacactggccttttccggtcttcaggctcaagtggaaacatcagctcttcttgggtctcaagcctgccagctttcaggctacagtttataccatgggctctcctggatctccagtttgctgactacagaccataggacttgacagtctccaaaatcacatgagccaagtccttatagtggatacataggtaggtaggtaggtagatagagagacatagagacagatgacagagaggcagacagatggatagaaacacacacacacacacacacacacacacacacacacacacacacacacacctgtttctttttctctggagaatgctgactaatacaagcagaatccaaatagtgctaaaatggaggtgaaaatgaagaaatagaaatgtatttgatctatacgtaacaattttaaaaatgcaaaagcaggaagaaaagtgggaaaacagaagagcctaccagattatatatgaagcagcatttgggggcagtacagagaaagaggcgagagtttgcaaggaagcattcctaagaatgtaagagactggaagcagggaaatagagaaacttttcaagagatacataggacatcagaaatgattctttcctttgtcattttctcaagagtttgaagaaagctttgatttgtttttaacattttctgatgaaaatgagacattatataagacagggccacatagggtcctagttatgtgcagattacagttatacagattctcatacataagttacatgtgggttacagttatagagattctcatgtataagttcaacatttggggtgggttattggtttatgaaaatctctctctctctttccctctttccccttccctcctcatttctgtctccatctctctttctccctccctcctccccgatataaccaatttatttagctaaggatacagaaacctattgaatgcgaggtggccatataaaacaaaggccactgcaatgtgtctcattttagcttcccttggcccccagtgtctctgaaaggtacacatttacataaatgcaacaaatttagagagtcacatttttaccagtattcttgatttttgcttttttaattaatttttttaatttttgatttttgtatactcaaggtatgcattagaattgcacaaagactttcgctgacaagctatgtatttctatttaaaataagttctcctggttctcaaacccatattcggtattcacaagacccatgttcttaacagatgtaatgggggaaaaagcacgttccattcttaagtcagttcttagatgtccctgaaaaaaatatctgcccctagcactccagaaaactcatttccctgccaacaaagcttgcaacgttattattaaccatcaagatgttatcaaaatgccaggggttcagtctaggtcctgctacttgccacacagatagccaatcaatgagataacaagtattaccagggaagaaggctttaactgggtgctgcagctgaggagatgggtgatcagtctcaaatccatgtccccagctgaccagaagtgggggtttatatagcagggaaggaatgtagctacgtataagaaaacaggaattaggaattaagtagcggtaaggaagaggagtttgtcaacaggaagcaggtggttgattaggaaaacagaaattagggaggggtaaggaagcaatcatgatgaatgaagtgtttggcctctcattgtccagatacagtgatctgttaattttcaattccttgatactatctgggagacctgatggtcagtttcctgagaaaggaactcagataagataaatgtaaatttttcaagttttaagactagagggtcaatttttatagttattcgaaaaactgtaaacattagttctatgggatgattgggccagtttcaaagataacttaacttataaatatcagagacaaaatatgaatccggatctatctgactctaaagttcatgattttatactcttatctctgcagagcgagttcttagaaaataggcatcaaattatgccaatacaacttctatagaagagtgagtctgcaagccagttcagcactcaggagtttttttgtgccgtaaacagccacggccctcctctaagggctccaaacggagcacctggtatacctgtatggctagtccctagggcagtcagatcttttgaaatatggacctaatttaagcttggtcttttatcaaataactcacccgacaaattctcagttggcaaccaggaggcatgatatgagcttcggaaatttattatgaagaaaacaatagatcaggtaattcactgtctttggaggtttcatgtcagaggtttttcatcccaaattttactttattttgctctgaatagaagcaggcaattaaagatgtccagtcaaatttgtttttgagataaaaaagtgctaaggcagtatgggaatgttccaaagcactccaaatgtcaaataggaatggtcataaaaaggcaagttgaatgttaaagataagttgctgcaattggaatgccataaaatatgatagcctctttcaaaattttaacattcagacgggattagaacagcacagagcccttgagattttttccaacatcctcatctccagatctttcaaattgttgaaactaatgcacaacccagggcctgagaccaaatttctcaactctcaggccagtgaactcattcattaacttggaaagtaagagctaaatatttatgatggatgacttcatttctacccttatgtcaaatttcactgacaccactaaatatttcagaacacatgctcatcagaaaacttcccagcaccacgcacagggaagagtttaggaagggtcacaatatctaggcatattgtctacatctatgttttacctagagtgtgttcactgatgggacagagttaagtaacattgcatacttgcattgcatttcatttccttcttgaagattctcgattctcctcagctaattaaaagttcttagaagttcacctataaagagaatatttagcattctctaagtcattcaccctagtgatctggtagtactttacaaactaatcctgtcaaaacaactcctgaacccctccaaattcccaagcctatatctaaatttcttttttttttctgataaaaataaaattctttggcacctagaatataacattatttcctccatcccagataacaggatgctgctgggtcaaagtgggtgagcttcatagtttcattcttgcaagagaactggtcttgtaaatgcatatggggttagggagagcattgcattccaaggagtttcaactgttttttgaagcgaagaatgcagaactagtggggggaactaagaaaatgcaaatatagggttagaagtagaggaataaaggagtttctgaatatgtgcttagcattctgcatgattgactggatcaaagtttctcagatgccaatgtgcatcgaaatcacatggaggttttattaacacagagtttggggccccactcccagggttttcaactagaaaggtttgtgtggggcccaggaatatgcacttctaacaactttccaggttatgctgatgctgctgattcaggggccacactttaagaaccgctcttctagaccattggttagccttaaatatctggcataactactcagaccagcagtcttcaggtttcttcttagcataaaatctttttgtgcatgacatcattgttgttgtccgggtggtcttccgtcctcacccgacatccatggctacaccaggaaaccactcctcccacactgtcttggtgggaaactcagtcaagttatttccactctcacctggacagagtggatacctgacaaaagccatggaggggcccagctataatctaataccagcagtgagtatgggggtgggagtaagaagaagaggtgaggtagagatttcattgttgctagaaaatgagcaccaaaaaataagctatgataattggctccttttccatgcatctcaaggtcccattttttttcagcagctttcaatacagtctcatcacagacatcaatatattacttaattttaaaacgcattattttaagaatgagcccacttacccaacccagtcatacttctaagccaatcagactcctatgcctgggaatttgaattcctaaacaaattcctaacacaaagtccctaaaccactggagcccaaccctggcaccatgaaattttggtctattagttgctgctacgtggatccaggtgctgtccccagtcctatcttccagtattgtccagcttcccctttacttctctgtgtctcctcatttctctttactaagttcctttttcgcctaagtaagctaatctgtttctgtggcttaaacctaagattctcccaacaaaagaaataaggaactccatatttaacgcataaaaatagtatctctgaataaagaggggagtggggacctatgactgagacaactggaacctgtcacacgtgctcttccttcccaaagaacacctccaatgagtttctaaatagcctaaaagttttgggagacacaaatgggagatcttggcttataacatctacttgtgttttgggctcactttggcaaccagctaaagataagggtttgggtggatctggtcatcttaaaggccagtggataaaaatatagcccacttccctgcgagttttaattataaatccttgtattagctcattcccaaaaggccttggaaaagtgtatttgtgtataacacgatcctccggcacaccgggttgtattactcatttcatcagcatagatggaatccgatatttggctccactatcataacatacatccaagggcttatttcctccaaaagaagtacaattggaaatagcatcgattgagccaaaacatgttaatttcagcatatatcgttaaagagcaggcatcagcaaagatgcagcgttgaggaggcccacacaacagaaccatgagagtccttacaacacagccccaaatagaagctgcctcctggaggtctcaaacaagaaaagaaatccacatgaataagctttgtcttaaaaaaagagttttccatcctacaactttctttaaaggatagctcaactgaaagaagtcactgtctttggaaaacaaagccccttcaccaaatttagtacaattttacttctagagatggatgcttcatgatagagcataagggccccaggaaatccaaatcccacaagttgaggggcaaactgttctattcaggagactagacgttctgactttgagagtgctagacaagcctgttctctgtgatcattttgaataggaccctccgctcaaagggtgcggggtggggtcttagtctgattgctacatcagtccaatcaagaagctgggaggccaggcacggtgactcatacttttaatcccagaactttgggaggctgaggcaggcagatcactcgaagtcaggagttcaagaccagcctggctaacatggtgaaaccccgcctctaataataacacaaaaattagctgagcatggtggcaaatgcctgtaatcccagctactcgggaggctgaggcaggagaatcgcttgaaccagggagttggaggttgcagtgaactgagatcacacaactgcactccaccctgagcgacagagtgagactgtgtctcaaaagcaaaaaacgaagaagaagaagaaagatgaaaaaagaaagaagaagaagaagttggaacatagaccctctgaaggctaaccacttcatttacagagggaggactccaaaggccatatgaagtccacttagagatcagaatctcagaactagaaggccagataagtctatctgagagatacagccattaaacagagaaagagctagacaagctcatgaagggactcagatactcagggggcttatcagtcttttctaggaatggggagctgagaccaactggagaagttcaattatggttcaaaagaaaatattctctgctgaaaagttctcagctagggtcattaatctaagaaggaaagttaaggctgaaaggaattattaagcatgcattgcatgcttatttctagatgggaaaaccatttccagcccaggctgaagacaaaaacagaagacgatatttgagtcatattgagaagaagagtaggaatatggatacccaagaagtttgacaccctaagaaaaaaagacactgaactacccacctttgtcagcataacaccactgcttcttctgactttatcttagcctttgtccactcaattctcaaataatcactgaacatacgtatcccgagatgcccccacattttcctataaactgccctttttgcttagccttggtttctgttgcttacagccaaaaacctttaacagacacaatttcaagatcctaaaaataatcccctagctttcattatctcatcctcttcctcgttgctttaaaatgcctacaaacatgtgcagctccatttgaagaaataaaaattctctaattgcatttttgcacccagacatctgcatggtatttcacagttcgcacagtattttcatagcttcactaattggtgatccttaaatacttgtgaggttaaaaataaggaggtttgttggtgtcattatctcaattttacagataaaacagaaagtctgtgagattaattagcttgttccaggatctcatggctcacgtgctgtgcaaccatatttagagcaaggtgtatctgagtttgctccaagagtcctagattcgccattcttctttggaacctcttactttggtgtctcaaaaccttaattttccccccaacattgtatatccaggaatccaactaactggattctggcccatgaaagtacttggacttgagttgtgtgtgatcttaaataagttattatttctgttctgaattagattctgaacatatttttttaagaagcttcacagaacagactttttgttgttgcctttttttttttttttttgagatgaagtctcgctatgtcgcccaggctggagtgcaatggcgtgatctcagctcactgcaacctctgcctcccgggttcaagtggttctcctgcctcagcctcccgagtagctgggattataggtgctcaccaccacacccggctaatttttgtacttttagtagagacagggcttcaccatgttggacaggctgatctcgaactcctgacctcaggtgatccactcgcctcagcctcccagagtgctgggattacaggcgtgagccaccatgcctggccacagaacaggttttttatgcagtccaaacacaattatatgcaaggattcgtactgcacaacaaagcagtccacaatggaaggtcattcattgaccaccatccctccaatgggccaagtagattgagttttcataaaaggacatgctcactgcttaaatgtccattttttgtgcatcctttcccttaaaagagcaaagtgaaagattctgatattcctgatgtggcttagagaattcttaatcaaattctctaacccagatctgtactggacgtactctcaagaccatcttcctccttgagtaagaataaaacttaatacctggagtcacttaggtttgaaggatgagcaaatgtcattataaaaatgttatctacagaaggtaatgagtgcatggaaccatggtcggcttatcttcattgaattaacacattaacaaattcaaaaaagattcttagagaatgggacataggatacacaagctttgatggaaactaggtaaaagaatactgtctgtgttttactccctgagagagaggagaattccttacaatggaattccttacactggaccattgattaaaacccatgtatgtctagtgttccattactggaacgctaagcatgtgggagttatttatatcctactgctcaaggtcatcgctgaggtctgatttctcacacgtctgcaattcaaaaaaattgcaatctctggcataaatgggttaaacatatctgacacctaaatactgacagtcactcattatcggtgtggttatgggtgagttcctgagtttcttccattccaaaaaggaaataaaaatcttgcttcacctgcatctcaaggcttttgtggggacctgggaagacagagtaaccacgaggtcccagaaagatttattgggcacaaagtaagagaagtcagagataaagaagaaaacaaatttctcattcaagatggtatactggggaaaacactggaccattgatataaaaatactgaaagtcattcattatcagtatggttatgggtgagtcccttagtttcttccattgaaaaaaggaaataaaaattctgcttctcctgcatctcaaagcttttgtggggacctggtgagctaatggaagagggaatgctttgaaaagaattgtgattatttggatgtagaaggcaagatgcaggaggtgtcactgggtgacccccaagttcctgacttgacaaaacaggtagataagaaaagataccctggaagaaaaacacatttgagaagagagtttggtgggagttgagtatcctgtgttagtggaatacccaaatggagatgtacaataggcagctggatattcagaacacttgggccaggtgttctccagaactggtccaataaccagaaattccatccttctctcagctggagttactctgactgtgacagctgctgctccagttactctatttattgttactaatcccccagggccgcaagacccttccacagaactctctctcattcctttccacataaatcagcagaagaactacactaagtcccaggtgataaatgaaccccttccccaaagagtttggcttaagcccaaatcagcagcttgcctgtcgatttattgttcatttaaatcattcttgcctcttatgacaaaatgttaatgacaaaatataggtgatcctccaatggagggaaaagctgtatctttgcaactggaaattagaaatgtattattaacaatgagcattaattatatattttaatgctcacaggagagatgtgattgggggataatttgcagagaggcatagggggctctgaaacctagcgcgatcattttattagacagatcctattttctgcaaccatgaatatttcattcggaatatttactccatcttattattcagccattcttcctcggctaagccccagatttagacaagtcttctctctttcctgatcttgttcttgagagaccgacagttatccagagatgatgtatgattctgagaaagagtatcctgaaaaccaaattataatttgctctgtccccaggaaaatccgtattagcaatggaggccctgtgattacttagggctgtgcacactctatgggaaaaggatatgaggtatcttaagtgttgatatctcttgctctggaaagtcttcctaatcctaataatctaattctccagtccaagaccagatccagagtgcattgtcctgccccatcaaagacccccactaggttgtcctaattacctgtgaccaagacacacatccctctgcaaatgtgccaagcctagatttcaagaagtattcagctcatcagaactgaacattttaacaaatattcagatacataaacacccacaacctacacccttgcaaatatgatcaacttcatgggagtagatgtacttgcccagcatgcaagtaagtttacccctacttcaatgtatttcattaaatgaagtatctttccaccttttactgagtattatcttattccttcctcacaacctcacagcaacatactcttcattctgtgtactttgggtagaagtcaactgagcttcagagagaacatagaagcttaagaaataaactcttagctgggcacaggggctcctgcctataatcccaggactttgggaggctgaggcagatggatcacctgaggtcaggagttcaagaccagcctggccaatatggtgaaaccctgtctctactaaaaatacaaaaattagcagggtgtggtggcacacacctgtaatcccagctactcgggaggctgaggctgaggcagggagaatcgcttgaactcgggaggcatagattgcagtgagcctagattacgccttccagcctgggtgacagagtgagactctgtctcaaaataaataaataaataaataaataaataaataaataaataaaatgagcccttaagggcacatgctggtacatgctagaactgagtttaaactaaagaccaattctgaagtttatgtatgtaagatcatccaacccaccattgggtgaatttgagaaagttcaagaaaaaaaaacaaataaaaaataatgataaccctaattgtaaacaacagcaagtgccatttatttatgacatattaaaagctttgcacacattatttcatttagttctcccaacaatcatatcaagtaggtacagttatctgccttattttattgatgaaaaaagaatctcagaaggttaagcaacttgaccaggcacacacagcttctaagtgtgggatcagaagtcacatctctctgactccaaagcaggcaaattttcaccttggcattgaagcagttttacagacctatgttgacttttcttttcaccaattgaccagggaacttctaactactcagcattaaacttcctaaattattccattcctcctctgtcagactacgagctcaaagccttagtcctggaatccagttttctgccccaggctccctgggcctatgggtccagaggagctacctcttctccagtccaaaagagttccctgacttcggagtccagttctgtctgggtaaaacactctgctgaagaagggtccataagggattttactatggctatctttttggacatattaaggggcaagttctctaatgactcataaaggccattaacatgggttttgcagtgagtactaagaccttcccatatgagtataactgaaaccctacacaaataatgtaatgtttaattgcatgtgcaaataaaattgtgcaaaactctctaagagtataaagttcgaaagactgtattttataaagaattttttaatgatataggaacaaccttaggcaagtatgttaaggaaaaaacagcagggtgtgaaactgtacatagtgtatcatcatcattatgtaaattatctaaaagcgagaggtgggagcaggggaagtacttgcagataaatacacaaaagtgctaacaatggttgctgatagatggtatgatggagacttttaattttctttttttatatactgcgaaattttccaaattctcctcggcgaaaatatttgtctttggcctagggggaaataaacatttatgaacaacaacatgttaggttataatattcaaatttacatagaggtctaatattgtagatttgatagcaaacttcgtgaaaggagaataaagctttcaggttttgcttctgtatctattcaccccattagacgacattttgttgacataatattttctgtttgttcctttccttcaccgctgatgcagttagaatatctgtgttaaacaagcctacctgaggccaattacagctctccttccaaccctagaagacaggagaagagaagcatctcatttctctctcaccccatctgatacatatattcaggctgggcgcagatgacatctgtccagacaacggataatattgcaatcacttctgattagtttcctgttaccaccacgctgttcacctgtgttacaggagtggctactggggtgtgctggaaggagggaagagtaggcgatgaaggcagttactgtaatttgagaatctgtgctattgttaccaaagccgtttcttcagaatccagatccatgcatcctcctttcctcacatacagacattctgcatgtgggatatgctaggcaaccagtcaaatttcctatgtttcagtgggatggactgtttgtcttaatttacattgctccaggaccttaggagccatcatattggtgaagaataaataggtctcagcgattgtaacatgatgcatataatttgccactgacagtttttcccctgaaaatagcaatgaggaaaaaaacctagttacttctttcaagccagtggtgaactttctattcgttttctgagcaactcagttttttgagagtcactcttaattttgtattaataaaaacttgatttaaaaaatcaggaagatgtgttatgaaggctgtcaatccattttctaatgatccacatttcctttttcaaggccaaagctataactttaatattaaaatacatgttcactctaggccttaccaatgttgattaagccagggataaggcaagaagcagaaaagatcgacagtatattttcattcactctctcttaaaataatgatgcatgcaacttcatgtcattactttttaatgatcttagcctagttaatagcacagtaatattccaaaaaggagcaggaaattatttccacatttaattttcattgcaaaagtgagaggaactcttgatttttttttctgccagagaagctgtctgctgcctatgactgcattagctctgctacattacagctgagctaatggatcaaagccaagtgattactttcctagtcttttgagcatttccaagtaccaactgactggctctcaaagacttggacatggcttttcaatgtcgccatgaagtttgcttgatttcccatcaaggcagggccttttgaccttgcaactgacctgagatgggattcattatatgtgtccctttggatatcttggttgcacagaataattagaaaagggggctctaggaagtgtaatagaatattatacattatgatcctaggcctttggtatggagcagttaacatcacagagatggttccttatgttggagctcatggcagcaagatttaagatattacattttctcaattccataatgttcttcattataggaaacacaattgatatattgtatatatcaattcttctttttgggggaaaggagaaaaataaaaaacaacaaactaacttaaatcttgacataaattgtaaaatgcatctgagataacatcaaatgtgaaaaaaaataaaagtatgtctttgaaccacaataagaggccaccatatatccaacagaatggctaaaattaaaaagactgacaacaccaaacattggcaaggacacagagcaaacgtaattcacatacattgctgatggcagggtaaaattggccgaccactctggaaaaagttctgacagtttctcataaaatgaaacccacaactatcctatgactcagcagttccaatcttaggtacttatccaagagaaatgaaagcatgtgttcacagaagacttgtacctaaggaaaagttgtcagtagcaactatattcataataaccaaaggctaaaacagttgtgcatcaactgaggaacaataaacaaactgcaacatcttcattcaatgaagcacctttttttttttttttttttttgagacggagtcttgctctgtcacctaggctggagtgcagtggcacgatctcagctcactgcaatctccggcttctgagttcaagtgattatcctgcctcagcctcccaggtagctaggattataggagcttgccacaatgtccagctaattttttatttttagtagagatggggtttcaccgtgttggccaggctgctctcggactcctgatctcaggtgatccacctgcctcggcccgccaaagtgctgggattacaggcgtgagccactgtgcctggcctaatgaagcactattctgtaagctaaaggaacaaactactgacagacacagcatatagatggatctcagagacattatgctaagtgaaagaattcaaacacaagagtgcatattgtatgattccatttatagaaaactacaacaggcaaaactaacctctggtggaaaaaaagaacagttgttggttctggaggacaaaggatcagggcttgacaaggaagggtttcaaggaaactttagttaataacatacatgttgatgcctgcaacttactttgaaatacgtcaaaaatataagctggacggatggatggatggatgagtggatggatggagatagatgggtggatatgtgataaaacaagtacagtaaaatataattatagaaactagatggttggtatataggtgttcactgtaaaagtcaacctttctgcatggtgataattatgataataaagtgctgggaaagtatatctttgaatcaagtaagtatggtagatgaaatgtttcacccacatccttccctgtccccgttgtatggacttaaagaatccgtaatccctatggtgtgccttctgaaagctcacgattcttctatcttgttccattcaaaaatctgaaaaatcagcatgtgaacttgttccggttttatagtaggtagatgtgcgtgaccaatctcactttgggatatttgtattttaatccaataatgcatttaacactcactaagggttttgtttgtttggttggttggttttgttttttgagatggagtcttgctgtgtcacccaggctggagtgcagtggtgccatctcggctcactgcaacctctgcctcccaggttcaagtgattcttctgcctcagcctcctgagtagctaggactacaggtgcccgccaccatgcctggataacttttgtatttttagtggagatggggttttactatgttggccaggctggtctcaaactcctgaccttgtgatccatccaccttggcctcccaaagtgctgggattacaggcgtgagccactgtgcccagcattaagtatttttttttaagagacagggtctcactatgttgcccaggctagggtacagtggctattcagaggcaccatcatagcatactacagtcttgaactcctagacttaactcatgctcccacctccgcctcctgagtagctggggaagtgtctatttaattcctccagtgccttatctatttcctcacctttaaatatagtaacaaccatgttttgtgcaacttctgtgtgccagatactacgctaagtactttcataaattattgttattattgtaaactgtcttgcggtttaggagtcattaccactgctttacagatgagaaaactaaggtccaggcagtttggaaaattttcctaaggttagacagctattctgtggcaaagtcagcattcaaaatctggtgtgtctgattttgaagcccatgtccttcaacatacaataaaatgaggacttggactacggtcctttttggttctaaaatctctaattctgggagaggaggaaaatcactgtattagacactgttgagagcaatcattaaatttaagggtcttcgtataattttatgtcaataaataaatgaatatataccaaccgatttatagcattacctccagcgactcctgcaggctggttagtttcttgttcccccaacatcccttgtgtttttaaacataacaaaatgcaaagagaaaagacaatcagagatcagtctggaaaagagcacactgctgtcaccagctacctaacatcaactgattgctatagctcagggttgaatttgttgtttcctggaagccacagtgaagggcaaacatcttgtattctatagcatttgctttcatatacaagatagcatacaaatactactgcaggggtgaactttttttctttcttggacaacttggtaggaatctacattcttattcaaaaaatgttagttaacagggaacagtatctttggctttctttttttaaaacagaaatataagaaagcattcttcaaatggacaaaccttctgggatactccctaaaggcagcatatgcccttaaatagaaactcggctaaggccctgctgtgtggccgagaattagtttcacatgcttggttttgtgagaatctcataaaatattgatttagaacttggagactcaagataaatgactaagttaactggtcttttggttagatattgggctgcaattgattcatgactggtttctctaacataaattcatgggacagaaattgagttttgggttatagttcatacatttcttcctttgccattaaatgttgtgcatgttttcacctaaatgatcaattacattgtaacagtaaccccttattttatacagcattatgtagttatcaaagacctgtaactcttttgataacttctgtctctctctttctctctccaaactccctcatctctgtaggatagatactatgccctcctattttattttatagattagtaaatagaagaaaagagataatagtcactattatttcattttacagacaagaaagttgaaggaaagaaatctggcaaaaattacatacttgatagttgcggcagccaggactgaccctgccttacctctgtttgaacagcaatagcaataacgatagtcataaaacatcacagcttttatgtagcaagatgctttgcatgcatacgtcagtgattctccagtccactaagagattggaagactccctagctgagcaggtccctctgctggaggattcagggaaccaaagcctatcccaaattggctgccatcttgacaatttctccccatcgcccactgccatcatggcagcacgcactaaaccagagaagcttctacatggattggttaaattctgggcttcctaaaatgttccagaggctgcttgcaatggggaagtcacagaggagtaactgagcctatcattcttggccaagtcctgcaattatggctcacaattatttaggctcacctctttctgatatctgcttggtccttccttatttaagatgcacaggtggggtttccagatggtctgggggacactcattctttatttatcctcttcgtttgccttataagtaaaggaaacttgagattataataaatgctcaataaacattatacccgttctgggttatcagaaaaacaatgctaatatgccccatattagggtttatgagctgtagacatgttctcaccaaaaccaaatgagacctggttcactgtaatgctcccatccagcaaaagccaccacacacacccgagctccctaatccagcttggagagtctcccaactggctacaaactaatcagaaaatataatgactttgtacgtaatcaaacagtacaagaacacttcttttgttgaatggcacataattccacagacttccatgtgctcatatatgaccgagggctaaatatctacaggctaccaaaggtgtaattaaggataatagacactggtactcatgaactaaaatcactgcattcctaaagattactgaagattctaattcaatgtttttcaaagaatgattggactatgcaggatcccttatgctccttctcaaatgcagtttaggagtctgtagtgctgagagggtcatgctcaaaaatatttaagataccacaaatgagccaaacaaaaaaaaagaacaaaataggatgttgagactgaccatccgaagcttcaccttgcccattatcacatgacctgcttctctcctcctgagctctttattttctgattgttaccaactaacctttctagtagacaggtaaaaataatacccttccaaagatgttgcagtatagttcttggtctctttaccggagtgttgttaattacacattaaccacatgaagacttgggatggaggagggaggagttcttgcagcctgtggaaggggagcctacagcacatcaattaccaaccttaaggactgttcattaagtgagatgatttatataaaacaactatcacataataaatgctcaataaacattatacccattcagtacctcttcctggggaatataatccattttctacctgctgattaattagcgagagtcctgcatatctgagtgatgcgccatacagagcatggacagttgattcatcatgaataatgtaatgtcacaatctggactatttatattcaggtgaattgtacataatatgccatacatgctaaagaggaacattaatatttagcattccaagctaagccaggatgattaatttggttttaacttagtatcttctttgcagaattttcaatcctctttctctttttaaagggacattataagaaatattttctacaacataattggttcttgcttatacactgcttaaaagagttgtgtgggatgtttcgagagccttaaaaaatctccagctagctttttatccagatgttttagttctgagactttatgctaaggagacatttgaaagtatatgaggaaaaagactatgcaagaatgtataagaacaggtaattgcttcagtaaattcattcattatatggaacattatgcagtcattaaaaaatgacttacacaaagcattatcaacaacacaggaaaaggaatatacttaggttatagatttcagtaaaaataattagcatacagtaaggaactgaagaaaatacagcaaaatgtttacagtggtcatttttgaagaagtgagtctactgataataccttttgctacttcaaaaaaatttccccatttgcttttttaattggaaaaattcctttacatgtaagttaaatattactggctccaagctccatgaggccagagtctttgttcctcattcactattatggttccaagtcttaacatagggcttgtagtaatttttatcaaccttattttctgcaataataatttctctgtttttttttaaaatttttgctgagttcctgaagccaaggaaattaatgatgtggaagagagggataatggtcaccagtcaccatttattgaccacctactatgtgcccgcccctgtgctatcctctctacacatgttatttctaatccttgtcacagccttgtaagtaaatatgatctgtatgtttcagatatggaaacagaggcacacagagaaagctaaggaacttctccaagttctacttagtatgaataaaactcaactgtgtgattctagtgttttcactgtttctactagagctcacctggcctttagatctttctagaattccataagcagatgctgtctcaacacaaagataatgaccttttcagttttcattgcagatgttcctgagtgattactgcttctattggtttacacacggcatgcgtctatgcatttaaaattgtgcacctaatgacccaggatgccttcctatcatccatcctgctctccagctccacttggattcctttactgaagccccagcacttggtcttcttgagtcccttgacctctcagcaaggtgagagtgggtagccatgtgcttgaccgtctgggcacacgaacgcagcaccaagaaggcagatgttgatgtttactacagaatctgtgatgagcattgctgggcctttggatttgcggagtgcgcagtttaaaatcacactcaccttcaaggagccttccttctttctgcaaataacttgtggagggctcactctgcacagcatagtgctgagtgctagagtctaagatggataaaaatatttaagatccctgtctgtctggggctcgcaccccactgggagaggtagagtcacacatgcaagtacataaatggctatgtgctataataaggaagctgggtgttgtgatggggccccttccgtggtctgaaggccatttaggatgtaccagtgctctgaaatataaagaatgggtagagatgaacttagacaagagggtggggagggaagcaacacgactcatttcaaaaataaaaatggttagaatttcccagagcacataagagctagtgagagaaaagacccaagaaaggagaagcctgatgcagaatcctaaagactgtgctaagaatgttcacatttatggcaaatgccatgggaggctattaagactctaaggaggctcaaattacatttttaaaagatccctctgatggtgtgggagatgagctggagagggacgagagtggatgtaagctcctcctttcttccctggtccaaagcagcatctctcgattcatcacacctaccttggatacagcctctgtgacggagtcttctctgcacctctgcaaatctatcttaggtacccctcatatgctccatggcactgtgtactttctccatcttcacacatgtcacagtatattggaattgcctgtttacttctctgtaacatcactagtctgaaagctttgaaggcaaggatcacatttatcttgtttacacttacatccccaatgccaccaaccatgttggttcacagtaggcattcaacaaatatttacacaatcaccatttcattgagcacctactgtgtgcaaggtacccttctagtcctttcatacgcatgaactcacccaattctgccaatactcctttgcagcatgttctatgattgtccccaaggtaaccgatgagtaaactgaggcacagaggaggctaggcaatgtgtccaaggttacaggctagtatgctgcaccactggggttcatagtgcatgcttacaaccacacactctaatgattaacaaaagaatggaattctcatctgttagagccagcatttaattatctgtgttaatggttcaaggcagtgtcctgcatcatccaaaacagtgagtaacttccaaataatccccagcggactctatgatacatatgggctttttttcagtagattgaccttcataaattaccacttaaaatagccaataacaaaacctattcctgttccctaagtagcaatcaaactaatggacaggaagtaactaagaactaaactggctaagccaaaaaaagcactcaatcaacaaatttaattaagcacttacttgttcttcttcaggatcctgccatggttcctgtttcttatcgctgccaagtctcttaaaagcatatgctacacccaccatctctatctacttccttacctcttctttctgcatccttaaatcaggtctttgtttgcacaactgcactgaagtggctctggcaaaagtcaccgatagccactgtgttgccacattcaatgggtcccttcatctccacagctgtccatggcatttagtcttctgtgacatctttcactccttgaaattttttctttagcaccttggataccactgcccatcccaggagaaacagacgaaaggacagggatccagagcaccctattttatttctcatctctctgtgaccgggaaaaatcacaaactcttcctctgccctgagttttaacccattgtgtgctgctatgagattaagacatccaggctctgtggctttcttttttctcccctaatcttacaggacagcacaaagaattttcataaggcagtatttcacatcaattagaaaatatttgaatcaacaaaacctccataatacagtatactgaatatatgaatccaccaaggaaattgagtttgttttgttttgtgttctagcaagggatttcatttaaggacatgagaggtacagagtttcaaagaagagggcagtcccaggatcatccaggctaggagggccctataactacatttaaacattgtgcaaaggtacaaagggcttgggctttgagatcagcaacttgggctagaactccaggtcagcaaattcctaagagtataaatttctgcacttacacttaagctcttgagactcgatgtctttatgtggaaaataagaatgatagaagagatagtgaagaacaaatggaacatataagctcttagtaagtgctcattttctctctttccctggtagagatgtagcttccccacatttgccagctcctttcaaggtgagtagggctgtgtgactggtaccatccaatcaattgcgagtatataggaagctcttagtaagtgctcactttctctctttccctggtagagttgtaccttccccacatttcccagctcttttcaaggttgggtggggccgtgtgactagtaccgcccaatcaattgtgagtagaagtcttccgtgtcacttctggctaatgcgttcatgagccactgcaagaccctccaacagtcccttttgttgtggcagcaacctggaagccatgtgatcaaagcagcttacatttctgagtcatcacctaaaagacggtcctatagagttgcctaaccagctttggaatttgcgtgagtgatacgtaagcctttgtcatgctaaaccactaacatttctgggttagtctgttcttacagcacagcctagattaccctgattaaacgcatcacccactggggagtccttgtgttcccaggggtggaagcaaggatgaatcagcttcatctctttttttagccaaggtctttactgatagcatctcctgttttcttccttctcttcccttcacacaccagaatcggatctctttattttacccccaaagaaactgaagtccagagaggccaagtgacttgtccaagctcacacagcacataagtggcacagccaggccaagaacccagggcctccgactcccctccagccctcgtagtgtccacactacactacctcccagcagcttccagcttcaaatgttaataatgttctgagcttgccatacctttcaatcactgtaagcgatacaatctatgctaccttaatgcactaattaccaaaggagcacattaccatgccctaattactaacaagaagtgttgtcaattcaccatcctgtttgccagtacatgcaaaatgtttccagacttgttctcaaggtttggctggaggagggaagacaaaatacaaagaacaattgattcatttcatattgacaaccagtcaggtggcccttctattattattctttgttacctaaacacaatccaacaaagccccagaagaaaggtagctgatagaatgagatgggtgggacaggcagtgtaatgagctccagaaagagatttgcccacctggtttagatgcccatctttccctttttgcctctagggtttttcaaagcctctgttttttcagtcataaaatgggtataaaagtagtgccaacctcatggggctgccctgggaattcagtagcatcacgcacacaaagtcctatgcaaaatggcaagaagataataagatgcttaactgttattgcctatgatgatgattgctatttaggggtagtttcttaatcactgatttttccaagaagattaaaaccaggcaacgaggccaggcacagtggctcatgcctgtaatcccagcactttggaaggccaaagtgagcagatcacttgaggtcaggagttcgagaccagcctgaccaacatggtgaaaccccatctctactaaaaatataaaaattagccaggcatactgctgggcacctgtaatcccagctacttgggaggctgaggcaggagaatctcctgaacccgggaggcagaggttgcgtgagccaagatcacgccactgcactccagcctgggcaacaaagtgagactctgcctcaaaaagaaaacaaacaaactgggcaacgaagtaaggataagggaccctgatttatcttttattaagcacttgcccattctatgatgtgacttcttggtaggtacattgctaacattctgtcttttaatctttattcccgtcctataaattagatatgattgtcagttttacagatgaggaaactctggctcagagatgttcagtaacttgtctgaggccacacagctagtaagtagtagacgcaggatttcaatccagggctacgtgcctttttttttttttttttcatttcacaacaatactgtaattcaatttcacttttcgtggactgtctgcctccacgcatctttatggaactatattttggaaactttaaagggactatgacttgagggcaaaggaatgagcacatcttctgggaccgccatttgggacataatcatatgcatttatagagcctttgctgtgtacctagcacagtgtttagtgctggggtcatagggatcaataagatgtagccctggctttcaaggcgttcaaggtttaacaagaaaactcgtacaaatttgagtcaattacaataacctgtggccgatatgcaacaaaactataagagcacagaggagagatggaactcaggagggacttagaagaagcaaaatctaaagcaggttttgaaaaattaaacaccacttgcgtgcggtttcagggagaaagggcattgcaggtgcaaagcagcagtgtgcaaaggcatgaggtgtgaacaagcaggctgtcctcaagaaagacaagcagccattctgctggactatacaaagcatgagaaggaagaggagcaatggggctccagaggccagctagtgtcaggtcactagggaccttgcactccacgctgaaggcacccagaagcagtcttggtttctaagccggggatggcacagtcaggcgggctttatcatagaccctgctgtttgctacgcaaagccagtgctggctgccaactctggctgcgcaggagactcaccagggagcaatttttaaaaatccagtgccaggacctcaccctggaccaattgaatcaggcactctggaagcgcagtctggacaccggtatattttaaaagctcatcggacaatcctaatatactgccaggaatcacgctactggtgtaggggcagaaatagcatccaggaggctagtgctggggaaatgaattctggatgaagagaaaggacaagattcaaaacaacaatattttaggagctaaaattgacaattgtgtttgatgagatgtgggagctgagaaagaagaggagggagggtgggtaggaagtgacgctccatttttttaatcttgatacataaatatattatgtgttatacacctcacataatattagtgccagagagtctaacaagcccatcagcaattattgatgtctcctcatccccgtactggttgtctatgagagttcaaaaatactacaatgattgaagaatgcgtatcacatcctacaagcaccatcttccatactcaggggtccacattcattccagtcaccctgcacggtccagagggatttgccttgaacccatcctggcctcttgaaggagaaatgcctggggaattccacaggaggaatgaaattgctgtctcgttagtgcattatttactttgatgcacaattctagcagttgcagttcaggctctattgttcacatggttgggcaggaagtgtaatgggaataccattaatctgatggttttaaaggaggtgatttccaattagaattattctcaagttgtgaaatgagtctgagccggtttgtaaaacagcgagtaatcaatgcactgtataaccttgattttttagagtcccaacgctatgcagaaaaaagtgtcctccgaacccattataagagggtaaaaaaaaaatgccatcatcctcccaccccccagacaaattagcaagaaaaatgttagcaaaaagctctgcagacgcaccattatttacaaaagggagagagaagaagatgctatgaaataaatcatgctgacagttcaatcaaaaaaaatcagaatatattattcatgctgtgtttcatgagttggaaaggaactggacagggagagccaaatatgtagttgtgtgctttatttatgcataataatttgaattcctaagttacctctgtttaatgaaatctgcgtgctaactgacctgacaggctcattcaacatgtattttttgaacttcgactcttaactagtgctggtctagatactggggatgcacaggtgagcaaaccaggtgagatctctgttcctgggaaggttagttctgcttgtgagtggggtggatgggcagacaataaacacgcaaacaagaggacagaggttcataatcggtgcccaagaaaaaagcaagcaggtggtgcaatagagacctgccacgggctactttgtactggtgattgggtgaggcctctctgcagagatgatatttaattctgtgacatgcaggagccattaaaagagaatcgagagaaaacgtactctggggacggatcctaccaaggccaagatgtgggagtaagaacaggttgggtgtgtccagtcaacacgcagtaggtgcatggactgcgatacagtgagctagcaggggcaggtaggagatgaggtccgagaagtaggcagagctttgcccaggcaagactttgtaggctgcaggaaggagtttggattttattctaactgcaatggaagccaaccagagcgttttttttttgttttgttttgttttttgagacggagtcttgctctgtcgcccaggctggagtgcagtggcgcgatctaggctcactgcaagcctcgcctcctgggttcacccgccattctcctgcctcagcctcctgagtagctgggactacaggcgcccaccaccatacccggctaatttttgtatttttagtagagacagggtttcaccgtgttaatcaggatggtcttgatctcctgatctcgtgatccgcctgccttggcctcccaaagtgctgggattacaggcatgacccaccgcgcctggccgccaaccaaagtggtttaaggggaggggtgataggatctgactacaagactcctgtggctaggttgatgattcagcactgtgctggactccatgagggatgacagggagagagcagtagtaaccagtgggtggggaggcatggaaacttgagtgggcttgggagtgacagtagggttatcagctaaataatcgaattgaagataaggaaatcttccagaaggatgagctatttgaagacatccatggtgagaggcaggagcaaacagtgggaagtttgctgagtatatttaagtcatcaacactaacacatttgaagaaagatggtattatgtgggttgccttgcccagagagcaggatgtggaagggcaaatgtgggcaggagagggtgtgataaatctcagaaccatgagaaacctagttactagagatgagacagaagagggatggtgggcccaattctggagtgatgattctcaactgggggcaattctgcatctcaggggacattaagaagcacctggagacatttctggttgtcacaacttgagaggcagcgctactggtatttagtggataaaggccagggatgttgctaaacaccctacaaggcttaggacccccctcacaacagagaattctctagctcaaaatgtccgtagtgccaaggctgagaaactgtggatggacagcagagtagaacaatcctggatttcagtccccagtgtgtgaacttgagtcaagtttttaacctccctgagcctcactgactccatctgtaaaacggaggtggcaatcatacctgccacccgtgggggtgtgcatagagctgaggcaattgaggtaataaccacacttgcaggtgcagcgggactgggaagaaggcagaggctatgccatatgcctggtaagtgtgagaggtggggccattctctgaattgggcatcagaggattggggtttgagttctcttgcacacagtgggtggacttttgggaagtgactcagccttcctatgccctccctattctggtgacagatatagttataaatatagatatagatatggatatacagacatacctgctctcaatacagaagcataaaaatcatgtttatgtggcccatcccgtagaggatagtctagtctgttcaggctgttataacaaaataccacagaccagataatttataaaaaacagatggccaggtgtggtggctcatgactgtggtcacaacaatttgagaggctgaaacaagaggagtgcttgagcctaggaattcaagaccagcctgggcaacacaacgagaccccatctcttcaaaaaaatttaaaaaaaaattagctgggcacggtggtgtatgtctgtggttccaggtactctggaggctaaggcaggagaacaacttgagcctgggagattgaggcccaggttctttggaggctaaggcaggagaatcacttgagcccaggagatcgaggctgtggtgagccatgattgcacccctgcactccagcctgggcgaaagagtgagggaccatgtctcaaaaacaaatacataaacaacagaaatgtagttctcaccattctggatgctgggaagtacaagatcaagtcaccagcagatttggtctcagctgggcggtccagcttctaggtcatagacggccaccttcttgatgttttttttcacatggtggaaggagcaagggagctctctgggtcctcttttataagggcaccaatatgattcatggaggctccaccctcatgacctcatcacctcctcaaagcccttccaatactatcacactggggattaggtttcaacaaatgaatttcagggggacacacatgtaatcccagcactttcggaggcagaggtggatggaccacttgaagtcaggagttagagaacagcctgaccaacatggagaaacccccatctctactaaaaatacaaaaattagctcgatgtggtggtggttgcctataatcccagctactcgggaggctgaggcaggagaattgcttcaacctgggagacagaggttgcagtgagccaagatcacgccactccactccaacctgggtgacagagcaagactctgtcttaaaaaaaaaagaatgtcaggggcacataagctttcagaccacagcacacccttttccaggttccatcctgtaaggtgggacagggcagagtgcaggcacaacaaacagcatgcccagtctcagcagaactgcctttctcgcacacagcatgtgggcccacttgtcccagatggctctccttagtaccacctgaacgcagctttatttaactcaacactagagagatggtcaaaaagaatcagccgtgagtgtctcacctagcacgaagtctcccagcctcagcatggtcgactctttggactggataattacctgttgcaggggtctgtcctctgcatttcaggatacgtagcatccctggcctctacccactacatttaagtaatgccaagttgagaaccactgaactagcatggtgtagtaataactcatcatcatcatcatcatcatcatcatcacctgtgtagatggacagaagtcagactcaaatcccaccgcttccccttactagctgtatggccttaagtaagccacagcattgctctaggattctgttttctcatctgtaatatgggtataacactttcctatgccgagaatgaagtaatgtataaaattcttagcacagtgtctagcacacaattgttctccaaaaagtccttatccttctttattgtacatgattgagagttacacagagttaggtcgggctcggcggctcacacctataatcccagcactttgggaggccaaggtgggtgggccacttgaggccaagatttcaagaccagcctggccaacagagtgaaaccccatctctcctaaaaatacaaaaattagctgggcgtggtggcatgtacctgtagtcccagctacttgggaggcagaggtggatggaccacttgaggtcaggagttcgagaacagcctgaccaacacggagaaacccccatctctactaaaaatacaaaagttagttcgatgtggcggtgggcgcctgtaatcccagctacttgggaggctgaagcatgagaattgcttgaacctgggaggcagaggttgcagtgagctgaaattgtgccactgcactccagccggggtgacagagtgagactccatctcaaaaaaataaaaaaataaaaaataaagagttacacagagtcaagacagatctctgtggctgggtccccagaacaaagtcctcctatccccttaaacagggccacagatggacagtgagtatatggtccaaggcttctttaaacctgccccgtgaacacttgctccctcatctatctacagagtggctgttattatttatgaacaccaccgtcatcatcattagcaaaataagaaactgttggattttcccccatatctagaggctgtcttgaccctatccagactcaaggacccccgaactttctgatcttccccctcagagggaggaaagccactaaaatgaagttcttataaggtcgaccgatgcacaccaagaaaaatcagcattgcagcaggccggggtagggcgtgggtggtctccctgacagcttgtttttaaatacttccaaacgaaaatgagtttgcctccaaggaactgcctgtgtgctggcagatccgaaagcggaagcaaagccctcatggctggctgcatgcaggcatcctgatgcggaagtgctgctaatttaaacccattttccaaggtgcccacagcctccatggggaatcaccaacactctctggagaagacgcttaatcacctgaagaagtcatgggaacagagaaaacaagagctgaaaaccctctccgaaagggaggcccccaagtgacattttcagcagaatattattctctaagcattgtcttttcatcctgtgctctcttgaaccaaatagatgattaggatttaagatgcatttgatgatattttcctggtagggagccagttgtgcccccagttctgtcccaccttttaatcttcttggtggagttcccgaaggaaatggaagtgaagaacttcagccaaatgcaagcaaacaccgcttcgttattagctgggccaatgcccaatagcccgatgttggacgatttggaaaaagctggtctatgcagcagacacttgataggtaccttcttcttaacctagatcagaatcttgagtgggtgcagcgataaaggaactctggatgaaagaggcgcagctgatacaactcaggagatagatcaccacgtgcataacggggaaggaggacagggagggagggagaggatatggctggtccagctcacctcatgcactgtcacaggtgcatggacagaacacgacagagggagattagcttggtacacgtctcttagaacacagcgaccctggccccaatcagtgtggcccaatccagggtttatactctgactaatcacattagcctcttcttctcccttggacgtgggagctagggtgaggatgcactgagcacgcttgcacacatgggacaccaaggccaatgagagactgaaaatgagtgtacctccaaggaactgcctgtgtgctggcagatccaaaagcggaagcaaagccctcgtggctggctgcatgcaggcatcctgatgcagaagtgctgctaatttaaacccattttccaaggtgcccacagcctccacagggaatcaccaccactctctggagaagacgcttaatcaccctgctatacatggagctctattttttttttttttgtttttgagatagagtcttgctctgtcacccaggctggagtgcagtggcgcgatctcagatcactgcaacctccatctcccgggttcaagcgattctcctacctcagactcctgagtagctgggaccaaaggtgtgcaccaccatgcctggctaatttttgtattttcagtaaagacagagtttcaccatgttggccaggatggtctcaaactcctgacctcgggtgatccacccaccttggcctctcaaagtgctgggattacaggcgagagctaccacacctggctcatggagctctatttatcaaggatttttccttgtgatacaaaataaaattggtcttcgtatccccactgccaaacactgggaatgggtacagaggaagtaagttcctgacctagcaaatatttcttcattcccttgtccttttatccactgtagcacaaaatagcttccttggccacccgtgtgagtcaactcttgtcctaggaccaggtatgtgtatgaactaaggtcagatctggatgggcaaaaaccatcccagcctccttccctcctgcccagtgacctttctccagccttttctggcaggctccgtcaattgttgattcatctcctgtcatcttctccatgcaacttagcaaaatattcattcattcagtgaatatttattatatgccttcatcttaggttggatttctccaagcagtggctgagagggtgatgtgggggcaggtgatctatcaagaaacagtgggccaggcacggtggcccatgcctgtaatcccaacactttgggaggccaaggtgagcagatcactgaggtcagaagctccagacaagcctggccaacatgatgaaaccctgtttctaataaaaatacaaaaattagctggcatagtggcacatgccggtaatctcagctactcgagaggctgaggcaggagaattgcttgcacctgagaggcagaggctgcagtaagccgagattggaattgacccttgcacctgaaattgatcgcttgcagctgaaacgcagaggatgcagtgagccaacattgaaattgaccctctcattcttaaagcttgaaacttatgtttgtcttatctgacttcctttgttaggaaacaaccttcaggccctcaggataatatcaagagaccgcaactgggaggccaaggcaggaggattgtttgaggccagaagtttgaggacagccctggtaacatggtaagacccctatccctaccaaaaaataaaaaaaaattagaaaattagctgggcttgatggtgcacacctatagtcccagccactcaagaggataaggcaaggatctcttgagcctaggagtttgagggtgcagtaagctatgattacatcactgcactccagcctgggtgacaaagtgagaccctgcttcgaagaacctggaattccacttctttaccccttcctaagttctgttttcctgcgtgtagctgcattccttcccagctatataaacccccaattttagtcagatggggagacagatttgagacttatctcccatctcctcagctgcacacctgaataaggccttttttcttggcaatacttgctgtctgagtgactggctttctgtgcagcgagccgtgcgacctacacctaacccttggcatttcagtaacaaaagctcttcaagaaaaacctctcaaggaaggacagtggaataaggcgaaggaaagaccagagagcaagaacatggtccaggtagagtctagccttcgccagatccccatgggcaggtctctagcacaggggttgacaggtttttttctgtaaagggataaataataactaattgagcatttgcagtcatatgatctctgccacaaccactcaactctgccactgcagtgctaaagcagccacagatgatacataagtgagtgagcatggccatgaggctaaggaacttgtctgtctcgcccatcaatgtgccccatgtctggaacacggtaggcaggaataaatgatgttactgcacatccaggcccctctactgggctgctgcatccatgatccagctgccataaatgttggctgatatggcttggagatgcccttctgatacagaaaattgcccacagctgacagaaaccaccttgcaaaaaagactacgctccaccctccaaccttcccagaagcagcccacagccaatggctgatggatatataagggcacaagagaccaaccctcctgcttcatggagggacacttcagtagtatgataccttctctaaagttgaggtcagcaaattatggactgtaggccaaataggacccactggccattcaactctgaattcgctctactgagcacagaccctggaagagagcagtcagagagtaaatgtttatcgaatacaatggaataaaattgaaccttgaaagacgggtccaatttgggcagggtggggagagaaaagcattctttcaggtcctcgaacatgttatacacgctgttccatctgccaccagcactagcctacctcccccacaccactttgcctagccaaccagcattgtctctcatctttcaagtctcaagttagatagatctgcccccagcatgagtccattgctccccatctgttctcctacagtacctttgcttgctactcatggaataattctcccatcgtgtatgaggtccttaagttaatttctctgtctcccgcactagaatgttggcttcttggagtcagagacctcacctgtctcagactcttccatggtcttagcatctcacacagtgcctggcacgtggtaagccttcaatataatatttcagcaattccactactgagtatatagccaagagaaataaaatcagtatgttgaacagatatctgtacccccatgttcactgaaacgttattcacagtaaccaaaatatataattaacctaagtgtcccctaaaggatgaatgaataaagacagcatggtagatacacaaaatgaaatactattcgccttaaaaagaaggaaatgttgtcatttatgacatggatgtacttagaggaaattatgttaaatgaaataacccaagtgcagaaagacagatatctcacgatcccacttatatgtggaatctaaaaaagttgaccttgtagaagcagagggtaggagactgtttaccaggagctgtgaagggggtggtatgggattggggaaatgttggttaaagatataaaatttcagttagacaggatgaatacattcaggagatctactgtgcagcaaggtgactatatttaatgacaatgtactgaatacttgaaaattgctaagagagttgattttaagtgttatcaccgtaaaaaatatatgaggtgatacatttaattagcttgatttagccattcctcaatgtattcatatatataaacatcctgttgtataccataaatatatacactttttatttgtcaactaaaaacagaaattattttgactctagatttcttttcatccaagttttattacaaaattttccaaacgtgcaaaaaagttgaaaggtttagtacagtgaacaccacttagattcaataactgttcatatcttacagcctatatattttaaataatagccatcattcttgggcatttactgtatgtcaagcacctgctaggtgatttgcaaatatcatttttaaaatcctgaaaaatagcatagaagataagcactattattctcccccattttgctgctgagtaaactgagacttagagaagttacatcactaaaatcaaacaggtactaagtgttagatttaaaccggatctggagtactgtagctgaattccggactactgcgttatagcacagtgtgtaaccccacaacgatatgatgtgctaggggatcctagaattgtggggctgggttatttctgaagagtctgaggcagctcctgcggggagatgactccagagagcaactgaaagggagatggagctgagacaagaaatccactgctgaagtttggtggccgatcatcaaagagattaactccaacagcatctaccccaacccctttcttccttgccatacatctctgacactaccattattagtgactgggctcagaagcttgccaccttgtatgatctgaattgatccagtaaagaattctctgaaaagcaccattaagatgatttatagtctaattttggttgctatagattccaagtcagacttatgactcggaagagaggggggaaaaatccccgcctcgcttagaattcaggcaaaggtttcagtattgatagagaagcatgactggctgggggaaaaaaaaagtcatatttttttaaagtttacagctaccactcctggtttggggttgctatagcaacgaagggccttggaggggggcacagtgtctgcggatctcactctacggagagctgattgataggtcgcctgaatactgtttagacacttctgtgctaggaaccagataacattagtttattaaaatacacgttaaaacaccagtcatctctcttgccccagcattttattttaatcattgttgttaaggaattgttaacaggctactgataggaatggaaggcaaatcccgttagggagctaaacgccatcttgctggggctcgcatgcacaggccgggcggcaggcccatgcagggtgcataattacgataatttggcatgactgattgtctccctctccccccagcccaacccaccctggctttccagggagttagaggcatggctaatcctcgtaaagacttctgttcctggctgtggaggggctccggctgggactgtgcctagctaaggtctccaaatttctgtcttctctgtcactgtgtgacagcctgcatgagtggcagtttgtgccccaagaagagtgtcatcagggccaatgtatatggcctgtccaatgtatcactgcttgggagatgtggtcaagacaagctgggcatgaaccctggtcctgctacttgctagatttgtgactgaggaaacctcttaagcctctgtttacccacctggaaatgggggtgctgatattacttccatttttttggagcataaataagacattccctttagccttctacctggaagagctcattcctcacaaacctgataagacagatacttcaactccattttgcagatgaggaaattgagggttagggaagctcgagagcttgaggagctgcctaactcctacagtttggggaagattcaaggatgcatgtaaactgcttagcacactacttagtacagggttggtactccatcaaagttcttaggtacatactattgacgttagtatcattatcagtggtagaaggtgaaacggctactctcatcatccaaagctcctgctggtaacacatgtctaagagcatgaataatcttcaagcacttggtgggctcttgtcacttttcatgattgcattaatcctcacaccaaccccatgagatgaggagcatcgttaatgcagttctacaggttaagaccttgaggttctcagagacaaaaatcactagcttggggccccccagctggtagcaggcatcactgggatttgaacccatgtcttcatcattccaaaccctgtttgtacccttatgttctactgtcagtgtacctatataaagccacagactgtgcattcacgtaggtctcctattgtcttttattcaacccacatgtgatgtgtgaattttctctgtgttaatactgagcaagacattctccaggcttggcttgaataccttaagagagttcactgtaaaatggaggccaacttcatagttagaaagttctccccagccgggtgtggtggctcacgcctgtaatcccagcactttgggaggctgagggcagcagataacctgaggtcagaagtttgagaccagtctggccaacatggtgaaacctccatctctactaaaaatacaaaaattagctgggcaagctgggcatggtggcacatgcctgtaatcccagctactcaggaggctgaggcaggagaattgcttgaacctgtgaggcagacattgtagtgagccaagattatgccactgcactccagcctgggtgataaagtgactccatctccaaaaaaaaaaaaaaaaaaaaaaagatctttcttatgctaagcccgaagcccagcctgcccacactagttcaaatctccagagccacagagatacagtatcttttcaagtgctagcccattgcatatgggagaatcatcatcaggcccaccttttataagttcccttttggttcatctcttcattcttccattcacctatccgctgttatctagtcatcctacaaacatttattgagcttctactgtatgccagatactcatcaggaacagggctgtagtgctgaagggcacaggcacagttctgcctccaggttgttcacattttagttggggagaaaggtactcaaaactattttttaattcatttgattataactcttaagaattataaaggggaacaataggattctaaagaagaaatgtaaggttctatgggagcccatcaccaggacaagtaggaattgatttggcaaggaagaatgttggaaggcaactcagtcaagatataccagagggaaaagcattccagggaaagtgagcagcatgtgcaaaggtcctgtggtaagaaagaactcagcatgtttgaggaactaaagagcagtgtgtctgtggagagtgagtgtgagagagagggagattccactggagaatgatgaggtcagaaaactccattccttgcctctcactttgcttctcgaacacagacaggagagtaggaactggatcctggatggagcctgaaggttggaaaagaagtcaggctctctcatatttcacctggacctcaatctctgaatatgtttgtgacagaatatgtttgtgccattgtcaccttattaagctgacaactatgtttcccagaaactccctccctgtagggtttcagcagaaaactgtcccacagaggaacttgtggggaattttaaaagcagaagtgaagctcagccatagccctcagaacgccattgtgtctgactggtagaatggtggcaggtgttcccaggaggctctggctggtcctcaccctgctgcatgccgtgtttctagcttgccttcctaaaccctggccctgcgaaccaaggaagctccaggccaccaccagatgcttggctgcagactcgcagaagcgcagccacacgctctggatggttctctgcagaaatatccgcgagctcccctttctggtctcacttcggctggatgtgcttagactctcctatttcccacttgggccagtgcttcaggcaggtgggctagtgactttttccgaagctccagctccccctccagacccccacttcccagctccttgcacaggtagatgcggtctaattcctgtaacaaatccttgctctcataataatcattatggctttgtttccctgactgaagcttgaccaacatgctggataacatcatcaatgggagaggaaaagagaggaggggagggaagaagacgggagagggaaaaggaagggaaaggaaggaagggaaggagatggaagatgagggagggaggggggaacttcctattgaactttgaactatttttttttaaattttagattcagggggtacatgtgcttgtttgtaacatgggtattacatgcatactggtgagggcagggccttctagcgcacccatcactcaaatattaggcacggtacccaataggtaatttttcaacgctcactccctcctaccctctccctttttaaagttcctccctagagtctgttttctccatctttatgttcatgtatgcccttcgtttagtagccaattgtgagtgacaacatgtgatattcgattttctgcttctgtgttagtttacttaggataatgtcccacagctccatccatcttgctgcaaaggacgtgatttcattattttttatggctgtatagtattccatgatgtatgtatgtatgtatgtatgtatgtacaatatatatatcacttttttatttgagacagggtctcactctatcaccagggtggagtgcagtggcgcagtcttggctcactgaaaactccacctctcgggttcaagccattctcctgcctcagcctcccgagtagctgggactacaggcacgtgccaccatgcccagctaatttttgtatttttagtagagatggggtttcaccatgttggccaggccggtctcaatcccttgacctagtgatccgcccgccttggcctcccaaagtgctgggattacaggtgtgagccaccacacccggcctatatatcacttttttaatacaatcaactattggtggacacttacgttggctccatgacatcgctattgtaaatagcgctgcaataaacatataagtgtaggtgtctctttatataatgctttattttcctttgggtaaacagtagtgaggtttctgggttaaatggtatgaactttcaactggtctactgaggttatcttcaattttcaattgtcttgagggacacaagacagtttgtcttgggagcaagtcacccttgctggcggatggccttcatttgataattgaggtaaacaagtttccacaatgagaggtgagatgagaacagaattccagttcttcttgttcttacttctgcattttcattccacacaagtccaccctgttgggacagcccattccatggctctaccccatcattcaaggatcaagacctagtatggtacctgggttcaactaccggctctgctactttctcagtgtgaaccttggtcaagttacctcacctcttatttcctcctatgaaaacagaaatcataatcatggtacctggaaatgttcaatgatactgtagatagaaagttctcagcatggctgggtgtggtggctcatgcctgtaatcccagcactttgggaggccaaggtgggtggatcacttgaggccagcagttcaagaccagcctggccaacatggtgaaaccccatctctactaaaaatacaaaaataagctgggcatggtagcacatgcctataatcttagctactcagaaggctgaggcaggagaattgcttgaacccaggaggcagaggttgcagtgagccaagttcacaccattgcacaccagcctgggtgcaacacagcaagactctgtctcaaaaaaaaaaaaaaaaaaagaaaagaaaagaaaaggaaagacaattctcagcacagtgcttggcatttagtaagtgttagtgttattcttattgttgttacagtaagtccaaatttctctacctggctttttatctctgagtcaagtaaaatatgcaaatgttagtcatggattttttttttttttttgagatggagtttcactcttgttgcccaagttggagtacaatggcatgatctcggcttactgcaacttctgcctcccaggttcaagcaattcttctgcctcggcttcctgaatagctgggattacaggtgcccaacaccatggctggctaatttttgtatttttaatagaaacggggtttcactatgttagccaggctggtctcgaactcctgacctcaggtgatctgcccaccttggcctccaaaagtgttgggattacagtcgtgagccaccgcacccagcctaatcatggttttgtccaacgtttccccagagcagcatgtcctggctgctttctatgagtgcttcactgctcttttacttgcatctttttcctggatccttaaactgccagtgaggtaggcacggccagtgctcttgtttggctatcccaaaagccattctcaacctgttttcctctacttacctcctactatggagagaataaagtcaggctagatagctgcagatagatagattctccctgcagctcagagtcaacatgagacccagctttgttccatgaaataaaaggggagaaattcctaaagaagagtgtttgggaaggcgttagttagtttcctgataaaaaggacaagttgtgttagcacttcccatactcctcctttctgccttggaatgtgattgcaatggctggttctgtggcagccatctttcacacataaggatgaggagttaacagctgggcatgggagaccgcatgtacaaaaagagcctgagttcttgataacaccactgaattactcaacaaaccctgagatgcatatgtgtccttatgttttacaccatttttcaacatgtcttttacttgcatatgaaagcattcttaactgataccagaggtcttactatgcctatttacatatggtggtggagaggctcaaaaggttgggcaaattgcaaaagttctcacagctttaaaatagcaggtttgaattcagtgccagattctgccagtttcaaaacccaatctctttaccaagaccaatgttctgtactcaatgaacgtaagtttctctactttaccttctcttctccatatatttaaattccattctgattttagttcaagttctggacccgccatgaatctttccttgattaatccagtacacagggagctcctgcttcgttgatccctgtttctccatgaaggcaccaccctaccgtctgacacttaatggttttccagcatttcaaatgcattgtacttttgacaccactccaccgaacccccattatatcacatgtttcttaaggtcagagaagcaaactcctatagggtaatagatcagaggatttggagactggttcaactcccggttcttcctcttgcctgttgtgtgtctttggggaaaagtcagttcatctactatggtctcagtctgatctatgaaatgaaggtcatagctgctgcgacgtattcaggtgaaacccatttgtaaagcaattagcagagtacctgacttggaatagatattcaaaaatgatagcaaccactgttattacatgttatatttcttgtatacagtcttagtgtgtggcagagtgacaacaaatagtatgagttcgataggcaactgttaacagaatggtccattgactatttcattaagaccttactgagatgtcattctattccagacaatgtgctaagtatttgactttaatgatttttttaaagtcaaataaaatacccttgtctttgacgcatgaacagataactgtaatacaatgtgacaaattcaataataaagaaattcatagggttttatggggacacaggggaagggtacttctcaaatccaggaggacttccaggaggaggtcccaagttgaatcctaaagaagagaagaatctggatgatgagtccttttccagtccccagaactctgttatccttgccaggagtaagttacagaaacagcagacgaagaagtggcatttgtgcatctgtgagtagggacacagattcatgtatatgataattgcttttgcatcttaggacttctatctagaggctggattagttagaaacaagcttccttttcaactttgctttcatttcagcttttcctcctgcgtggtaaacataaaacccattctgtaagggctctcctatttccttttaggcacgaagcatattcttagaagcagcctgccgggaaacaaaggttaattctgcagggaatgaattgctaaagctgcgttcttatttgaagttttgatttatggaagcaaccgtgggtttttctttgctttgcaaaattctttaatgtctccatttcaggcagatccgtcggcgtcactccacgcgtgggccaaagtcactggcaagattttatttgactctgctattcttaaaaggcaggagacaggctttgtcaggactcacaggacctctagcaagggatgctcagttggaaggcttccgtcccactagcccagccatgtacagggggctgtaaagtcagtaggcaagaacaaggctaacaggagtacttaaataagagttcctgcggctggtgcatttatgaaatatcagaaggtcacagaagtcagcctcaattggttactgtgctattgaagtgctgttgtgttccagctgtgagcctctgactggctctagctggtctgtaagggaatcaaggttggtctcaaaggccttccaaggttttttattgttgttgttcctatataagatattgctgtataacatggattgtttggtaggtctaagagggtattatggtctcctcttattcaattacggtatcatattgattcattcactatgtgccaggggtgatcccaaatagcactagacaagcagggctgcaacatatatttctgaagttcttgtacgacatgccgaagaaaagcgaggggttgaaatccactcgtcaaagctatgaacccatgcaaccggcatctaccaagaagatgtgactttttctaacccacctttttggagagggtgtttttttctaattcacgcagaggtgcacaggaatctagtttaggctagcctctaccctgtctacaagataatcgtagttcttgcactcatgaagcttttattctagaagagaatgaggaacaagccacaggtaaagaggcaaacttaaaatattgaagatgacttcatattaagtgcaaaaaaataaattattagtgtggtgttagcacagtgatggcggaaggatgttaccttaaatagtcaatgaagacatccttaattattagcctatgagctcagactgaaggtacaaaagaccaagctagtgaaaagctaaaggtccaagagtattcaaagagtccaacagtctaactacaggaagttgaatgtagatttcccaggacatttatttgagagaaggggagcttcccagtaatagcaatcgcactgcatttccctctagcttctgacattgtttttgtgctcagaatcaatcgattccttgctattcttggtgggcagaaagtctttgcaaaacttgacctttcccaagtgttatcaatacagctaatagtgatgctgtcagaaatgtccaacaatcatcacacatcaaggggctttctgagttcagcgctcttggttcagagtttctgctgtccttggaatgtgtcaatgtttgttgaagattatttctttactgaagttcaattatggtgtcatattgattcattttatgtcttatatttttacatgtttatgtgtctgttttcaccaataggctgtgggttcccaaggggcaggggttctgtgtcatttcattttgtgcccccccacaataaaacagtgtagagttcaaacagttagtcaaggcagtcaatactttcatgtcctatgatggtcacatagtcacatggggtgttatttcaatactttgcttaactgattggcagactgatagatgactaggaatttcaaagtcgccatcctagggtgatgaccttcacctacatattataaacaacttgagaatgagtccacgcatttttcccctacttgggtagtttgtatatgtgctgccctaacctgtcttcttaaagggccccccaaaaattgactctgataaatcagtgaataatgtaatatttactgaagattccatggggtaaatatgagtttacattgtgcaccaaagttaacaacctaaaatctctttgatatttcttttaaggaaagccttctcttccgtactgtctagagactgtgtttttctctccctaatgtcctaaacagccccccaacttcactgacatctctttttcctgactacatggagcctttttttgttcccaaatcatttgtcagagcttatcttctaaacaaccattgcactctgttcaagtggagtttgcataacagcttcttagagaatagtccccatgttgattggcctatagaccccaaagtgttttgagcataatagatgttcaattaacagctaactgaatcaactatagcccagtgccattatgatatactgtgctataaaacaaaaagggagagagattctaatctttctcagattcctcaagatctgcttcatacttctgttgtaaggggaggtattgctgagccctgtcatgctgagccctgtcatcagccaaaaggcaaacagagtttctttagtcctagtcttgccagaatgggggtcactccggaatgttaaccggttaataattctaaaggtgcacaactgtatgtacgtgggataaaccacttcctactcagccactttatggtttaggaacttgtctagtgccaaaaagctaatgccattgggaccccagttagtgactctccctcaattccttcttccttacatggtttttaaaatattgaccttgctggagtttgaggccagcctggccaacatggtgaaaccccatctctactaaaactacaaaaatcagctgggcgtggtggtgcgagcctgtaatcccagctactctggaggccgaggtaggagtatcacttgaacctgggaagaggaagtcgcagtgagttgagattgtgccactgcactccagcctgggcgaaagagtaaaactccgtctcaaaaataaaataaaataaaataaataataaaaattaaaaaaataaaaaaaccttgccaaaaggctacagtacctgtgttatgacacttctcccaggcctcagatgattgatccagagtggtgcgtgactctagttaagagtcaatcacattctctttctctctgtcggatatctggaattgaggcatggagacagaattaggtgctgaactggaaggttctgtagacctctgtatcagcagatgatggagcagagttggactaaagagaaaggacatgacatgggcagagacatagtaagagttcctgatgattttacagttcccatgatgtctcccacatttgcatttgtttcaatgaaattccccctgaatcttttttttttttttttttttttttgagacagagtctcactgtgtcacccaggctgaagtgcaatggcacgatctcggttcacctcaacctctgcctcctgggttcaagtgattctcctgcctcagcctcccgagtagctgggattacaggcatgcatcaccatgaccggctaattttgtatttttagtagagacagggtttctcacgttggtcaggctggtctcgaactcctgatctcaggtgatccacctgcctcggcctctcaaagtgctgggattataggtgtgagccactgcacctggccccctctgaatctttataactgcttcacttttcatttgtcctcctttgcatgtgtctctggcacataaaccaaactatcctgaactaaccacaccttgtcaccaaaacagaggcaaccaaccctcccatgcaccttgcaccaggggcacctcttaacacattgaattggaattcatgatttacagatttctctcttaccaggctgtgagcaaattgaagtcaaggtctatgattttgtccctatatccctactatctaactcagcaccagggacatagtaaatgcctaataaatgtttgttgaatcaaattaaaaacaatgtcatctgcagaataaaattaggttcctatcgatttgttctaagccctatttaccgcaggagaccaggattctacaattagcttacagccatgcatttacatcttgcaccaatcacaagccactttggggactcttttctaaaaataatcccattcctttaattatatcactgcctctggcagaaccagattgccctctgtgggggcttttgaatgcaaatgtatgtgtaagcctgcgtgtgcaatactgaacgtcggtactagagccattttcattattcaataagcccttgacccacctcttcagactaatggaattacactattagttgtgctgtctactcctttcttttgttttcttctgattacaagggtaatgcaattagagataattctacaatgatgtcacaggtagccttggtgtccacctccccgccactgagaatcaaaatccatttacctacaatatcgtaatcttgctctgccccaattggtcttcagcatccttttagccaacgctggtaggaagttctacaggaaatatagcgaagcctgccagggttgcctcttctgccattataaaatgttacttgcggcaaaagcaagggattatttttcttatatgctgtgtagttcaccaaaatggtgctgatggtatttaaaaaacaaaaacaaaaaaacatgaaggcagggcatggtatcttacgcctgtaatcccagcactttgggaggccatggtgggaggactgcttgagaccagcctgcatgatatagcaacactctgtctctagaaaagaaaaacaaattgatagggttaataaataacaaaaatccatattctaaaacaataaagaaacagttatgcaaaagtatgatttaaaaagctttgactagaactgaattaactctgtaaataattagaagcaatactgaaaggtgatcatttatgtccacttaccgtcaattttgcctgggtatttcaaaatgagctaataaaaaaatagtaaagcatgttttacactgtagttcttctttgtcgttctctccaaaaccttaatctttatacattgtaagatcaaatatctaaaacactacatgtatattatttttacaaaaatacatagaagtttgattctatcttaaattggataattcagaattagataccgtacctactatgccatttgatctacatgtaccttttcctagaatggtagttctcaaacccctattcgtgttagaatatccagtgaagctttttaagtgtttgccctactcaattcaattaaatgtgaatctctaggtatgagattctaatggcatttcttaaagtttctcagatgattccaatacacaacccagacagagagccactgtcctcagaaatgtttgggagtgcatggctgggtgcagtgactcaggccaggtgtggctgctcacgcctgtaatcccagcactttaagaggccgaggcaggtggatcacttgaggtcaggagtttgagaccagcctggccaacatggtgaaacatcatctctactaaaaatacaacaacaacaaaaaaaattagcggggcatggtggcaggcacctgtaatcccagctactcaggaggctgaggcaggagaatcgcttgaacccaggaggcggagggtgcaatgagcccagatcgtgccatggcactccagcctgggtgacagagtgagactccatctcaaaaataaataaataaataattaaataaaaataaaaataaacatttgggagtgcaaatcacctgtctgtcttaaatagcaaacttctcactttccaaaacatacctcaaaccactggattcagacaagcagaacataggcataataatgaggaccaggtttggggaaagggctgtgtagtatagatgggtaagcatctctgtggaagtaatttgggtcgtatctatagaagttagatacctcagccagcacatcttctattgcaaatttgcagagcacacttccaatcagccaatgttaatttggttaatttggttgggggtcagaatacagagtacagccttcctatggggaagcctcattagtcatcattaggagtatccattctgcctggttgtcttagagtctttgcctttcttattacaaagtattagatagaacatgagaggatgccaacagccctgcagattgaacaagcaagatgtcttagaggtgtggatagcactttacactctcccaatataaaacatttaaattaaatattaaatcattattattcagttggtcaacagttatgatatggtcactataaagaaaaataagtacagtccaaccagagtaaaggaaatgtatcctcagaactctgaattttcaggtttgggaggtattgggaggtactttagaagtcaagcaatccaacttctacattttatgtatggaaattctgaggccaaaagaggactgcaactggggtttctaattctcgactgccaatctttcttcctaatcctggaagtctgttttcttgatcttatcagcagttgactttttaaaggcactgcctcctcatcccatagaatggattactattatagcattgcaggatgaacatggtggcaggggagtacgtggtttccatggttaaactggggtataaccaggacaggaacactggcctcctccctgcaagtctagaatgaccacacgactgtgggccccagacaaaccgaccatattctaatctgaacctccagctcagaaagtgttaagtgtatcatcttggacaagataattcacctccatgaatatcagttttctcataagtaaaacggatgtaattttttaaaaaaaatctgtcttgcaggatagttgtatagatacagtgagatctttagaggtcagcagactttttctgtaaaggaccaggtagtaaatattttaggctctgcaggctacatgaggtctctgctgcgtattttttctctctctctctgtcttacacacacacactttaaacatgtttaaaaataaaataaacattctgagcttatggaccatacagaagcaggcataggtcacagttttccacagctgatcaagaccacacgctgcaagcatgcagcaaccaggcatgtctttgtgttgttattcagcacccagcacccaccacagtatcagatgcttgggtatttactcaacaaaactctgaataaataatatgtaaagaggctgggcgcggtggctcatgcctgtaatcccagtactttgggaggccgagacaggtggatcacctaaggtcagaagttcaagaccagcctggccaacatggtgaaaccctgtctctactaaaaatacaaaaaaaaaaaaaaaatagctgggtgtggtggcgggcgcctgtaattcccagctactcaggaggctgaggcaggagaatctcttgaacccgggaggcagaggttccagtgagccgagatcgtgccactgcactccagcctgggtgacaagagtgaaattctgtctctaaataaataaataaataaataaaatgtaaagagcctgatccaaagtctaagatggaaaaggcactgtgtgtttatttagcattgttactgcccttgtggcttataagctccagaactatgatttaatatgaaagacaggatgagttcactcattaaagtatttggaggaaaaggagatgagtagaagtgttgcagaggaggaggcactggcctgagcttggaaggatgggtaagtttttggataaatggataaatgaagaaggtaccagtgtattaaaaggaaaataaggaggttatgcatctgccactgtaccacggtgtatatatgctatcaggacaaggttatggcttcacaaagaccacctccttatgtgatttcttggaatgtggaactcagtggctgctgaagtgagatacaggtaaattcccatagggagaactgacctctgatcattttgagtttcaatgagagtagaatatctctgagacaaatatagacctattaaccagtgaacattaaaagatactgaaggcctcccatgactcaccttgaaatagagaggaaatgcgcccagctatcttggtacaatgccaatatctcaacacttacagaagctgattctgcacacaaattgtgcttgagcctggaaacttcaggggacccagacacctgagcagtatagtcatattctgagttactgactttgcatatgaatgtaaattgaagacctttaattgagaacctggacctagatggctgggcaaagtggctcacacctgtaattccactactttggaaggccgtggaaggtggatcacttgagcttaggagttcgacactatcctggacaacatggtgaaactccgtctctacacaaaatgcaaaaactacccaggtgtggtggtacgtacctgtagttccatctacttggggggctgaggtgggaggattgtttgagcctgggaagtggaggttgcagtgagctgagattgtgccactgcattccagcctgggtgagagagcaagatcctgtctcaaaaaaataaaaaataagaaagagaaactggggctaggataatagcaattgtggttgagtatcgttacggataaacactttctccttcttccctctcccgctatatattccctccaacacacatgctcagaggagtttttgccaggccagcattaaggcttagggttgtgttaatctaatcactaaaggaaatgtgacttaattaatacctccaagcttgtgaatggcaacataccactgtgtaaacataatcacactattccttccatcttcattaacagatgagaaaatagtctcaaaaggtgaaccagcttgctcaaggtcacaagctaagcaggggagtaggtctttctgtcttttcactaaaccctgtggcttacctaaagaatgaattataaatgcctagcatcaggtcatctctcagaaatgggttttggagggcagaagactttctctgagcaagaatttgaaagacagacaggggaggcagaaagagtgaagataaacatcaaagttgttttccttgggtagagaaacaccagattccatcaatcaagttagcagggttctctggtcttctttgagtactggagcttggattatgatgacacccagctgactgtcaggccactgttgcagtcaaaatttacacaaagatcgggcccagggttgcaacgcaggctacacaaagctgctggtacgaggagtcaagaagaaacagacattggccaagaagacaaatcatgtgccgcttcctcattcggaataactggccatgtctagtaaatgcaacctctagattcatcatgccagatgggttatttcaagtacagatgctagtatttgttctatttcattcaactctttgagattgatcaataaaaagatgtatatggtgcctgtgtgtctggcattaaaagaggaaagaaatgacctcagtgaataagaacagtacttggatttcttagcgtgcctaggaaaccccgagtaaactgggcagattcaagcatgtgatgaatttctgctgtctgatttaatatttaatattttaatatttaatcctaaagttgtgcattccacttctttggttacagaatattaagaagtgaagctattaaaaacactaagtgttttagttcaggaagagagcacaaccttccctaagtgacaggtgatgctgggtgtcttcgtttatttgtttttgaaaacgtgggctttatttcttaaatatttattattaatgcaacaatcaggctacccaggatttatatagaaccttgtcttccaaggaatactctggttgaataacatcatctgtctttatgaacttcaccgtcaggaagaaggcgagactaacttttgatttcttacagatgggaaaacagagaccctgagagatcaaacaagttttcccaagttacagaataaatctattgaattccctcacacttaatgctgctcaaaccagcttgtgttgtctatgacaggaaaatctctgctacagactttcagagaaatgtcccttccacttttcatttgatgaccactcataaaccttgacttacaagaagatatacgtgaaacggagacacaaacattgcactgcaaatggctcaaatattcatttgtggaagaaacacttaagttcctactgtgtgcctagctctatctaagcactagagctgtgttttcacttcttattgctgctgtaacaaattacaacaaaggtcagaagtcctaaaatcaagttgtcagcagggctaccttccttctgcatgtcttgggcagaatccatatccctgccttttccaggttctaatatatatattataatatatattatatatatagtattatatatagtataatatatagtattatatatactatatatagtataatatatagtattatatatactatatatagtattatatatagtattatatatactatatatagtataatatatagtattatatatactatatatagtattatatatactatatatagtataatatatagtattatatatactatatatagtattatatatagtattatatatactatatatagtattatatatagtataatataatactatatataatatatagtacatattatataactattatataatatatattatatattttatatattataacatatcatacataatatataatgtaatacacatataatatataacaatacatcacacgtaatatataatgtaatacattatatatgtattacattatatatatacccccaaaaagtaaatttttaaaaaaatgtgcttccctcaaagcattgatcagaagattaaatgtataatgtaatacatcctatattatatatgatatatataatatatatgatataatatatatcatgtatatgattatatattttatatatatatatatagttgattgattaagttttgagacagggtcttgaaatattgcccaggctggaatacagcattgctgtcaagcctcactgcagcctcgacctcctcagctcaagccatcctcccacctcagcctcccttgtagctgggaccataggcatgcactactacatccacctaatttttctttcttggtagagacagagtatatctaagtttcccaggctggtctcgaactcctgggctcaagcaatcctcccagctgagccttccaaaacactgagatcacaggtcccagcctttccagcttttagaggccatctgcattctttgactcacggaaccttcctccatctttaaagtgcatcgctccgacctttgttttcatcctctcatctcctttttctgactttgactctcctgccttccttttatgaggacccttgtgattctatcaggcccatctggataatccaggataatctcctcatctcaaatccttaaccaaatcacatctacaaagtggcttttgccgtcaggtaacatagtcacaggttgagtggattgggatgtgaatatatctgggaggagagacattattcagcctggcacagactgtcaagaggttttctagcccttgcagcaatcttcatttcgtgggaaagaggtgcacaaacaattgatgacaaacaccatggtaagtgacaagcagtgatgggtaaaatgatgggcctccatcccaggctaatgggggtgaggaagacttccagacagaatgatgtctaaagctagtcttcaaggatgaatgaggaatgctcatgcaagagagcaaggtagcatgttggaagttgggtcgtccaggaaatgaggacacagcaggcaaacagcacaccagaggccgaggagagtccagttgtacagttcatctgcctatagtgtttgcttcgcattggtcagctttgttttagagctaccttgggtggcagacagacaaaaaactaggctgtatagcaaaaaaattaagagtaagagcaggccagtcgcagtggctcatgcctgtaatcccaacactttgggaggccgagtcaggcagatcacgaagtcaggagttcaagaccagcctgaccaaaatggtgaaaccccgtctctactaaaaatacaaaaattagccaggcctggtggcaggtgtctgtaatcccagctactcaggaggctgaggcaggagaatcccttaaacccaggaggcagaggttgcagtgagccgagatcacaccattgctctccagcctgggtgacagagcaagactccatctcaaaaaaaaaaacaaaacaacaataaaaacagtaagagcaggaggctgggcatggtggctcatgcctgtaatcccaccactttaaaaggctaaggcaggtggatcacttgagttcaagagctctagaccagtctgggcaacatagtgagaactcatccctactaaaaaaaacataaataaataaaaaattaaaagttgcccaggcatgattgtgccattgccctcccacctgggtgacagagcgtgaccctgtctcaaaaggaaaaaaaagagtaagagaaggtaatgtgcccttcattcaagccctgatccttcttaaaagtttgtttaacttctctgctcctcagttttctcatctgtcaaatgggagtaataagagtactaatcttaattgttccaaacataaaataattaatataaagtccttagcacaatttctggcacatagtgggtgttcaataaacgttagatttttctcttttagttccctccctttcagcctctttggcaccaggacactgtcacacagtatcttagtctgttcaggctgctataataaaataccacagactgggtaatttataaacaatagaaatgtatcactcacagttctggaggctgagaagtccaatatcaaggtgccagcagatctgttgtctggtgagatctcactttctgcttcaaagatgacaccttctagttgtgtcctcacatgaaagaaggggagaaaaagctccctctggcctctttcacaaggtcactaatcccatttatggaggctctgttctcataacctaatcatcccccaaagactctacctcttaatactattgcactggagatgaggtttcaacatatgaatctagggagatgcaaacattctgacaacagcacacagttcgtgttttcacccatgccgggaaactcctacaggaagagcaggtgactttccctcgagagcctagttcccagggagccatcaacacatgtcccatcacagagatgacaaggacttttataggatgtgatgtgctacgttaaatacggttcagaccaaacaagaccatgccgggcacacccataccgtcaggtcctctcgattttccgtggttggaatttcacttttctctgtcttaaaacagccagatgggcggttattcttggggataaacaaatagctgtgatttctgtttatgggaggagccctaactttctgggtttttccccacaacactgacagtgtcaggcagattaaaagatgtggggcctggcgcggtggctcacccctgtaatcccagcattttgggaggccgaggcgggcggatcacgaggtcaggagatggagaccatcctcgctaacgcggtgaaaccccgtctctactaaaaatacaaaaaattagccgggcgtagtggcaggcgcctgtaattcccgctactcgggaggctgaggcgggagaatggcgtgaacctgggaggcggagcttgcagtgagccgaggttgcaccactgcactccggcctgggcgacagagcaagactgtctccaaaaaacaaaaaaacaaacaaaaaaaaaagatgtggagctcgagccagatcagctgctaggaaccacacccctttagtcaagtgctataatctcagtttactcaccaacaaaatgaaaactttgaatgagaagatttgtaagagcccctcctagatctaaaattatcttcttctatggcaagtttagagcataaatagaccccaactacaagaagtcaacctgaactgatgggaaaaacaaaattctggggtcagacaaatatgtgctgaaatccttgtgagattcacccacagagctacttaacttccctgagtcttggcctctataaaatgaggataaaagttcttgcctcaaatggatactccatttaccctgacatgattattacatatactttgtatgcctgtattaaaatatcccatatatcccataaacatatacacgtactgatatggtttggctgtgaccccacccaaatctcatctcgaatcgtagctcccacaattcccgtatgtcatgggaggaacctggtgagaggtaattgaattatggggtgtggtggggattatcccatactgctcccgtggcagtgaataagtctcacaagatctgacggttttataagggatttcccttttcacttggccctcattctcttttcctgcctccacgtaaagccctttgttcttcctttgtcttccgccacgattgtggggcctcctcagccatgtggagctgagtctattaaacctttttcctttataaattaccctgtttctggtatgtctttatcagcaacgtgaaaacgaactaatacacctaagatatacccacaaaaagtaaattttttaaaaaatgtgcttccctcaaagtgttgatcagaagattaaatgagatgtcataggtaatggaaagtcaggcacaaaatcagcattgaatgattattgaatacaaaagtggaaaggggctatgtctcaccaaagttctgtcttcacattccagcggccagcccctgttctgagaggttttctctttaaaatgttaattttttttcaaaacaataaaaacatcagtcctcttccccacccctctctaccattaattactgctcttaaggggaaataacttttaattttcaggcctttttcatggtagtttccctccatatacctaaataacatggttatgcagctatttctcaattgatcaattttaacttcttgttaatggtattgaaagacttagtgcctcctcctgctcctgcctctccccatgcactcacatcctagtttagtgatatcccgttgtttttgttaaatcagtaatcagtatatatgttactacagctattatcacatcctgctaatttagtgatatcccattgcttttgttaaattaataatcagtatatgtgttactatggctattaatccaagtagaatacaatgattaagtttcttcttcatatagatttagtttttcctgatgttaatgctttttttttctgccctttgacttattttttatgtacccaacatgaattcttcccagaaatctccaacagaacactaaacaaattttaatggaataaaactccccggcgcggtggctcacgcctgtaatcccagcactttgggaggccgaggcgggcggatcacgaggtcaggaaatcgagatcatcctggctaacacgatgaaacccgtctctactatcagtacaaaaaattagccaggtgtggtggcgggcgcctgtagtcccagctactcgggaggctgaggcaggagaatggcgtgaacctgggaggcgaagcttgcagtgacgcgagattgcgccactgcagtccagcttgggtgacagagcaagactccatatctaaataaataaataaataaataaataaataaataaataaatataataaaactcatcagtaagctatcagtccttttataagaagtacctcttcgagacaccttcccccgtgtgaatgtgttccactctagacctgctacctcacctacctccttccacgcttcatcccttcccatcctgctgggtttacattgaacttctctcctccactgaatcctatttctctgatttcctatcttatttctcttgattttcttttttctcttgagatgaagtcttgctatggcccctaggctggagtgcagtggtgcgatcatagctcactgcagcctcgacctcctgggctcaagcaattctcccacctcagccttccgaatagttgagactacaggtgcatacccccatgccctgccttgactttctttctttaatttttggagaggaatagcctcccaaagccttttcaggtacaattttgagtccttgcatgtctgaaaattttcattatatcctcgtacttgattaatcatttgattggatatagaattctaggttataagtttgagagcatggacctattaccttccagcttctagtatttctattaagacattcaatatcaattcttatgcttaatccttttaatgtgacctgttattattcccttgaagcttttaggattttctctgcatccccagaattctgtgacttaagaatgatgcaccttattacaagtttttaaatttattttactggatactcagtgattccctgtagtctagattttcatgtctttcacttccggtagttttgctccatatgtctgaataacatggttatattggttgtttcttaatttatcaattttaacttcttgtaaatggttttggaagatttagtaccacccccctcctgtctccctcacacactccccaacacttttacggtatttattctttgatagtcttctccctgcaattttgtgtctcctctctttgcaatttctgggagtcccacatacaacttctgaattgttcttctactttttttatatctgctctatgtttttaatctttgaatcatgtttttgccttcttgcaaatttcctttttcaactatgcttttaagtgacttacctttctgatttttaatttccaagagttgtttcttattctcttacagttcattttttaagtagcatccttctcttgtggcatggatggaatatcttctttaatctctgtgaggctcttaattatcatttatttgaagttttcttctgctgcctgtattgtctgcttttcacaagttgcattagttatattgtttgtatgttttagtttgttcctcaccccatgttgaaggctttccttaagtacctgattactctttattttgtattaatagttgagtgagataaatctctctctctgtctctctctctctctcacacacacacacacacacacacacctcacactaatcagaggctctatggataggattcaccaattcaagaattttatggaccaagccattctgttaagattatcccaaatgtcagtatccatatttacttttttcttggtcctttctgttactttcagaaaaattcttctaagccagatacagtggctcaagcctgtaatcttaacacttttggaagctgaggcaggagttcaagatcactttgggcaacatagccagaccccatttctacaacaatcttaaaaaatatttgaacccaggagttcaagatcagtttggtcaacacagtaagtccccatttctacaagatgtttaaatgctggcttccagcattccagaagctcagagaaaatgggctgggtagccacaccattcagtgtactgattttcattcactcttcccattgtcgaacctcacatgcctattacccactgtctgatatttgtgaataaagaccctgccctggttcaatttttccaaatcttcacctccacttccctgcctgggttcacagggtgggattgggtgtctgggagtctatctatcaactagctctcttgtcacgagcacctcctttgctcatgctatctgaggtacctgaagcctccaactgctgaaagtttctgaggttctgtgacccaattccccttgattttggtttataatctcccctcagtggggccttagatttcagttttcttcactcggttactttggttaccattcatcaatccacatactactgctcaaaacgcagttgacatctcttgtccaatattgtcttgtctcttattctagattccccctctcatcctagtttctcattctattcatactggtttatctcttctgtgccatttaaatgggagtctctggggaggaatggagataaatgggtgtgttccatctgtaatgtttaactgtaatgtttaatgttctactgagggtttctttcagtgaaagattttgcatgtgggaaacacaaggaaaaatacagagaatgtgcttccctgataaagtctctccctgggctgctcattcacaatggcctcattttctagagtaacagaaattatctagggccactctgtctccctaaagaactggatgacattatcttgaattccaacctcacctctagttcacctgattctcatcattctcaaaatttatacttttcctaggaatcttttttctctgctcagatggactgttttctttatatctgtcccagcatcatctcaaatctgagacacaagactttttttttttttgtcatttcagtattccatctcccaatcccccaaacacaaaggaaacacccttctgaaaataatctgcctgtagaagactgaagactggaaagtaatagtttcttctccagactgaatgctgataccagatggtgagattttaatttttctaatcctgctaccatgtctgtgtatacgtttatttctaaaatgaacacaaaaatccaaatagcatgggccttctatgtactctgatagaagaaatgagaaaatgatggtcttcaatcaaagaagacctgctattataagccaagaatccttataaaaagaaacatttaataggatatcctatatctgcttttgatttccatatcccaagaaaggaagaagatatttagaacaaggtcaagaggtgacaaagaacatctgcctgcgttgcttcatttaatcttctcaataagtttgtgagatattatttctttctattttccagatgaggcaatagaggctatgtgacttccctgaaacacacagctagaaagtgacatcaccagtaattgtaatggtaaccgtttctgccccaccgtgcttgcaatacacagtgatagattacatagatatatagattagctatagatatatagattagatagatacatagatgagattagacacatcgattagctagattacatagatacatagattagatagatagattagatagactgcatagataggatagattacatagactggattatagttgtgtgtatccatatacatatacacatgtatgtgtgtgtgtgtgcgtgtgtgtgtgtgtgtgttttcactctcatgattacaaatagatgatattcttctttctcatttttggaaactaagactcagagaagttaagtaacatgctcaaagtaacagtcacaaagtgcccatctctccccctctcttttcttccacctcctcacactgtctttaactagtgtccagagatagtgcccagtaatccctccccatcctgcgtgcacttggcactcctgacataaagaggagaggtatattttcccaacccttgaatcttggttggctttgtgactaactttgacaaagagaatgtgacacaagtgagattctgagcttccaaactcaagccgtaagataactggccactcctattccctgcgtcatggaattcagacaccatattgtaagaaactcaagctgcatggagaaaccacgtggaagagaatggagatgctctggtcagtagccttaggtaaactcctggctgaaagccagcaccaactaccggcttcatgagggagccatcttggttgttccagccctatcaagccctcagattatttcagtctcagtcaacagcatgtggagcagaggaatcacccaagtgagctcagtcaacctacagaaacacaagatagaatacaagtcattgttttaagctactaagtgttgacgtgttttttgtgaagcaagagacaccaaaacactgcctatctttgaaagcatgattgcaaaacctgatgtctttctattagagcaatttcactgacacagtctcttccactaagaataaaaatggcacgaatcattgagcacctagaaatgacaacatttgaaaacaagacactcaaggataacttagagatggcaaattaaaagctcatatagctttggtaagagtgtagagaaacaggaactgttactcatttactgtttgtggtagtataaaataatgaagtgttcctggagggtattttggcaatgtcttataaatactcagaccccttgacccagatttgtcacttgcaagacatttatccttgggaaccataaagacatatgcaactattttttcctgtaaaagtgtttactataatgtttggtataatactctttataacagtgcagagaaagaaagagaaacacctaaatatgcaacaataagggatttaagtaaataaaaatattttcacataacggagagttactacattgccactgagaataaggcaatgaaagtttttaatggcacaaatgtgcattcaatattcagaagaatatatgagacaatgtaagccgtttccattggtttttgtaagcaacaaccacaaaaattataactaacaccaagataggactatctgccaagcactcttgaaggacataacatcaaataaatagtgattgtctttcagtggtctcattacttctgctttatgccttttaatgttcactaggtattttttcaataaacatatgagaagaatataaaaacaacccactattatgagctgagatataatttttgaaataggttagtaactttgagatttctgggatgatttaaaaaaacagttctgccattctgaaattgtcatatgtacaagcatacattctcatggggcatttttgggacagtagcttcggccaaattccagagcttgaaagagcccctgatctcatgcatatttttagtgcatacttttaggccaattctgagccatctcctgggactttctgtaccaggccagttcccagttttgtttctgccatatgcattaggcaagagattccaaggcattctttgcaggggttggatgaggtacacattcagtttcattgcatcccagaagttttaaactccctggggattcagaacatattgctaccttacactgtataagcctgggaaacaggggtccacctgcattctcaaatgaccctcctgcaattagaaatgagatttctagtaggacttctatttcagtgttaacaccagacaatagcctttggctctctctaacaagatcggcaagccaggctctgcaaattggctaaatttatattgcacactagaccctctgaataagtaagaaggaaattctttcgttggctggaaaagaatctatacagattctatcttaatcatggtctctaaataggccacacaagtccggtgggcaggagccacatcagaggatggggacgggatctcggagtttagagtgtctgtaatgaaacgctacacctgctacctctcaaagtggaattgattggataaaaacttagtacacaagtgtcatcctgtgcttgcttcccagacgttcaaaatctaaagtttaaggtgctattttcctagagcctggaagatgctctgaattcttagtgagataaacagtgacctggcatactggaggtactctatgtgggaaaataagcaaactgggtgggacattaactctggtacactctgtcatctaatattcatttgatgtaacacaaacctactttccatactggccagagtgcaagaggaatttatttacccaccgagggaaaaactgagggcctggtttagctgcaggcatggcttgatcaggggttaaaatgatgttaacaagatttaattcctctcttcctttgtctttaaattgtgacttgacttacctcatattggattatgttggaaccttttttttcctttttgtcttttctttttctttttttttaatacaatttattccatcatggtcaaaagacagacgcagtgttttcagaacttacatcctcctggtttcaaatttcttgtgagtagagggagaatctcttttcctgaaggtgaagcacacaatatattgtgcctccttgtctctgtttgggccacatacccaatccctgaactaatcagtgaggcaaatgcatagatctaagtataaactcgcttagccctggttcacacctcttccctcatagttagagaagttgggagaaggacatcatctccacccaaaatcatggattgaatccagggagaactgattgacccaaagctcattcaaggtgtacgtacaagcaggagcatgtttggacctggtggcaaagagttcaaatttaacacagatattaaagaaaaatgttaaatgtgccctttaaggaaaccacttaaaattcctcctgcacagagcatcataagctgtcttctcttgctgtcttctctttctgcaagcatgatctacaggatgaaggtacatgcaccttccacttcatcttgcagcccctgctcttcatggaaatatctatctatgcctcctacctacattctttgtccctacatctactcttaaacatgccctgatgaagataggaaaattcctctttattatagtaatagctattacttattgctcccttaggatatacctggtatgatgcaaaatcctttacacacacacacaaaaaatcatttaatcttcacagaaactctaggaggccaaatctactgtgtatacagtgagaaaaatgaaagtcaggaggaggatgaagctcaggcaagaacacggagctactaagtggaagaaaagggttccattatacgattcctgcaccagtgttcacaactctacaatgattccattcagttccgttcttcactctgttgaaccgattccacacggaagggcttctccttgctcactgatatggtttagctgtgtccctacccaaatctcatcttgaattgtagcccccataatccccatgtgtcatggaagggacccagtggaaggtaatggaatcatgggggcaggcttttccagtgctgttctcgtgatagtgaataagtctcatgagatatgatggttgtataaagggcagttctgctgcacatgatttcttgcgtgcctccatgtaagacgtgcttttgctcctccttcaccttttgccatgattgtgaggccttcccagccacatagaactgtgagtccattaaaccttttttctttataaattacccaatcttgggtatgtccttataacagcggaagaacagacaaacacattcacttttccttagatctgaggcttccctctctaaccttcattgctatactcctccctcacaactgtaagtatgctttaagctccagagcactggctgggagtccaatgccttctttcacaccattcctcctccctgtgataggaagcttgtcttctagatatgactatgttttctacttgaaaactgccacgtgcttggccccagggaccctacccactgcttgtgttcttcatctctctgcccactgactggggaatcctacgctggcagtattgtacattccttcttatcttccctgccaataagaagctgcctcccacaagataggtgaaccaaaaatttgcagaaaataaatgtaaatgccccatggcactatgcatagaggctcaacatcactgagaataaaagggataccaattaaaatgacaccatgataaccatttactacctattagatcggcaaatattcacaagctgaacaatgtattccgttggtgaagctgtggggaaacacactcatccatcctggtgtgaatgcaaaaatggtaccatccttatgaagagaaaattggcaatgcttaccaaaaaaatctatgtatgtattgatccttcgactcaggatttccacattaagaactctattccaaggagaagttgtcaaaaacatgaacacacaaatgcacaagcctggtcattgtagtactatttgtaatatttgcaaaggatgggagaatacctaaatttccatcaatggaccttatttattttattagacagtgtcttgctctgtagcccaggttggagtgcagtggtgtgatcttgtctcaccgtacctcttaggttcaagtgattcttgtacctcagcctctcgggtagctggaattactgccaccacacctggctaatttttgtagttttttttttttttttcttgaagagatggggtttcaccgtgttggccctgctggtctcaaactcctagcttcaagtgatctgcccacctcagcctcccaaagtgctgggtacaggcataagccaccacattagactagtataataaactatggtacatccacacaatggagtactgtccaaatataaaaaaagaaatgaggaatacaatcaatccttgttattggtggattctacagttgcaaattcacatactagctaaaatttatttgcaactccaaattcaatactgaaggcactttcacagtcaattgtggacaggcatgtgaacagaatggcaaaaatttgagctgcttatgtgcacatttcctggtgaggccacacaaggtgacactctgtcttcttacttaatctctcgtattatacatgtaaatatcctttacacagtctatgaactgccaaattgtttgcattttgtgctttttgatagtgatttaattgtctcaaatggcccccaagtgaagtactgaagtgctgtccaatgtttgtaagcacgagaaggctgtgaaggggctgagtgcagtggctcacgcctgtaatcccagcactttgggaggccgaggcgggtgggtcacctgagtttgggcgttcgagaccagcctgactaacatggagaaaccccatctctactaaaaatacaaaattagccaggcatggtggtgcgtgcctgtaatcccagctactcgggaggctgaggcaggagaattgcttgaatccgggaggcacaggttgcggtgagctgagatcatgccactgtgctccagcctgggaaaaaactgggagactccatctcaaaaaaaaaaaaaaaaaaaaaagttgtgtgtgaagtaccttatggagaaaaaatatgttatataagctttgttcaggcatgagttatagtcccttagttcactcttaatgaattaacattatatattaaatcaggtgtctttagacagaaacacacataaaacaaggttatatgttgattggtgggtgaaaatgttgtcacacaaggctcacaggaacctaactatgtattttccctaggaccaataattcaggatttactaatctagtattcatggatactttacagaacaaaactactatgaataacgagaattacctgtacctctatatatcattaagatgtgatcaccaggatatattaagtaaaaataaggtgcaaaatagtggatatagcatgctactttttccctaaaaaatgaagcagatatgaagagatattcagttttgtgcatatgtgtatataaacaataatagaatgcacaaaaactaaaaaagaagttacctaatacaaatggtatgaaatacgtgaaggggaggtggatataaattacatttctctgaatataatctgttccaaagattttactttttaagcatgtaaatattctacaaaattataaaatcaaattatatgaaacaatctaaaacaattccttcaaacgtaaagccaaacgaagtaaaataactaaactatgtcaagttcgcggcttaacagtgagaaattatgttacactactttaaaatacactaatttgcctgtatctccctgtgggatacagcttaaggttaaaaataactaaagaaattgcaagttattttcagttaacatattgttagttgtgatattgctgctgttactctggaactgttgtacgaatgtggtaggataaagaagtgagtaattacattgatgctacttgggccaaggattttgtcataaggaagcaagacccaagtatagaatcagaaaacttcagtgtaaaccttttgacctaaaatgtgagttgaaggtatcagcatgaatacctgatgcattctctcttttaaaaaaaaaaagaaaaaagttcatttcctaccttagtcaattttaaagacctattaggtgggtgcaaaagtaactgcagtttttgctattactttatttatttatttattttcgagatggagttttgctcttgccacccaggctgtagtacactggcacgatctcggctcactccaaactttgcctcctggattccagcgattctcctgccttgttggccttctgagtaggtgggattacaggcacgtgccaccatgcctggctaatttgtgtatttttagtagagacagggtttcaccatgttggccaggctggtctcgaactcctgacctcagatgatccgcccgcctcagcctcccaaagtgctgagattacaggtgtgagccaccgggcccatccaccgttacttttaacagaaacaatgacatagcccagactgcagtttctaaatactattcgccacttaaagaaactagggatccttggatacaagtagtcaattcctggtctggggcaggaaatacaaaaggtgtgcccagaacatcttattctaccagaaggcaggaggattatcaaagatcactggggtcacatcaaaagaattcaagagaggttcccaagaagatatttctactagcccaaggttgcttaatgttcgtttcaaaaagaatatatgcaataaatgtaaacaactaaatatgttaaaaattaatgagttcaaactaacactttacaaaaaaaagaaacctcaatggtcatctgtggaggtgttaggataccaacttatttttcagaaaactgatgataaagggaaaacataaaaagcttaacgtgcggggtgcagtgttcacgcctgtaatcctagcactttgggaggctgaggcaggcagatcacctgatgacaggagtccaagaccagtctggtcaacatggcgaaaccctgtctctactaaaccctgtctctactaaaaatacaaagaaaaggccagatgcagtggctcacgcctataatcccagcactttgggaggccaaggtgggtggatcatgaggtcaggagattgagaccatcctggctaacacggtgaaaccctgtctctactaaaaatacaaaaaatagccgggcgtggtggcgggtacctgtaatcccagctgctgggaggctgaagcaggagaatggcatgaacctgggaggcggagcttgcagtgagctgagatggtgccactgcactccagcctgggtgacagagtgagactccgtctcaaaaaaaaaaaaaaaaaagtttaacctgattttcctatattaactctactttgaggtaatcaaagagttgatagtgcagagttcttcttttagaaaaatctcagctactaatcaaatgatagagttatactatcacaactttgtacccataaaaaaatggctccaggaaatggtcatcaatagtagctaaaataattaggcgaaaagctaaagaagaactttagaatgggtgaatcaggctgttaccacttatacccatgggtaagtcttaaaaaagagttaaccagatttaacctgttaaccagacaggttcttgctgtgtttcccaggctgatctcaaacttctggcctcaagtgatccctccaccttggcctcccaaagtgctgggattacaggcgtgagtgactgcacccagcccagaactctttaaaatcaaaattgtacagtcagcgttctcagatgtaaacaatagtgtaataaccacattttctggtttctgtatttaacgcttggacatcttagggccttgctgacctcagaaggataggccctttcagggcgagccaatgcttagaaatagtaaatgactcacctgcgagcatgcttttcatatgcaaaccaaccaaccaaccaacccgagctcatatccccagctgtctccttaacgggactctcactctctctgggccactgtccatctgcccatattaccccagggctggtaccatacaactagagacagcccctacaccccagggtttgctgaaattatgccaactagccaatcctaaagcagcttatcctgtctaactcatttcttccagcagaaaccacagtcaagtctcttgcccatgtccttccttctctccctctacatcctacccacccctggggctcccccttaaagtcctgtgtggcatggagtgcctcctgtttctagagaactgtcagtaaaaacttccacgtctgtgtttccttccatacctgattaagacaaatctcacacactcttaaagcaaatagaaatcaactctggcctacttaggtagcaaaagatcatgagaagctcatgcatattaacagcaaagcaggcaatcattactggggctcagaaaaacattaccccaacatgaaggcctcagaagcagcctgtgttttctctgacattctcctgccctcctgtctgtctgtctcattctcccccaaggctagccatagaaaccagaatccctcttccccaaggatgggtcaaagaaactagaatcccttttccccaaagccaaccttaaaacctaaaaatattctatgtaaaaactggccatgctgggtgcactggctcacgcctgtaatcccagcacttgggaggtcaagacgggtggaacacatgaggtcaggagttggagaccagcctggccaacatggtgaaatcccatctgtactaaaaatacaaaaagaaaaaaaaaaaaaaaaccaggcatggtggcgtgcacctgtaatcccaactactcaggaggctgaggcaggagaattgcttgaacccgggagacagagggtgcagtgagccgagattgcaccaaaaaaaaaaactggtcataaacaaattacctcacctaccttgtttgattgtgggtcacaggatcccccaccccgccccacttccagagaggaccctgccccgcatgcagaggaaggaatacatgctcagagagactatgaagaatctagacagacaggccttgctgggtttccccactccatctgtcagcatttgatcagaccctttttgtcccatcctatttctacatggctgtccatacattgttggacataagcatgaaaatagacaatttcccttgactctttgggtcttcattcttagggctcctatatacacacattaagtatatttgtatgccttttctcctatttatcaatctgcttcatagcaatgatttttcagtgaacctagacttagaaaataagcaaaacccagagaggtctagccgtgcaatgcccggccaaggccactttgcaggatattctgtcaagggtgcgatcactgacaaagccactttgggacgctcagagcctgctgggctctcaacaccaccagtgccaccagatgcttgatgctttcatgactaaatcctcaagatgcaaagtcctaggcatgagcttccgattgaccaagcctacattatgtaactaccctccaggtgccaggaggtagcaaaaaaggaatatttgctctctttggcttctgtcaatcaagaaagtacttcctactagatacacaaaggatgcatctcctatatgtaaaaagaatgtttacaccctaagtaacaaaaaaaaaaagtcagaagaccacaagggaagccacagagaaatgcaaagaaggtaagttttaccttgtcacttgcagagcatgtgctaacatcaccaaatatcacagcctaataaatcatgaaattttttaagccaggagagattggtgttaattgattcacgggccatgaaggactagttcggggctgcacatctattcatcatgaggcttccggtgacttttcagagaagccctttaacttctgtggcatctaattcaattaaaggattgagagtttcactgagtagaaactgcagatgaaaacccaatattctttcatttgactcaaaattatattatccatactaagaacatgagagaggtcaaggagcatgagtcatgataaagagcagctcatcgaaatgactctgcaggaacctctgcaggccaacgccattcagaagagccttgactcagaattgtgactttaagagagacagagagagagaaaaaacaacagagtcaaggccaggtgtgtggttcatgcctgtaatctcagcactttaggaggctgaggcaggagaactgcttgaggccaggaatttttttttttttttttgagacagagtctcactctttcacccaggctagagtgcagtggtgcaatcttggctcactgcaacctccgcctcccaggttcaagcaattctcctgcctcagcctcccaagtagctgggattacaggcatgcaccaccacacgtggctaattttttttgtatttagtagagatgaggtttcaccaggctggtcaggctggtcttgaactcctgacctcaggtgatccacccgccttggcctcccaagtgctgggattacaggtgtgagccaccacacccggccaaggccaggaatttgagaccagcctgggcaacagagcaagaccctgcctctacaaaaattttcaaaatagccgagtgttgtggcatgcacctgtactcctagctactcagaaggctgaagcaggaggattacttgagctccagagttccaggctgcagtgagctatgatggcaccactgcactccagccagggctacagagcaagaccctgtctcaaaaaaaaaaaaaaaaagaaaagaaaaaaagaaagaaaagaaaacaattcagttttaaagacaaactaaagctatttttgatgagtaaaataaaattgctcatatttaatagtatctctctttctacaccatgccttcccctaaaagttaccattaaattaatcagtaagagaatgatagtaaatgtcaagtcaatatcggtgtacagatatgggcttgggggtggaaccatccagactagatggcctttcttctcctttgccttttctgaccttgcacttgcctgaacttcctcatctctgcagagcccacagttccaggtctaagctgtgtctgggctgagtggtgcataggatccaggggatgtgaagcctctgattttcccccaatgagctgtgcaaggaagccatctttgctgtgaagtgagagagacccctgagaagaaagggcaggaagacagacccgtggctgtggattcacttcttggactcagccctataaccagtgaccagattcccctacaacgctcaaggaatttgtccttccttcctgttgatcctattatagctttgactgcacacaagcccagagaaacaggggctggggatcagcaggaggaagctgctgctccctcggctctgtccactgtaacgtactcaaggccaggagccacctatcacccaaaacactcagtgtctccccaaatcacgtttctgaaatcggtaaacctttctttatcaaagttatgaatcctgccttgccttattgttagattcaatttttgagtcacttgttatgttctgggaactatatatacattatctcatttaatcatcacaaatactctgtgggtgttgatatttaccctccctcctcccattttgcagatgacataattgagcctcagaaacgaagacaggatttgactccaagctctgtctgtgcatcttgttttaatttattgttttaatcagcactgaactaatcagattctcctctaaatatgcctttttttataacagctttactaaactttaattcacatattaaacaattgtggattttttttgttttgtttgagacagagttttgcccctcttccccagcctggagtgcaacggcacgatcttggctcactgcaacctctgactcctgggttcaagcaattctccagcctcagcctcccactcgtaactgggactacaggcacctgccactatgcccaactaagttttgtatttttagtagagatggagtttcaccatgttggctagactggtctcgaactcctgatctcaggtaatccacccgccttggcctctcaaagtgctgggattacaggcatgagccacagcgcctggctctcactcttttaaagtatgcaattcaatggtttttactatagtcacagaattatgtcatcatccccaatatctaattccagaatgttgtcatcacccctcgaagaaaccctgtgtccattagcagttacttcccattcccctaaccccacttctggcaagcactaatctgttttttgtctctacagagttcatattctgagtatttcacatgattccatttatatgaaatatctgtgtctggctgcttctttttttgtgtctggcttcttttacttagcataatgctttcaaggtccatataagctgtagcatgaatcagtacttaaatcctttttagggctaagtaatattccagtgtatggatacaccacattttgtttatttattcatcaatggataaacactcgagttgcttccacttttttttgctaacatgggtaatgtgccgtgaacattcatgtacaagtttttacatggacatatgttttcaatttttgtgggtatatatctatgagtggaatttctgggttatatggcaactctatatttaacttttaaggaactgccaaagtggtttttacaatatctgcatcattttatgttctcaccagcaacgtatgagggttctaagtttcccacatcctttcccacattatcattttccaacactgtcttgtttattatagccatcctggcaggtatgaagtggtatcttattgtgattttgaattgcatttccccaatgacttaagatattgagcatcttttcatgtgcttactggccatttgtgtatcttctttggagaaatgtctattcaaattattttcccattttcaactgggttatttgtcttttactgttgagttataggagtttttaattccagacacaaatcccttatcaggtatattacttgcaaatatatttttccatcttgtgagctgtcttttaactttcttgatagtttaactttgaaacgtatacatttttaattttaattaagtcaaattcatctggatttttgttgttgttcatacttttgctgtcatatctaaaaaactattgccttatccaaggccctgaagatttattcccatattttcttctaagagttttgtaatttaactcttaggtttaggtctataatttattttgagttagtttttgcacatattgttagggaggaatctaacttctttcttttgcatatggatatccagttgtcccagcaccatttgctgaaaagacttctttttttttctttgagttatcttggtacccttgtagaaaatgtaagggttaatttctagactctcagttttcttccatggatctatatatctatccttatgccaataccacactgccttgattactgtagctttgtagtaaattttaaaaggaggaagcatgaatcttccaagtcttttttcctcaagaattttttggctattctgggtcccttgcactttcctatcaattttaggaggagtttgtcaaattctgctgggattttaggattgctcagaacatgtagatcagttaggaaatattgtcatcttaagtctcccagtcattgaacatgagatatatttctatttatttaggtctcttttatttcaatgatgtttgtagttttcactgtatacgttttgtacttcccttattaaatttaaccctgagttttttttattatttttgatgcttttgtaaatggaattgttttcttcctttccttttggattgttcattgctagtatatggaaacacaatcggtttttgtatattgttcttatatcctgcaaccttgctgaactcactgattagttctaatagattttcatacgtgaattcttcaggattccctgtctacatacatgagacattcctgggtggagaccaaaattcctggatggtctcttcagatccaaacatcccattatttgtaagcatagccctctcttaccctgttcaaatggacttttttgcttttgttgatgttttattcatttttaccacccagtattcatttcctctcttctggaaatagtattttatttttttccaggaatacacgctctccttctcactctgtccatagtcttcagagaatatagctccaggaatgggcatgtgatataagcctagccatcatgtctatctggctactattagttcaggtctgggcacatggtacaattaggaccaatgggttgcaatctcaggactttgaaaagcataccacaagatcatatagttgtcttttctggcagacttattagagccaacacagagaaaaacagagaagagagatggagagagattgggtctgattcttcacttcagcccagaatcacattacactgggaactcagtctagcccttgactagttcagtgtgtgaaccaataaactctctttatgcattaggcagttatctatcacccacattgatgttatttcagaccatgtgcgaggcattgctactcataagagaccagtattttccctttgcaactcctaaaggctttatgcttaagtgaattgtctagtgattaaaggatagcaaatactttaaaaaaattatgttctctgtttccattctatgaaggaagcccaagtcaagaaaactgattttcattaagggtgtacatatttgaattatttagctctacatttggtaatgcacttggcttgaatttcaagtacagtccctctgatggctaatttaacataaaacacagtccaggcttccttttttttccagcagtttttgctaatggtgactttgccatcagagggtctaggaccatgcagactcagctctatagtattttttaaatgaatccccttagatggaaagagccagcttatatttaccgagataaacttttagagttttgcattatatccaacagtgttaagcaagaaaaaaaaaaaaaccttccaataatcagttccacgagagaggctgttgacttttattcgtttctatagctcatgaacccaaccttgaattccagagagagaaagctaccctcagcttgtgatttaacaagttctgcagttcacgaggaactgaagaggtttttagctctggataccatccctctggctccattcttttagctgatagaaaacaggatattactctagggaaggaggttcttttatctcccagctgtagctttctttagagaaaggggattgtggaagtcaaaacatcgtccttccctgaatagacgagattgatttattagttggcatctttataatcctttcctaagtaaaggcaagaaacagtgcttaccagcgtggatttaaagctcctcatatatggaccaaaaatttgccactcccactcactagaatgtgtccatggaaaaggtcctgaaccagtctgagccttagactccttttctgtaaaatgcagttgataataaagcctacctcatgggaccgatttgagaactgcatgtgataatgatgtaaaatgcacttagctcatgatgtctaataagtgttccttaaatatgttatttttgtgactgtttaatcctcaataagaagagtaaatatcagatatccctgcctccctctaagaaggcacattcccagttcattttcaagactcaagtggccaagacaagcaaactttctagatgtgactgaggctgaacaaagctggcattatctactcctggtctttccagatctgtctgtttttatcccaccaggtccactcgaagcctctcttctgaaatttgaccagaaatgacaaagaatcatgagttggttccactgagcatccacccagaatgatgcctcccaagctaatggcatttttcaaccatcacaatggagtgaatgatgtggatattagcacccctacttacagtcattgatgaatctgctcttggcagtcagagcaccgaagtgtgactgcaacaatggtgagggggagagttagaagggaagataaatgagctcattgtgcctatgtattttggaggccaaggctactatcaggtgttccaagaaatgggatacaaaagaaatgagttttgtcacctaaaaagagaaaaggattcaaccaaggcaaattctgaaaagaaagaacagccagtgtcacccaatttctacctcttccaatcatggcatttatctattttatgtctctagccaaggaaaaatgcaatgcctcctttacaggtttgttctgctggagatagtgattattaaagcaatttgttagaggcagattttgcgtacatattaaagcaagataatcgtattggagacgcttgcctgaagcagggattcagctggaatggccattgcacacaagtctgtttttcagaactgggtaatgatgagcacatttagtgactaagatgcatggcctgatttaatgggatttcccccaaaatatatatggtaatggaagtaagcctgcttaaatagtgggtacatttggaatcctgctttaagagaatacaacttaccaattagatcacagcctattgtaggggagaaaaattaaatctgcccctgaagtttatgtattcattcaacaaatatttatctaacacctactctgcacaaggggctggaaattaacatgtgaagaataagaaagacatagtgtctggttttgtaaggtttccgtgctggtgaaggagatcaaacatagcattatacagttagatactcaattacaatcatgacaaacgcttcaaaggataactacagggcactttgcatgtgagtgtcaggggaactcactctaatccagacaatcagaggttttcttgaggaagtagcatttaagctaaacactaacagatgagaaccacttaacaaatggggtggagaatgaaaatgtgttccaggcaaagactatggcatatgccaaggctctaagtcaggagcaacagtgtaacctggtgtggttggagctaggagagaagaggagaagcgaatgaaggtgctggaaaggttgttagaagcctttgcacatgctgcactgttgcctggagcacaacacagtgctgggacatgcatgcagggccatggtcaggacttggctctggcctaagaacaatggggagccactgagggaccctaagcgagtggcctggcagtagtttagcatttttgaaaagtcactctggaccaggggtggtggcttacaactgtaatcctagcactttggaggctgaggtgggcagatcacgaggtcaggagttcgagaccagcctggccaacatgatgaaagcccatctctactaaaaaaaatacaaaattagctgggtgtggtggcacgcaactgtaatcccagctacttgagaggctgagacaggagaattgcttgaacctgggagacggaggttgcagtgagccgagatcataacactgcactctagcctgggagagagagtaagactccatctcaaaaaaaaaaaaagtacttatattaattaattcagttagtcctacaaacaaccgctgcaatagataccatcattatggtcattttacagataagaaaattgagattcgcagagccaggaccaccccagcaaatagcacagttgggattcaaaaccaagcagtttgagtgggtattaaaaaaaaacaagtttccattcaacttatgaagcaacaacaggcagaaatagaagttgaaatttatgttaatcaccttctgtgattctacactctcaatcaattcagatagagaaatccaagttgactgcacagaggcacggctctctgaaaaatttaacactgtgccacgcttacgaagaatgaaacaggctggatgtcggttccacagcatcccaaatgttcccacccttcgcctcatgacaaaggaacagcaacttcaatttatgtgccaacggatcacaccccagcattccaagggactttgctggggaggaagcgcagtggtttaatggtacagcatgctgtgctgggctaaggatagaaagtagacacagcagtgtggcctccagcttgcatttacagaagggagttcagctgggtgtctggtcaagctggcccagcccagactgggaaaggctgaatgtctgaaagtctcttttggagaagtacaatggaatgctaccaacctgcaaactttcaagttccatggaaaccaactgtctcatgcaggatgtttttctcacaatcactgcaaggatgacaatgggttgtgtaaggtggcacttggagaattaaacttttcatgccattgtttggtacaaagattattggatattgacatgtaatgatgctgtgtgctgtcactcatttaacacctgcttccccagtggactccatgagggcaagagttcagtctgtctgactcaatgctacagcacttagcatgatgcctagaataataataataatgaagaggagaaggagaaagatgctgaagaggaagaagaggaaaaagaaaaaggagaaaggaagataacagttgacatatattacgtaattatgataagcccattatagtctaaaagccttccatgaattgtcattgaattctcacaagaatcctacaagatggattttattactgttacagtttacaaatgaggaaactgaggcatagggaactgcagtaacaggctgactctgctactaagtggtagagacaggattcgaacccatacactgacatcagagtctgtgctcctaaccttatacagtggtgcccattgtaaagagaggagataggtcagtacttgtggaataaataaataagtgtttcagaaacgctcacagtagtaggggacgtggtcaggaagtaaatgagtaccttcctagaaggatatattggaatccctagggagtttttttttcaaactacccacctgtttcttagctactcccacccgctactgctggatgaaaagccttacggtggccagtcacctttagtgattggaagtgtgttttctcactcaagcgtatagggaagaaaaagaaaaacaattttggaaattattgttctagaccagtggttcccaaacctgcccacaaactagacttataaaaaccagataatttacaaaaatactaatgcctgtgccccaccttcaatggattaaattagaactgctaggggtggggccttgacactggtatttcttttttttttgagaccgtgtctcgctctgttgccaagctagaatgcagcggcatgatctcagcttactgcaacctccacctcccacattcaagcgattctcctgcctcagcctcccgagtagctgggactacaggcacccgccaccacacccaactaatttttgtatttttagtagagacagggtttcaccaggttggccaggatggtctcgatctcttgacctcatgatccacctgcctcggtctcccaaagtgctgggattacaggtgtgagacaccaggcccggctgaaattggtatttcttaaaagccaccaagggaattgaatatatggtcaagactgagaagcactaatccactctcctcatcaaaaagcaaccaggggatgctccaggcccacctgattccccttccttagatgttagcttagaggtacagatatcacaggtgtttggtatttaaaagtttaattcaattcaactattatttcatgaacacctcctttttgggtttaattttgggggtacatagtaggtgtatatacttatagggtataggggatattttgatacaagcatacaatgtgtaataatcacatcctcaagcatttatcatttgtgttacaaacaatccaattaggttctatatttttatttttaatgaggtggagtctcactgtgtcacccaggctggactacagtggcgcgatctcggcttactgcaacctctgcctcccgggttcgagcgattcttctgcctcagcctcctgaatagctgggactacaggcgcatgccaccacacccagcaattttttttttttttgtattttttgtagagacggggcttcaccatgctggtcaggatggtctcaatctcttgaccttgtgatctgcctaccttagcctcccaaagtgctgggattacaggcatgagccactgcgctcggccaagttctttgtttttaaatgtacaattaaattactattgtagttactctgttgtcctatcaaatattagatcttattctttttttgatacccattaaccatccccacatcccccctgttttgaaaagatgttttagtctgctctcattttgctaataaagacatatccaagactgggtaatttataaaggaaagaggtttaatgaactcacagttccacatggctggggaggcctcacaatcacggtggaaagtggaggaggaacaaaggcacatcttatatagtggcaggcaagagagcatgtgcaggggaactgccctttataaaaccatcagatctcatgagacttattcactatcacgagaacagcactggaaaagcccctccccatgattcagttaccttccactggtccctcctgtgacacatgggaattatgggaactacaattcaagatgggatttgagtggggacacaaccaaaccatatcaagagataaaaaggcacaaagcacaactttgatcttttatggccccaaagcttaataatgggataatacaagcatagagacgagtatataacatagttacaatatgtaagagaatatggcagagatagataggaaggaggaggaccgacaggaataagggccctaatgaaaagtggaagagtctctctgggcagctaagaaaaatgccatggaagtacagagaaaatggatgcagaagaacaaagcaaagatggaatttcttttcttttttaaaattttttgagttaattgtagattcacatgcagttgtaagaaatacagagaaatcccatatatccttcaccactttttcccaatggtaacaattcgcataactatagtctgtatctcatctcttttctttttgataaaaggctctgagaatgagcagatttcaaaaaaaatttaactatcctatcagataatttaattatgagcatgaatcaacaatgtatttcaaatttgtggcaaaggcaagagactttgctgaccttggaagggacattttctggaaaaagagaagaatgagataatcactgttagactgaatacatgtaaaaagaatgcctggttaagaagatcattagacccttgactgacagtcagctaagtagctgggtaggtagtttcccagaagaggtcataatctcattaaagtttgatataaaactgcttaagcattttatcacaaatcttaatttccttcctagtaggaggttatgaattacagcatgaaaaaacttctgtatcaaaccagatttgggacagtttttctttaccataagccagggatctgagtgaaatgttgagtacccaccttgaattttggaaggaataaacacaataccaagaactgaggccgggagcagtggctcacacctgtaatcatagcactttgggaggctgaggcaggcagatcacctgaggtcaggagttcgagaccatcgtgaccaacatggagaaaccctgtctctactaaaaatacaaaattaggcgggcatggtggcacatgtctgtaatcccagctactcaggagactgaggcaggagaatcccttgaacccaataggcggaggttgtggtgagccgagatggcaccactgaactccagcctaggcaacaagagcgaaactccatctcaaaaaaaaaaaaaaaaaaaaaaagagttgaggccctggggaagatgacccaagaggaaacccataggagaccattcagtaacatggaaactttagtttctgtgtgacatacatgacttgatgtttgttatatattttttccaagttagactgtgaatcctctataatgtaagcttccaggacacggatctcatttgtgatactgtttccccccaccttgaacattatcaagcacataataggctcacaatgcaataaatattgactgaatgaatgaatttctaaacacttaaataaccaggaacactgcctttcctacatttcaagcatgtcaaaggtggggatagttaagtcatgactgtatttcatgaattttcatgaattgatattaggggaacacatgaaggagtgtgttgatatacaccaaggctgaaactgtaagaaaattttcagcctcatcttggccaagaacctctacccagaaacaggggacccaggaatcactcaagaaagccttcattgtaattatgaagataaagaacaaatcagtggttgctgggaattgaggaatgggatgtgattacaaagggatagcataagagaatttttgggggaggagaagctactctgtatcttaactgtggtagtggttacacaaatctatatatctattaaaattcacagaactatacacaataagtcaatcatttaaaaaatgttgccactaaaaatcccattgaatggacaccttgtgttgagggaggtgcctgccagccaacgcactgttgcttccttctcttggaccagcaccaccccccacacgccacctttatgtatgatgaggtctccaggaatgatacttatactgtgagactccactcccatctctatccttcagggtgactgataatgagtagacagcaaactagaccaagtaggtgtctctctcagatatttaaaattgggactgtagctataagtaaatctctaagagttgctggaatggtaacaataatacctaaaattgtgagacagccatatcgtatttcatagatatcaaagttgagatagatggtttacagaatgagagagaaggatgtaagcctaccaaaagaagtgacgataagggaaataagagagagactgagaatcagacatgttggctgactgatttaatgggtttccagtttctaattcctcttctcaaggtctatctactttcttccccttggtttcaatgagctaccctacacccttatgatagtccttgtgtatgcttctgtttaatcaagctcagttatcctgtttgtaaaaacatagactctgaattaatctatgggcctttaaacactagttcaagcaccatcaaatagtcagaatttgggcaactcaacctcttgatgcctccgttttctcatctttaaaaggacaatagtaccttttatacaattgtggggattaaatgagtccatataaagttcttagagcaatgcttgacacataatatgaatccagatatgctgctattattatgactaacacagctttatcagagtctgtctatactctcaatatcatttcatagcaggaaatagctataattatcaatattttctgaggtgagagaacaaaaaacaggaaaccatctcattcattataagaaccccaagacttcccccaaacatgaaaaatgcctcttgaaatgattattctaatctaatgcaaaattatgaacatgaggaattttattgtatttctttaaaatctggtaagatttcctgtgaaattataccatggtatcaaaatgaaatttaagacctttcaccaagtttggtcctattctctctgtggcatgaacacagtggggagttgtggatgatctctttcatctgcattgtaacattgtaattttagagtttataaaacaccttcttggattctattccattttgattttttctttttttagatggagtctcactctatcaccaggctggagtgcagtggcacaatctcggctcactgcaacctccacctccctggttaaactgattctcctgcctcagcctcccaagtagctgggactacaagtgcacaccaacacgcccagctaatttttgtatttttagtagagacagggtttcaccatcttggccaggatggtctcgatttcttgacctcgtgatctgcccgccttggcctcccaaagtgctgggattacaggcatgtcattttgatctttatgacaactctctgaggcaggtattatcatcaaaaatttacagatgaggaaataaaagctcagagagacaccaacatccatccagctacttagtttcatagctagaactgaggccttctggctccaagaattgggcttcttcctaacaatcatattgatgcctaccagattaacagctctgcagatgaagaccagcctgatataattattttgcccacttctcagtttctactaccaactgttatatttcagacctatatattaggttctcacataagtgcagtgagtttagcagaccatcctcactgtatagactgtgaaaccaggtcttcagtaattcaagtccaaggtcaccctttgggtatgttgactagtaattatataaacctggaaaatcaaccaaatatctcttgacttcaaatccagtactttcccccactttatggcactatctctctgatatgtgtttattcttagcgctagaacttcaaatttccaaacaggcctgggtgatagagacatgtgtttcttatggtcaaacaaattgctagagctaagacagaaacacacttgcttttccaagtggataggggcagaatgaaaactaagttcaattgcttgatttgtgcaaatatcacacaagaatacggtagacctatgtattaggttggtgcaaacagaattgcggatttcgccctaacttttaatggccaaaaaacgcaatgactttgcgccatcccaatattatatttcaacataggtgtccaagatagagtgttaagttggtggggtgtgcggtggaggaagcacaacgtaaaacagcttagctgttagcttcaaccataagggggaaagtaacaaacttaaataggttatgtaatgagttgaaatatttctctagaaagatgtcatacattgcaaaataggtcagagctggtcttcggcctaaaagagcagagtttctttgttctttgtgtggttgagggtggaaatccttctataacagatccagctaccccgctactgtggtttgccttaagaaaacaattgcaagaaaggtgggaagtgagagagaatagtatgtgtgtgggggagtggggcggaggggagggtgtgcctgtgtatgtgtatctgtatacgtacagctaaattgtgagatctatgtattaaagagttttggaaacctaggacctgcacctagagacaccacctattcaaacaatagtttgcgcaaatgggaaaataaactgggtaactgggtttggcagtagtataatcccaggtcatggctgattttatgcaagagtttatgaattataccagcacagctggagacctgtgtttcaagagcaatcatctgggccgggcacagtggctcatgcctgtaatcccagcactttgggaggccaaggtgggcagatcacaaggtcaggagatcgagaccatcctggctaacacactgaaaccctgtctctactaaaaatacaaaaaattagccaggcatggtggtttgcacctgtagtcccagctactcgggaggctgacgcaggaaaatgttgtgaacccgggagatggagctagcattgagccaagatagagccacggcactccagcctgggcgacagagcaagactccatctcaaaaaacaataaataaataaataaataaataaataaataaataaataaataataaataaaattaaaaaaataaaaaagagcaaccatctgaaaataaaaactaccaaatccaaaaacaacattattcctcagctgaggaaggtttttgtttttatctctctataattatggtaagcagacccgcctccttaaatagtagaatcacccctgtattatgagaagttaccataggagaatagactcaggacaggaaaaaagatattctcacagtataaggtttcagagatatttaatttagttaataaagggaatgtgacctcacttctatttctgcctaggacagtggcttatatcacactaaatcttctgccaataataactataaaatctgggtgaaaaaaaaataaggctgcttgaaaccactgaagggcaaccaaggcagccagaagtggataaggcaagatcatgaagagataaggatgctattgaggtgagccctgtgttattatccagtgtgtttccctttgaggcatttgccaagtcatcgtgcatggcattgaggccaaatagaaatcagcaacctggaacttgcagctgtcttagcaatgaacttcaagactcccaaagcatccagaacatgaaggtctaagttttcagagaaaaaaagagaatttctgaaaagtgagcctgaaattctacatacaattctctcccaagggatttgggagcttcggcgatgtacatacacatcaagaaaaatgctgagaacacaggaagaaagcatgagccaagaagctacaaagctagatttgcagagataaactttggaggtcaaaggataccaaagataatggacgcttgttagggagaagtgggagagggtggtggtgcagggcagattttgagttgaaacgtcaatgggcattgccctaggattaggggttacactttaggagtatgtacaagctggaaatacagccaatacttacaaaaactgaagcctaagcttctgctaaagcaaggtaatctgctcatactctttctgcctgccagaaaataaaatatatcccctgtagaggaagatatattgtccagagcctctactatctttcatacaaaatatccagcattctacaaaaaaaaaaaaaaaaaattatcaggcatcctgggaaacagcagaatgactaaaaaccctaagaaaacacaaacaatagaaactagcctggaaagaatccagatattgagttatcatacatggattttaaaataaccattattattatttccaaaaacagagaaagagatcgtgaattataggattagaacaccgaagagagaaaaaaggaaatagaaattttaaaattgaaaaacatcaatactcaaatgtagaactcagtaatgatttttagagaaggtaagatagagcaaagaagattaatgaaataacagataactaagtagaacctatccagattgaggcatggggagagcgggaggaatgaaaaccagataagggtgtgacccaagggacatgatagcaaagtttaatgaatgtgcaataagaatctcaaaacgagaaaacagaaaagatagaaaagaaatatttaaagagataaggactggaatttttccaaaactgatggaagatcaatccacagatttaagaagctctataaatactgagagaaaatgaacacaaaataaaatatctgggtaagctgttgcaggccaaagacatagaaaaatcagcaaagagcagccagaagagagaaagggttatattattttccaagggataccaataagactaacagcagatttctcaattaaaatgacagaaactaggaggcagtgctataatattcttaaaaggctgatagaaaataactatcaaccgcaagttctatacacgacatgaaaatgaaggtagaataaatataattttacataaataaaaactaaaatatttaattacagcagactggtactagagaaatattaaaggatgttaagtaaaaataaacacagaagcagtgatcctacagggaaaaaaaagcagtacagtaaggaataaaggcaatggaaaggacaaatatgtaagtaaatccaaatgaatattgactaccaaaacatccacaatttgtctggcagtgttcactatatttttagaattgaaatatataacaatgatgacataaaaaataggagatgttaaataaaagttaactcctgtaacattctagctttgtctgggaaataagaaaaaattgttacatcaagtagaccttaataaggcaatgacgcatattgtaatatctactgaaacccctaagaggaaaataagagaatgtatatgaacatgttaaaaactagccaaaatggaataaaaaataatttattaatccaaaagaaaatacaaacgaaagtatgatgacacattttaccataaatatttcggtaactagcaataaatgttaatggattaagtaatccaattaaaagagattttcaacctagataaaaataacaagctatgggttttatccaagatggccaaataggaacagctccagtctacagctcccagcatgagcgacgcagaagatgggtgatttctgtatttccaactgaggtaccgggttcatctcactggggcttgtcagacagtgggcgcaggacagtgggtgccgcccactgagtgtgagccgaagcagggcgagacatcgcctcacccgggaagcacaaggggtcaaggaattccctttcctagccaagcaaagctgtgacagaaggcacctggaaaattgggtcactcccaccctaatactatgcttttccaatggtcttagcaaatggcacaccaggacattatatcccgtgcctggctcggagggtcccacacccacggagcctcactcattgctagcacagcagtctgagatcaaactgcaaggcggcagctgggggaggggtgcccgccattgctgaggcttgagtaggtaaacaaagcggccgggaggctcgaactgggtggagcccaccgcagctcaaggagacctgcctgcctctgtagactccacctctgggggcagggcatagccgaacaaaaggcagcagaaacctctgcagacttaaatgtccctgtctgacagctttgaagagagcagtggttcttccagcacggagttggagatctgagaacggacagcctgcctcctcaagagggtccctgacccccgagtagcctaactgggaggcaccccccagtaggggcagactgacacctcacatggccgggtacccgtctgagacaaaacttccagaggaatgatcagacagcaacattttctgttcagcaatattcgctactctgcagcctccgctgctgatacccaggcaaacaggttctggagtggacctccggcaaactccaacagacctgcagctgaggatcctgactgttagaagtaaaactaacaaacagaaaggtcatccacaccaaaaccccatctgtacatcaccattaacaaagaccaatagtagataaaaccacaaagatggggaaaaaaacagagcagaaaaactgaaaatactaaaaatcagagcgcctctcctcctccaaagcaatgcagctcctcaccagcaacggaacaaagctggtgttttgttttgcatgactttgatgagctgagagaagaaggcttcagatgatcaaacttctcccagctaaggaggaagtttgaacccatggcaaagaagttaaaaaccttgaaaaaagattagacaaatcgctaactagaataaccaatgcagagaagtccttaaaggacctgatggagctgaaaaccatgacatgagaactacgtgacgaatgcacaagcttcagtagccaattcgatcaactggaagaaagggtatcagtgatggaagatcaaatgaatgaaatgaggcgagaagagaagtttagagaaaaaagaataaaaagaaacgaacaaagcctccaagaaatacgggactatgtgaaaagaccaaagctacgtctgattggtatacctgaaagtgaccgggagaatggaaccaagctggaaaacactctgcaggatattctccaggagaacttccccaacctagcaaggcaggccaacattcaaattcaggaaatacagagaatgccacaaagatactcctcgagaagagcaactccaagacacataattgtcagattcaccaaagttgaaatgaggaaaaaatgttaggggcagccagaccgaaatgttgggttaccacaaagggaagcccatcacactaacagctgatctcttggcagaaactgtgcaagccagaagagagtgggggccaatattcaatattcttaaagaaaagaattttcaacccagaatttcatatccagccaaacgaagcttcataagtgaaggagaaataaaatactttacagacaagcaaatgctgagagattttgtcacaccagccctgccccacaagagaaggaagcactaaacatggaaaggaataactggtaccagccactgcaaaaacatgccaaattgtaaagaccatcgaggctacgaagaaactgcatcaactaacgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggaaacccatctcacgtgcagagacacacataggctcaaaataaagggatggaggaagatctaccaagcaaatggaaaacaaaaaaggcaggggttgcaatcctagtctctgatacaatggactttaaaccaacaaagatcaaaagagacaaagaaggctattacataatggtaaagggatcaattcaacaagaagagctaactatcctaaatatatatgcacccaatacaggagcacccagattcataaagcaagtcctcagagacctacaaagagacttagcctcccacacaataataacaggagactttaacaccacactgtcaacattagacagatcaatgagacacaaagttgacaaggatatccaggaattgaactcagctctgcaccaagcgaacctaatagacatctacagaactctccaccccaaatcaacagaatatacattcttctcagcaccacaccacacttattccaaaattgaccacacagttggaagtaaagcactcctcagcaaatgtaaaagaacagaaattataacaaactatctctcagaccacagtgcaatcaaactagaactcaggattaagaaactcattcaaaaccactcaactacatggaaactgaacaacctgctcctgaatgactactgggtacataatgaaatgaaggcagaaataaagatgttctttgaaaccaataagaacaaagacaccacataccagaatctctgggacacattcaaagcagtgtgtagagggaaatttatagcactaaatgcccacaagagaaagcaggacagatctaaaattgacaccctaacatcacaattaaaagaactagagaagcaagaacaaacacattcaaaagctagcagaaggcaagaaataactaagatcatagcagaactgaaggagatagagacacaaaaaacccttcaaaaaatcaatgaatccaggagctggttttttgaacagatcaacaaaattgatagactgctagaaagactaatgaagaagaaaagagagaagaatcaaataagcgcagtaaaaaatgataaaggggatatcaccaccaatcccacagaaatacaaactaccatcagagaatactataaacacctctatgcaaataaactagaaaatctagaagaaattgacaaattccttgacacatacaccctcccaagactaaaccaggaagaagttgaatctctgaatagaccaataacaggctctgaaattgaggcaataattaatagcctaccaaccaaaaaaagtccaggaccagacggattcacagccgaattctaccagaggtacaaggaagagctggtaccattccttctgaaactattccaatcaatagaaaaagagggaatcctccctaactcattttatgaggccagcatcatcctgatagcaaagcctggcaaagacacaacaaaaaaagagaattttagaccaatatccctgatgaacatcgatgcaaaaatcctcaataaaatactggcaaactgaatccagcagcacatcaaaaagcttatctaccatgatcaagtgggcttcatccctgggatgcaaggcttgttcaacatacgcaaatcaataaatgtaatccagcatataaacagaaccaaagacaaaaaccacacgattatctcaataaatgcagaaaaggcctttgacaaaattcaacagcccttcatgctaaaaactctcaataaattaggtattgatgggacgtatcccaaaataataagagctatttatgacaaacccacagccaatatcatactgaatgggcaaaaactggaagcatttcctttgaaaactggcacaagacagggacgccctctctcaccactcctattcaacatagtgttggaagttctggccaggggaatcaggcaggagaaagaaataaagggtattcaattaggaaaagaggaagtcaaattgtccctgtttgcagatgacatgattgtgtatctagaaaaccccatcgtctcagcccaaaatctctttaagctgataagcaacttcagcaaagtctcaggatacaaaatcaatgtgcaaaaatcacaagcattcttatacaccaataacagacaaacagagagccaaatcatgagtgaaaccccatccaaaactgcttcaaagagaatgaaatacctaggaatccaacttacaagggatgtgaaggacctgttcaaggagaaccacaaaccactgctcaacaaaataaaagaggacacaaacaaatggaggaacattccgtgctcatggataggaagaatcaatatcgtgaaaatggccatactgcccaaggtaatttataggttcaatgccatccccatcaagctaccaatgactttcttcacagaattggaaaaaactactttaaagttcatatggaaccaaaaaagagcccgcattgccaagtcaatcctaagccaaaagaacaaagctggaggcatcacgctactgacttcaaactatactataaggctacagtaaccaaaacagcgtggtactggtaccaaaacagagatatagaccaatggaacagaacagagccctcagaaataataccacacatctacaactatctgatctttgacaaacttgacaaaaacaagaaatggggaaaggattccctattcaacaaatggtgctgggaaaactggctagccatatgtagaaagctgaaactggatcccttccttacaccttatacaaaaattaattcaagatggattaaagacttaaatgttagacctaaaaccataaaagccctagaagaaaacctaggcaataccattcaggacataggcatgggcaaggacttcatgtctaaaacaccaaaagcaatggcaacaaaagccaaaattgacaaatgggatctaattaaactaaggagcttctgcacagcaaaagaaactaccatcagagcgaacaggcaacctacagaatgggagaaaatttttgcaatctactcatctgacaaagggctaatatccagaatctacaaagaactcaaacaaatttacaagacaaaaatgaacaacccaatcaacaagtggcaaaggatatgaacagacacttctcaaaagaagacatttatgcagctaaaagacaaatgaaaaaatgctcatcatcactggccatcagaggaatgcaaatcaaaccacaatgagataccatctcacaccagttagaatggcaatcagtaaaaagtcaagaaacaacaggtgctggagaggatgtggagaaataggaacacttttacacagttggtgggactgtaaactagttcaaccattgtggaagacagtgtggtgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagtggattaagaaaatatggcacatatacaccatggaatactatgcagccacaaaaaaggatgagttcatatcctttgtagggacatggatgaagctggaaaccatcattctcagcaaactatcgcaaggacaaaaaaccaaacagctcatggtctcactcataggtgggaattgaacaatgagaacacttggacacaggaaggggaacatcacataccggggcctgttgtggggttgggggaggagggaggaatagcattaggagatttacctaatgtaaatgacgagttaatgggtgcaacacaccaacatggaacatgtacacatatgtaacaaacctgcacgttgtgcacatgtagcctagaacttaaagtataataaaaaaataaaataaaataaaataaaataaaataaaataaataactggctatatgtggtttatatgacactgaacatcaatataaaaatatagaaaagttgaaagtaaaaggatggtaagaaatacccaaggacatagcaaagccaatgtcattatactaatatcaagcaaagtagactttactgaaataaatataatagagataaagatctgtataagaatatgtatagaccaggtgtggtgggtcacacctgtaatcccagcactttgggaggctgacgtgggaggattgtttgaggtcaggagttcaagacctgcctgagcaacatagtgagaccccatgtccacaaaaatttaaaaattagccagttgtagtggcatgtgcctgtggccccatgtactcaggaagctgaggtgggaggattgctccagcccaggtcgttgagattgcagtgagctgtgatcatgccactgcactccagcctgggaaagaaagaaaagaaagaaaagaaagaaagaaagaaagaaagagagagagagagagagagagagaaagaaagaaagaaagaaagaaagaaagaaagaaagaaagaaagaaagaaagagaaaagaatatttaatagaagcatttttcacaaatgcttccccaaactggagcttacccaattatccagcagcataataaataaataagcatattgtaatagtcataagatggaatattacatagcaattagaatgagcaaacttctgttagacacacaattacagataaatactgtagataaaatgttgaacaaaagaagacaaaaatgaaagggtgcatgaaatatgactccatttatcaaaaatccaaaataggaaaagctaatgaatggtggcacaagtcaaaataatggtgatctttgaggaagatgatggagaaggaacatggaaatcttctaggaaatattttccgtattgatctgagtggtgtgtccacttctgaatatttgtcaagcagtacaattatgatttgtgtacgtttatgagtatatgttttacttcaataaaatgctttagaaaaaagataaatttaatcccatttgctacaccaaactactgaaagagggtatatgatctgtttatgataattttaatcattaatagtaacagtagatacttaactagtccttctggaaagaaaaataccacatgttctcactcacatgatagagctaaaaaatttgatctcatagagatagaaggtaaaataatagatactggagtgggaagtatgtgaaggtgggagggggaaatgaagagagattggtgaataggtacaaaccgagagttagatagaagaaataagttctaatgtttgatagctactagggtgatcattgttagcaactgtatattgcatatttgaaagtagctggaagaagacttgaaatgttaccaatgcatataaatgaaaaatactcaaagtaacgaatatcccaaataccctggcttgatcactacacattctatatgtgtgaaagatactcacttatacccaataaatatgtaaaatattatttattaatacaatttaaaactagtcctgcatgtaagtattgtaattatgttaacttaatacttataaaaatctgttaagtaggttctattattatccccatttcacagataaaggaatggaagaagagggagtgtcttagtctattttctgctgctatagcagaatatcacaggctagaacatttatgaagaacagaagtgtattttgtttatggttctagaggatgggaagtccaaggacatggcacctgcatctggtaagatacatcttgtggcagaagggtggaaagcagaaagtggaaagcagaagcaagcactcaacacagagaaaaaataacagccagacttacccttttgttaggagcccactcccaaaatcattaacctactctggtgataatgacattaatctgctcatgagggtaaagccctaacggcctaaaggccctcaccttctaaaggccccacctcttaatactgttaaaaatatgattaagtttccaacaaatgaacttttgcaggatacattcacactatagtagggaggttaagtaacttgccctaggagacacacagttaatgggtagcacactctctccttctcccttccccctccccctctttccttttttcctctcctccctgccatttctctgttgcaccttagaatctcttggggagatttgtaaaaatttcaatgtctagactgcagcctaagccaattaaatcagaatctctagagtggaatacaggaaactggttggttggttgtttttttaaagaaaaacaattccttgataaatgtatgtctgattatcattttaaggatgtgagggttaaagttcaacggggttagataacaacaaatgagtagagggaaattaagaagtggggaaatcagaatttaaaccccaatgtactgaggtctagaatttgagtaccattcctccttccaatgatcaggaacttttgattttcttccagatacccaatcctccacattaaaggtacagccccaacatctgggggtggagagaggtataggtctggcatttatccaggatttttagcttccttcatcagaaaacacctgaagataggcagtcacctatggcaagaaacaaataccaaagatggaactatggggataagacataaataagttttaccttagggatcctgttccagtatgatgtccatgcttcaaacttttataaccaggtccttcaatgactaaacttctttcataagtgtccaaagtaggcttacctttctccttcctgtctccagggtaattaagtgactaaattttaccgaggctacaaaactcacattgaaagaaaattgggtaacactcaagtgggaaaaggagaacttttctaacataaaaatattataattgtgcaatattggccataaaacatgctgagaaataattgtttgaaaattatcattatctaaatctcagtatgggagagataaaagagaacaatgttcacacgagctttctcaattaagggtgctacaatcacgacctccaaacatagaagaaacaaatatatgcagttcttttaaacatatacttaaagttacaaaatggattttgagtgtaatttaaaggcagggtgctccctacgacttacttggttatattagtgcgaagcagggtgtggaggtaaaaagttccctttgccagaagatgtgcttattcctattaacttgtgcccatccactggccagtccccgataaggtcttctttcttaatatctaaaatgatatctacatcatcccaatatcaacttcctgagccacccactcctttgaaattcaaatgaaactggcaaagccgtacaccatatgccatggaaaagctcagtgttaatctcccatctctgtggagctcctcaagatgtccagaaagagttgtcacaatcgctggatcgtttcttactcagagtcccaatattcaggagagaccatttagtttgtggataaactcactgtctgcccattttttcactaatctccatcacttcacccagaatcctcatcctttaacccaggctacctgcgtggcagcctttaccatgaagggggtttcagcacagacgtaaacttagcagcaaagtacctcacagttttgaaattcagtcagtctctttacctgccacagaatttcccatgcactacctcacttggctctgttttcactcctcttcctcctcctacccctttgtttgctccacgcaagccataactccaaaattattatgactctctcctgaggatgtttttacaatctccttgttcactgactccttccaaactattccttgtcatctcacaactttccaagcccaactggtctgtatattaagctattgtgctacaacagtagttctcttcctcaacgaagttctgctgccagattttacatgattcatttttaccatgcttcaaccaaatgatataagtaagctcccttctacttctaaattcacctagtagatggtacctagtctctgacaagcactgatatactgggatacatagtggataaacatgaatgacaaagtccctaatttcattaagctcccaagacagaacttaagagatgcttgtttgtttggaaaaaatacagtaaaatcttttgcattaatgagtgaatgaggggcattatttccccatctgtgacctggaactcagaattgcatacataataatggttctgtctcttcttcttaggatacccacctaggccctctcattccttaaagagaggttacaagctacagaagcaatgctcctaaccaacatttactaaatctgctttatcaaaataaccaaaaccctccatttcttcaacaaaacatactaaatgctctctacagaaagctgaaagctcatggctaacaggaaactctaatttttctgctacattaaccagccaactactacttctaattatatcagataagaaggcttctactgtatttttccaaataaaaacagttccttcccaagtggaaatctaatgcaagctgttgaaaacaaagtaattctgttttcttcttatcacatgcagatgaatggatgcctcagaacgactttgccaggactacacaaaattcacttagtcctgttgcagactatgactatgatcttcttttgcagaaaggaaacgtaggtagttgtcagttgtatcagctacctattactaagaaacaaactcccctaatattcaacggtttaaaacaatacacttttattattgcttataagtctatgggtaagcagggaagttctattgatctgggcaaagtttgggtgatctcatcttatgtctacagtcagctggcaaggtcatctggtaatggctggtcaaggatagccttacatgtctcgtggttggttggctgttgcctaaagtaaagggagtcactgaaccctgtgtcatctctacattcaacaggctagctcatggcagctgggcagactccaaaagaaagtaacaggtacaacatctgctgagggggaggtttaaagctgacacactgtcacttccaacatgttctaatagcccctgtaatttataagatcttatggtttgaattttgtcccaccttagattcataagttgaagccctacacccccaatgtcactgtatgtggagataggggctttaaagaggtaattaaggttttaaaaggccataagggtggagccctaagctaatataacctctgtccttataaaaagaagaagagataccagaagtacacacacacgcacacacacacacacacacacagagagagagagagagagagagaccctgtgaggacacatggcctttgttgttttatcagtctttattgatgaaacaattgaattctttataggaaaaaaagaaaccataatactttttcccccaacaaaaattaattcaagttgaattatatacttagacataaaacccagaaccataacatttctaggaataaaagaatatttttaagaccttggatatgcaaaaaattttttgaacaggacacaaaaagagatgaggtgtcatctgtaaatcaaggagagagacctcaggagaaaccaaacctgacaacattttgatcttggacttctagcctccagaactgtgagaaaacaaatttctgttgtttaagccaccacctagtctgtggtatttttttatggcagcccaagccaactcaaacacaaggtaaacccagactcaaggagtagacagatagattccaactatttatgaaaagagctacaaagtcacattatgaaggttgtagatatagggagggatggagaatcaaagctattgttgtaatcaatctaccctactacatcagttgaggcagaattatcaacactttttgtattgtatttcaattttacctataaatttcagtatttagaagaaagtcagtgggttcccttacacagtggacatagaatgcacccaaaggatcaaaacaagtcacttaagctatagcaaagggctgagactagatatgatgaggtgtccctctaatgcatactagtcctatatagtagatatagctgcatccatagaagactcagaggcaagaagcaggactgaagtctctaggctctgaaatcagtgagcaggaatagagagcaaagagaaatcttcagaacccaacacgttggtaggttggtggtagagccaggaaagacttcctccagttctgaaagctagaaacatgttcctgaagcacagagagattggtatactctcaccagcactcagacctgggtcctgctgaaaggaagtcctgatcccacactcatttgaagccagagacaaattgaattaaacaaaagccacagcaaaacccaaactgagctcaactgcagattagattgcatcagtccctgctgcagtagcctagcataagaatagccaaggtgatcatgagtaaaaataattgagctggagaaattttcctacctgatttaaaaatatactacaaagcaatagtaatcaaaacagcatggctagtataaaaacagacacataagccaatggaacagaataaaaaacccagaaataagtccatgcatttatggtcaattgatttttgaaaaagaatccaagaatatacaatggggaaagaatagtctcttcaataaacagttcagagaaaactggatacccacacgcaaaagaatgaaattaggccttgatctcacatcagatacaaaaatcagccagaaatagattaaagacttaaacataaggcctgaaactgaaaaaccagtagaagaaaacataaggggaaaaccccattgcattgctatgggcaatgattttttttaatcggaccccaaagacataggcaacaaaagcagaaatagacaaaagggatttcatcacactgaaaagcttctgcacagcaaaggaaacaatcaacagaatgaagaggcaaccgagagaatagaacaaaatacctgccaatcatacaccttatgagggagttaatatctaaaatacacaggaaactcaattaagtagcaagaaaacatcctgactaaaatgggcaaaggatctgaacagacatatctcaaaaggcaacatacaaacaggtatataaaagatattggatttctacatctttttttaattgacaaaaattgtatatatttatggagtacaacatgatgttttgatatattcattgtttgatctagacatttgatagtcattgtggaacgactgaatcaagctactgaacatatcaattccctacatatttagcatatcttggtggtgagaacatttaaaatctactctcttagcaatttttacatatacaatattattaattatagtcaccataatgtacagtagatctcttgaacttactcctcttgtctaactgaaattttgtatcctttgaccaatatctccccagtactccaaccccccagctttattttttatatacttttcatataccaacaggtatatttttaagatgctcgacagcactagtcaccaggaaaatgcagattaaaaccacaatgcgatagcacttcacacctattacaatgacttatcaacaagatgaaagataacaagtgttgaccaggaatgtagatacaagggaaccctcagatgctgttggtgaaaatgtaacttagtacagctattatggaaaacagtatggagtttcctcaaaaaattagtaatagaacaatcatttgatccagcgatctctctactgggtatgtatctaaaggatatgaaatcagtgtgtcgaaggaatacctgaactatgttcactgcagcaacaatagctggaattaacctacatgttcatcaatggatgagtggataaagaaaatatagtatatacacacaacagagtattattcagccttaaagaagccctcttatttgtgacaacatggatgcacctggaggacattaggttaagtgaagtaagccaggcacaaaaaaaaaaacaaaatattgcatgaatgagttcatacgttaaatctaaaaaagtaatgctggagaatggggggactggggagatgttggtcaaaggatacaaaacttcagttagacaggagaagttcaagagatctattatacattatgttactgtaactaataacatatttatgtgaaaattgctaagagagcagattttaaatggtcttatcaccaaaaaatgctaagtatgtaagtaaagcatatgttaattagcctgatttagtcatttcacaatgactatcaaatgcctagatcaaacaataactatataaaaacatcatgttgtactccataaatatatacaattttgtcaattaaaaaataaaaacatgcaaaaatcccatacctttttatgactaaaaaactcagcaaactagaaatttctcaagctgataaagtgtatctatgaaaaacctacagctacaccaaatacttcatcataattaatatcaaaattataaacaatttttcccccaagatcaaaaacaaggcaatgatgtatgccctcaccacttgtattcagtattatcctggaaatcataactgtagcaatacaattttttataaaaattgttataaaattgttataaaaattgcaaaagaaataaacttctactaatttgcaaattacattgttgtgtaagcagaagtacaatgtccaaagcaatctaccaaacttctacaactagttagtaagtttttaaaagtcacaggacacaaggttgataagcaaaattaattgtataactatatataagcaacaaacaattgaaaattaaaatgtaaaacacagtaactctccccttccttttctttcctgaacaattctgtccaaaagccatcaggtggggctgaacacattaggcaaccctgcagagaagtagggtaaagttgctgtgggcctctacatggtgttgaggactgagtatgtgtagaggacgtccacaagagaagatggcctatcacagggcatcagagttgagcagactgaagggctgcctacatgagagggtgaccaggtgctaggcaccaaagcccgtgcaggttgaacagggcatctgcttgggagggaagcccagcaggaggtgtcagagcctgaatagccaccagggggcaggagtgacagccatgactagagattggtacctatgatggggttgatccaataaacacattgagggaaatgggagctaggtttctgccaataaagagatatacaaacaaggaaaggcagataattagaataaactctgtagggctggaatgaaagatattggtgtaaacccttggctttcaacaagtatagatagatattcacataaggtatatagatatgggcataaatatagaaataggaatatacacagaagttactgagcacacctaaggctcagatcttggtttctaaataccattctaaaataaaagtagacacaaaataaaataaaagggcttgttggataaatggctaattccagggctaaagaaaaaagaagtacaaaatgaatctggaacactttgtgccagaaagtaagaaagctcttttaaaaataataaaacaaataggggtataattaaaaagacatggaaatcttgaaggtgcccctatccacaaaatctgaaacaatttgagcatcaaaataaaaaataatattaatggattaaagctaagtaaaatatgaaggcatgagcctatactgatagtaattaaattcaaagtttgatgaagaacaaaacagtttcaaaatatcactacacgaaatatttattacaaggggatacatagtaaatttacagtggaaagcctaatagacatccccttcatcaattgatcaaagtgaatatcatcagtaaaggaacaaatcaaaattatatgtcacttgataggactccataagaacactatctcgctctgtgatgtttctgccaaagaggaatagcctgaatctaaccaaaaggaaagatcagagcaatccaaattctacaaaacattcttataatttgtctaggtcaccaaagtcaaagaaatactgaggaactgtttcagactagttcaactaaacataacacgattctggaccagatcaatttcttacaaagaccactctggggacaactaactacacttgaatggagtctgaagactaggtattaagaggggatacatgtctatttcctgatttttatgttcgtatggtggctatttaggggaatattcttgttcttagaaaatacacattcaagtattaggagataataaagtatcatgttggaaactttcaaatgctttgaaaaagtttctttattctgtactctaaacttattggaaattttgagactgtttcaaaataagaaacaatataactttcaataacatcaaaatatcaaatacctggaaataaatgtaatgaaacctactcaaacccagaaaacattgctgagaaaagttaaagacctgaataaatgaaatgttttacaatgttcgtacattggaaggttcagtgctattgagatattcattgtttctaaattagcacataacttcagtatgattcctatcaaaattccagcaggctacttaccagacttacataagataactctaaaaatgtttatggcaaatctacatgtctagaataatgaaaacaatcttgaaaaaggtgaacaaaactggagaactaacattatctgatctcaagccttattctaaaattacagtaatcaagacagtttaatagtggatcataggatagaacactagatcaatggagcaggagagagtgtccagaaatagacccacattcatatggtcagtggatttcacataacggtacaaagtcaattctacgtggcaaagaatgccttttaaacaaatgttgatgaaacaattgaatgctttataagacaaaaaatgaaccatgacaattttcccccacaaacacaagatgaactatgtacttagatataaaactcagaaccataacacttttaggaaaaaagaatattttcaagactttgagtgtgcaagaaatttttgaacatgaccccaaaaacatgataaaaaaaaagaaaaagatttaaaaatgttggactttatcaaagttaaaattttctgcttatcaaaagataccataaagaaaatgaatagacaagttatggtttggaaatatacttataccacctatatatgactatgggcttatatccagtgtacacaaaaactacaaatcaacaatctaattgagcaacctaatttttcaaaattaacaaaatacttgaacagatgcttcacaaaagaagatacatcaatagtcaacaagtatttgaaaaggactcaatgttgttagtcatcaaagggaatgcaaattaaaaaccataatcaaatagcacttgacacccagtagaaacactaaaatgaaaaagactgacatcaaatgtgggcaaggacaaggagcaactggaactcacatacattgctggtgtgagagtacaatgttactacactttcaggactatgtggccctttcttcaagtttgacatacatgtcaaacttatgacccgtctcttcttctcctaagtacttacccaaaagaaacgaaaacacgtttactccaaatcatgcacaagaatgttcatagtagccatgttcataactgcagaaaagtggaaaccatgtaaatgcgcataacaggagaatgccggatgcctacataggaatactacacaccaagagaaagaataaatgacaaatacacacaatacgcacatgcatgaatctcaaaaacagtataagcaacagaatcctgaaacaaaatgacatccaacacataagaatgaccctatttatgaaatctatatataaaccaaactaacctaggttgacagaaatcaggtagtgggatatagggaaggaatgaactggaaaggagtcaaagcgtttctaggatgatggagatctatgttcttttgagtggtgttacactggtatatactattaccaatattcattgaactgaacactttagatctgtgcattttattatatgttaattatggcacaaaaaaacaaaaacaaaaaagtctaaaaggtctagtatgggacttattgcagatgaatgccattttatttttttatgtaatttcaacttttatttatttatttgagacagggtcttcctctgtcacccaggctagagttcagtggtgggattatagttcactgcagcctcaagctcccaggctcaggcgttctcctgcctcagccttctgagtagctgggaccacaggcatgcaccaccacagccagattattttttattatttggagagacaaggtcaccctatgttgtccaggctggtctcaaactcctgagctcaagggatccccctgcctcagcctcccaaagtactgggattacaggcctgagccaccatgccctgacaacttttattttatttagattcaaggggtacatgttcaggtttgttacctggatatatattacatgatgctgaggtttggtggacaactggggcagctgtcacctaggtactgagcatagtacccaatagtttttttttttaatactgtctccctctcttttcctccccacctctagtagtccctagtgtctattattgccagctttatgtccatgaatacccaatatttcacccccacttacaagtaagaacatctggtatctggttttctgttcctgtgctactttgctcagggtaatggcctccagctacatccatgttgctgcaaaggacatgatttagttgtttttatggctacatagtattccatggtatatatgtgccgcattttctttatccaatccgctgttgatgggcatcgaggttgattccatatctttgctactgtgaatactgctgcgatgaacgtatgagtgcatgtgtctttttggtagcataacttattttcctttggatacatacccagtaatgggattgtcatgacaaatcatagttctaagttatttgagaaatctccaaactcttctttacagtggctggactaatttgcattcccatcaacagtgtataaccgttcccttttctccacagcctcaccagcatctgttgtctcttgactttttaataatagccagattcatgaaattttcaatgtttagatttttttcactctataagagcacagtgtttgaaaaattagaaatttaacacataatatgtaaatatggacatttgcaactcgaagcaccgaaacagttgctatgcaacaaaacggagcagcgagcgagccatcacagtatgtcatttgtcacactcaggtgatggcatattgtaacccaactgttagaaccatgctgtttataattcggtaactatacagccacaactacatcattgaagttagtagcaccagcttcaaaatcaagcaaacctggattcaaattctgcctcagaaaatttcctactacatagctcctgactcttcttccaataattctgtgaggcatgagtctggaggtgaagaggtgaaaacttcttccagttccagtctaaatggccttactcggaatctcctcattttaaatctatccctaagcaccacaaggtttagcatcagttccagtggcacaggcaacacagaaattataaataaatacattcttcaactaagcccctcacacccgcagccaccttctccagcttgttgagaaatagcaaacaagaactagatacaccacaccgagtggcgtggatattggatagtgtagccaggatctaaagtgcttttcttgaacaagactgtcaaggggcaaacaggcatttacttatttttgggttgtgcgtgattgacgatgccactctgaggcccaggattctcatttaacgcccctcaggcatccaattgtttgacaggcttaaaacacatgaattctatttccaaagacagagacagacatcagggccctcctaccagagcatgtggaagaaagagcaaacagcaaaagaaactcgctagggagggtgaggccatggacagctgccgctgcatttgttttagagtgtaagcaagaaaaatgctcctttgacatttgaaaactttctatatcctcccctgtaactgccaagctatcccagacttcctcaccacagctccaaatgcccatatttttcttcactcctggatataaatgtgactctcttctctttattataaggcaatgaaaggcctccagacatagttactggcactactgggacccccagatggtttgctgggccaggaagaatgccgtgtagcagtggggaggtaacaggttccttcacaagaagccacctgctcataattcattcacacgcttttcctctgggcaaagcaacaacaatttaaaatagtctaacgtgggccttcctggaattacaaaaataggagtgcatccagatttgaggattggttgccccctcttctctggtgccaccccagctggaagactgccaggaacaggttacggagtctctttaacagaaatggagattagcaggtgttaaagacagattagcaactaaatgagtttctccctgtcataatcagtattcaaagaggaagggtttctagttgggcagctgctaggagtcttttctgacaagaagaaatttgcctggatttgccaggctttagcaaactcaagatatcaaagtgtaaaggtaagccataaatgaagtttgtagcaggcaggcacttggctagaatgtgtaactgagataaaatggggtcacagcacgttttgttttcagggcactttctggggatgggaagggagaagttccatgtttgtgctttttttcctgtggactcagatgctgactctaattccaagactccactggttccacggtgctttctttttgcacccttagatttggccatcagtctggagggcagagggaagagcttgaacaggcttggatgaaataatactgtcttagccagtttgggctgctataataaaaataccgtagactgagtggcataaacaatatacatgtattccttgtggttctggaggctgggaagtccaagatcaagatgctggcagatctggggtctggtgagggctctcttcctagttcgcagacagctgccttctcactgtgtcctctcatagctgagaggccaacgtggtgaaatcccatccatactaaaaatacaaaaaattagctgggggtgttggcacatgcctatagttccagctacttgggagggtgacgtgagagcatcacttgaacctgggaggtggaggttgtgtgagccaggatcatgctattgcactccagcctgagtgacagagcaagaccatctcaaagaaaaaaaaaagaaaagaaagaaagataatctcttttgtgtttcttcctataagagcatgaattccattcttgagggatccactatcatatcctaattgtctcccaatggtcctaccccctaataccatcacaatgggttagattccaacatataaactctggggaaactcaaacattcagtctatagcaaacactatgacagcaaagtatgctgtaatagtcaactaggcttttagagagaaagaaagaaaacaactatttattaagcacctactatgcgccacccactttactaagctctttcattattttattttaatccaaaagacccggtccacattagaagatctggcataagtgaaactaaagacagattgagttgcttatttctttccttcccatggttttgtgtttccttcttaatgttgttttgaatttgtttgggctcaaattatattacacccttgtcatctccattagctaaaatgtatttatggctgattatgcatgcataaaataaattaaatatctgaataacattaccagtaattggtgaaattgccttatgttttcacatccttacaacaaaaaaggcatcaacaaatgaccaggaaaacaaaaggataatccattataattttccttattaacatagtgataggacagacacaattatgggcaatttcagtgtctaaaaatcaagtatgatgaaaattatattgaagttaactaagaaaaaattactttagctattgctccaaaccaactgctagtcaggatgaaagaaaatagcccctacttagaaaaatcagccactgacttagaagttgacactgaatcttttaagtttctacaaactataaaccatagctggagtgttcattttgatttgcctgggtgattctccatgatatggtttcccttcagacaccactgctttattggtgaatcatttatgctgatttagagagatattctagtgtttttctttctaaacacataagtaccaccttcagcacagcctggtatttaaaaatatatgtgtgtacccacacacaagcacacacaggatcaaaccagcataatcattttttgggctgctaatttgtgtgttttgatggtgatgtgaatttaaagtatttgataaccataaaaaccatcatggcataggtactgaccaacggagaaggataccagctgtgacattagagcaaagtactaggaccccttttgtgcaagaccaggggatcacagtaactggggtgcaccaggaagctgctatttaccaaccaaaatgaaagtcttttaatcggttaacaatggtgcaaccataccagggtgtcacaactaaatgtcagtactatacacacacacacacagagagacagagagagagagtgagagacagagagagagagagagagagagagagagagagagagagaaaaccccaaggaaggtctggcctctcccttgacctctgttatcccggtggttttagtcagcatcttgccaaatggacaccccataacagtacactcctgtagggctctggcaggtgacatggcagtccaaaccaatggtcatttctacaaggacaccccttctctttcagccctgacacctggaaaaccagtcttattcacagaacatagtagttgggacccaagcacgggtaccaccacttagattttaaaagccaaagatgtgtgaagtttgaaacagacagaaatgctccaaatccacccaagggaatctaaagaagatgatctatctatctgtctgtctgtctgtctgtctatctatctatctatctatctatcgattgatcgagagatgtggcagggcctgtatctcaagagaaagagaatcctttaccccatcaaagtgaaatttataaagaacagatccaaacatgcctttccatttctcaaaattctttgatggccagcatcactgatcttttaatatggtagaaaagggacttcataatggagcctcaccttatttcttgctgccttaaccctacattcaagcaatagtgaaccatttgtagtattggaaaacatcatgttattctatacccagacttccatttcactgggtgggcaatccattgcaacccacatcataagtcctggaattgtttgctagaaatcatcctagttgccttcatccaagtatcctgagtaacacaaggcttggcacatagtagatcccaatagtttttgttgagtagataattcagtataaccaggcagttctgaagaataaaatatggcaggcacactgtcacagatctttgcctgggagagatgaagacatgttcaatgtattctaagatcacaggatcaaaaatgaacagaggttaaaaacaaaaagactgaccacttccaggagtggtgaagacgaggagtcattagaactctcataccctgctggcaggaatgtaaagtggcacaaccacatggaaaacaatttggcagcttcttaaaaagctaaacatatacttaccataccatccagccatcctagtcctaggtattcactcaagagaagagaaagtatatgtccacagagatttggtacacaaatgttcattgaagtcttatttgcaatagctaaaatatggaaacaatttagatgtttccagtaaaacaactggtgaatggataaacaaattgtggtacatccatacagttaaacacttctcagcaataaaaagcaatgaactattgatacatgctacaaaaaggatgaatttcaaagtaatgatgctacgtgaaggtaaccagacaaagaaagagtatgaactgtacgattccatttattcataattctagaaaatgcaaactaaggataaaaagcaagctagggcttcctgagaatggaagaggaaggggtaagaaggagatattataaaaggggcatgcgaaaacttttggaaatgatgagcatattcactattttgattatgatggttttgagggtgtataggtaagtgaagatgcagctaactctatactgtatgtgctatttgttgaatttcaattataccttgataaagatatataaaagtaaataataactgagcaaggcatatgctttacgagaaaacagtcattgtggtttggggaaatcacaatgagacactaagaaggtaatgggaacactttgactttggaagtgtaagttagagattaagggtggcatttcagaaaaggaaaaatataagaaaaatgtctaacagtcaagactgtccaatgataaaataaactggccttggaggtagtgagttcctagtccctggaagtatttaatttgatgaccattaaatagcccttgaaatggattctcgccctggttggccaattattttctatgagccctaagattcttttaacctctgatacttacttgttcaccaagaagacactggcagggaatatttgctggtagcaaactccctgtcaccgatgctcatgaaaacaaccattaggaattttcctcaagaataaaagaagtgaaaataattcaaaggcttgggacttcaaagaagtcgagttgaaaggaaatcagttcttcagatataggaattactagtgagtacaaagagaagagtgagcgatggagctttggggagagggcggccgggtggctgaagtctgggtgtgagaatatcagggaggggagtaggcactggggtttagaaaacccagggggtggctataaaacacagaactggagtcgtgagcagggattgggtggctcgggtcttgggatgcttcctcacagatgctgtcggacttgctgtggaaataacttcccaaataacaaaacatatccctgtgttcaaaaacttccagtagcctcctgttgcacttagaacaccattaaaatgatttaccagggctacagagatactgctaagtgaaaagagcaagatgccaataaatgggtaacaaaaatgcaacggttttaaaaacaaagataatgaaaattcttttaccacgaatgtgtattctatctgagcattttgcacaagggtatcagtctggattattagactgaattaaaacttctcctcaagcctggcccaggtccccaacaagccccactctggcatatggcactgctctgagggggagacagggataattgctggaagcagagggtgtccgaagaggagcagttgtgacccccaccagccacctggatgaagcaattaaacaattgactgagtgaatctaacaaatgccaaagggatgaaaattgatttgggtaaaagacaaatgaggtcaatttcctcatttctgaaaaccaaggtgagagttaaggacagacccttccccagattccacatttcttccttagtccataaaggagaggatatcgctcttgtcttgtgggaagaaagctgccaactctttttacccatgagtcctccccaagaaaagaaaggatgaatgtaattgctcagagaacaacactcaccggaacatggcttactaaagggcagggatagggtattgcagggttagggcccgccacttaccactttctctttgcatacctcccagacacccccctttctccctcttcagtgccctataggcctgtgggcctcacccctcgatggctatctcaaagtcagacctgacctgtaagtcaatagtctttggcagatgtacagaactgaaattcgaatggcgaggatggcaagaaaagctggcaacttctatgtacctgcagaacccaaattggcgtttgtcttcagaatcagaggtatcaatggcgtgagcccaaaggttcgaaagatgttgcagcttctttgccttcgtcgagtcttcaatggaaccttcgtgaagctcaacaaggcttcgattaacatgctgaggattgtagagccatatactgcatgggggtgccccaatctgaagtcagtaaatgaactaatctacaagcgtggttatggcaaaatcaataagaagcaaattgctttgacagataacgctttgattgctcgatctcttggtaaatacggcatcatctgcatggaggatctgattcatgagatctatactgttggaaaacacttcaaagaggcaaataacttcctgtggcccttcaaattgtcttctccacgagttggaatgaagaaaaagaccacccatcttgtagaaggtggagatgctggcaacagggaggacaagatcaacaggcttattagaaaaatgaaccaaggtgtctaccatgattatttttctaagctggttggttaataaacagtacctgctctcaaattgaaaaaaaaaatagtctttaacttggtgaagaaggtgatatggtttggctctgtgtcctcacccaaatctcatcttgtagttcccataattcccacgtgttgtgggagggacccagtgggggatgattgaatcatgggggcaggtctttcccatgctgttctcatgataatgtgataatgagtaggtctcacgagatctgatggtttaaaaaacaggagtttctctgcacaagctctctttttgcctgctgccatccatgtaagatgtgactcactcctccttgccttccaccatgattgtgaggcctacccagccacgtggaactgtaagtccaataaacctttcttttgtaaattgcccagtctcgggtatgtctttattagcagtatgaaaatagactaatacacaaggagtaggaggctaagatctgtttctactcataacacttctgacatcaaatgtgtgggtttttttccataccaacacccaatgatccaactcttcagacaaccaactgggtgtccaaggacccagttctaacaccaactacccagaatttgcatcagaccccacaggttaagggctcagtcccacaagactgctcccatttcagatgctaattgcaagttctaggtctcctgtacttctaatagaccagctataaataaggggttcccccaccagcacccccatgttcaatggtttgctatgatggctactggaacccaggaaaaaccatttatttactattactggtttattatgaaggatacaaatgtacaccagatgaagaggcacacagggtgaggtcagaagggtcctcagcatggagacatctgtccctgtaggagttagggtgtgccaccttcctggcacatggatgtgttcaactcagcagctctctgagcccatccagtttaggggatttcatggaagttccattacataagcatgaaagattaaatcactggccatttgggatcagctcaatctccagcccctctcccctccctgaaagttccaatcctctaatcacatgattgattcctctggtgatcagcccctatcctgaagctagctaggggcccaccaagagtcacggcatttgcataaactcaggtatggttcaaagtcttattaagagtaacaaaagatgctcctctcacccctctgactcagaaaattaaaatggttttagggcctctctgttaagaactaaggaagaagatcaaatatatattttttcttctatcacaatatcacagagggtctactcagcctcaggcctagccatgttcccagtcgaggtttgaaacccttctttgcaacttgaaaccctgctttggaagtgttaggggtggggaggtgctgctttgtgtggaagctcctttgtcagaatcctggaagggaagaaaagggactggtaggatttgtccgccatgaattcttagatagtaagaaaaattaaaaggatgatacaaaggaagtagcaaattagtctatgcattaaaattggccttagacactcttctgtcttctgatagcaacagcaacaccaccacatgccaccatgaggcacatactgttatcccctttccacatatgagtaagagaaaacagagttaaaacaactaaatatcctgacttgatcattccatgactgatcattctaggcatgttacaaagtctcacatgtaccctgcaaacatgtgaaatagtatgtacccatacaagaaaaaaagttcaaacaaaaattaattaaaatttctaaataaatgtctaattaaataagtaacacagtagagaacagtgggaccaggtaagttccagagagtgtttatcgttgttgctgtttttctttgtgtttttgttgttattgttgttgttgttttttgagacggagtctcgctctgtcgcccaggctgcctctgttgcccaggttggagtgcatggcacaatctcggctcacttcaagctccacctcccaggttgacaccattctcctgcctcagcctcccaagtagctgggactacaggcgcctgccaccacgcctggctaattttttgtatttttagtagagaacgcgttagccaggatggtctcgatctcctgacctcatgatccgcctgcctcggcctcccaaagtgctggaattacaggcgtgagccaccgcacccggcctgttgctgttgttttttaagacaaggtcttgatctgtcacccaggctggagtacagtggcaccaacatggctaactgcagccttgacctcccaggctcaagcaatcctcacacctcagcctcccaagtagctgagaccacaggcacgtgccaccatgcttggctaattttttaatttggtagagtcagggtcttaccacgttgcccagcctggtctcagactcctgggctcaagtgatcctcccaccttggcttcccaaagtgctgtaattataggtgtgagccaccatgcccagccccagaaagctcttacttactgcactattccacctctttgaatgcatgaagggatgttctaattattattattattatattattattatagttttgaaagagaaagacactaaactaaggaggcccagtggcttatctaagccaaaaatagtcagggaagtgcagagaaggcagtgtggtgtagtgggtagcacttgggacttggcccctgaggatcagggttcaaatctcagttataccatgagcttcatcccttcatctgggaaactgagcatcctgacaaggttcagacaagatcatacacatacgagcacttcatgcatgcaatattatgtctggaaagcacagactttgtatgtagtggtttctgttgtcacagctgaccaaccttgagttgacccagtggttctccacccagggtggttttgtcccccaggggaccccgggcaatgtcacaattgacatccagtgagtagaggccagggatgctgccaaatatcctacaatgcacaggacagctccctgtaacaaagaatcatccagcccaaaatgtcagtcggacccaggctgagaaacactggtttggaataaatccatggcatttataacaattcgggagtagagtagatgctcaataaatatttgttgaacatatgaataaataaataatcaagttctgcaacgttgcctacaacgtggttatgtgagagcaatgttagagtaagtaaatgggtggtaaataagccagcaagactgagggataggcaacatccttgctactcaaactgtggtccagcagcttcaccatcatctgcacacctgttacaaacggagcatcccaggttccatcccagacctagtgagtcagaatctgcattttaacaatatccccagagaactcataggcacattcaggtttgaaaactaccatcctagagtctgcatttgggggcaggttatatccaatagcagccctagttccaaccgattagtgcagaaactaaggcctctttaagatcagttctgctgaatcgtccctcttggctataacccagctctatccacaggtggtatttccacctggatactctccatttggataaagaagaacatgtcccccaggcactgagcagggccttctctctctttgttcacaaagtagagcagtgagtataatgaaatatggcacatcatcaataccccctatgcagaaactgcacgggatgctacagctgaaagattccttgaagaggaaaagaaaatggtattgcaacttttatttggagcttgattacttcattgtcttttaccctccgggtgaaggggcagccaagaaaaacaaattctgcatgacgctatgagctcggatccttggttctgaatgctgctcagactttgtcctgtggcaccaggaaaggaaaagaggtgctttgcatcagccacaaagccaaacatttcccccagtcaggatgatcatattcttccttcaactactaacaggtcatcagaactcagtatttactgagcattgactaagtaccatggcactattctgagtattttacatatattaatgcatttagtacttacacaccctatgaggtagaaactaccaaattcttcattttatagataaggaagttcatgcatagagaagttaagtaactttcctgaggtgagatagctaaaaagcaagtggtgaagctaagactggaacccagaaagtctggcttcagagccagtgttcttaacccttcaaccctactgtttacattttagattttataagaataactaagatgaaatctctgctctgatggagtattcagcctggtaaagggagacagataaacagatacaacacacatatcaggcatttagagcaaagacgtactgttgtctccgtttagtaccactcgtattatatctctcatattatttgtccttatttatgtgtttgagacggagtcttgctctgtcgcccaggctagagtgcagtggtgtgatcttggctcactgcagcctctgcttcctggggttaagtgattctcctgcctcagcctcccaagtagctgggattactgtcatgcgccaccacgcctggctaatttttgtatttttagtagaggtggggcttcaccttgttggccaggctggtcttgaactcctgatctcaggttatctgcctacctcggcctcccaaagtgctaggattataggcatgagccaccctactcagcctatttgttcttactctaatttgactcaatgatttagaatcaacaagcatgttataacatgtcaggtacatactagatagtcattaaataatagttgagagaatgaataaataaaataattaatggccaggcacaatggctcatgcctatgatcccagcactttgggaggctcaggcaggaggatcacttgaccccaggagttccagaccagcctgagcaacacagcaaaaaccctgtctctacaaaaaaaaaaaaaaaaaaaaaaaaaacacagaaaaattagcccgggatggtggtgcatgcctgtaatcccagctactcaggaggctgaggtgagaagatgacctgaacccaggaagtcaaggctgtggtgatctgtgatcccatcactgcactctagcctgagctagatgagatgagagtaaaactctgtctaaaaaaatatataataataataattaacaaatgaacatggtccttcaacatgttttcaagaaagtaaggcgctatgtatggcaataggctcttaaaggaaatacctgctttttactttctatccagcactaccccccaacctccctccttaatctgtggaattgcctcttttcccagttcctcccatgttcttcccactggagctataatagctttgcattgcaacacctctggccttagctaactggccatgggtgagctcctgccaatgagttatcttctttgggaattttggaagcaggagaaagaagatcagtacaacttttccaagtagtcaaagctgtacaacgaaaaaaaaaaaaagatatctgttggtcgccacattttcttttttttttttaatttttttattatactttaagttctagggtacatgtgcacaacatgcaggtttgttacatatgtatacatgtgccatgttggtgtgctacacccattaactcgtcatttacattaggtatatctcctaatgctatccctccccgctactcccaccccacaacaggccctggtgtgtgatgttccccttcctgtgtccaagtgaccccaggaaggcagctcgtctgtatcccaagagctccataaagctttatgctaatatgcagctaagagccaaagatgagagatggagagaaattacttctgacatcgttcaagtctctgtttccagacacttaacctctgaggtttcattttctctttcataaaacggagagagtgtgggaggattacatcctgcaaggctacaatcctgctgttcaaggaagaggggctctaaccaggcaaccatgtccaagtaaggggaaagttcactcactcccctctattcaaactcagagcctctagcaccagagtaaaaccagttgaagcaaattccttttgagcttgagctccaccaaacagccctctaattctagagcacagatgatatgccctgactggtgacatgaatgggtaagtttctgtaatgggcatctcatgtttctcatgaacaaaacggcatgctaaatttacacaactggcctcctgtgtcttcggatgccatgagccctttctcaggatctgctcaccaagaggggctcagcattcaaattttgctcccatagggctgaaagagcacactcacttggcttattcataccaagcatctagcatctaggaagatggtttccagacccattacaaggctacgatgctcttcactgaagaagcacagtaccatcagtgagttccaaaagcacatcatggctcattgcaaacagcccttcagattctctagatatctgtttttcacatcttgctctgaacatcctcggaggccactgagaaaaaggaggaagtttaaatgagatggctcttctgcaggcttcaaccgcagcagctccatctgacatgctttaaatatttcagttttgcatatgtcatgtgatacattcggacattttctattttctttcttttttgagacagggtctcactctggtcacccaggctggagtgcagtggtacaatcatagctcactgcagcctcagtttcctgggacttaagtgattctcccatctcagcctcctaagtagctggcactacaggtgtgcacctgtatgttgtacaccaccatgcctggcttttatttattttttttgtgtgtgaaacggagtcttgctctgttacccaggctggagtgcagtggcacaacctcggctcactgcaacctccgcctcctgggttcaaatgattctcctgccttagcctcccaagtagctgggactatagatgcgtgccaccatgcccagctaattttttgtatttttagtagagatggggtttcaccgtgttagccaggatggtctcgatctcctggccttgtgatctgcccacctcggcctcccaaagtgctgggatttcaggcgtgagctaccacatctggccgctaatttttattattattttggtagagacagggtcttactatgttgcccaggcttgtcttgaactcctgggctcaagcaatcctcccacctcagcctcccaaagtgctggaattgcaggcgtgggtcaccatacctggccctactttatttttttttagaatagaaaaagcagctatggcccacaaaattaatatcatgatcccctaatgggccccaacctgaagtttgaaaagcattactccggcatgcccacagaacacgttccagctgggatttgcatccagtgaattcattaggtcaaaggttaccaaccagttcccacagagagcaagggtcctttgaacttaagccccacatgaccggctagcataatgttagaaacaaatcctagaaatttcatctccagaagctctaaatggagacatatacattctaagactctagccttgcttggggagaaaaaaataaatagaaggttatgtggcacagtgtctgtattcccacacaattgcaactagcaggagcggaagtagatgtctgattccctctactctctcccaaaatataagttctgaatggtaagcaatcccaagaccacgtggtctcaccccagggcctccaattccatccacctgccaagcctcctgctgaaaatcccctctcaccatggattctgcaagtctggccagctgtccttttgataaatgccctttgctaagacgcaggtcagtgtaattttccaaaaggttaggaggagtgactgctcagagagggctcgcttattatttcaaatgtcacctatcccattctctaacatttactgagttatttacaacttgattcttgctgtacctgccagtatgtctgacctgctccagtctctcctctcgtcactgtctctatagccctgaaacaggagctagagactaatggccttgcctctgaaagccagggtggtttctaacctaagatagggaaaccaccctaataggtaatttttgcaccaagtcatgccttaaacgtcgatgaaattcacctgttttgaggcatgcatggttgttgattgtttccatggggctgcagatgtttagtccattttcaatttgttcagccagattaaaaacccaatactaatgtttaaactagcaaacctcaaaaagacttcattcatttctcctctaaataatatggggcatttgtttgggtcagtaatttcagttaaagaaactttttggggacaactatttatcccatacgcctgttgaagttataataaaaacagtaacaatcatgataacataaatgtctgtcaagtattcagtgtctactatgcaccaagcatgatgcatggtattcagcctttggctatatataaatatataccgctagagagagttttatatatagttatatcagcggtccccaacctttttttggcaccatggaccagttttgtggaagatgatttttccacagactggggtcagcagacagggtgattgtgggatgattcaagcgcattacattcatcatgcactttatttctattattattacactgtaatatataatgaagtaattatgcaactcaccataatgtagaatcagtaggagccctgagcttgctttcctgcaactagacggtcccatctgcagcgagacagtgacggggcattagtttctcatctaggagctcgcaacctagatcccttgcacgtgcagttcacacagggttcctgctcctacgagaatctaatgccgccactaatccgacaggagacagggctcaggtggtgatgccagcaatgggaagcagctgtaaatacagatgaagcctcgctcgctcgccgctcaacttctgctgtgtggcctggctcctgacagggcacaaactggtaccagtctatggcctggaggttggggaccccaggtttatatggtcatacatagttaatattagttatatgtatagttttatatgtattgttatggttttatatatacatatgatcatttaactcacaacatctctgcaagttagatatcagataattatttcccctttacaaataaacgaaggctgagagcttcagtgactttcccagggccactcactcatgatcagagccaggactagatttcaggactgtccgtactttataccctacccactgcctctcaatcattataccaggaaccatcactttggagccagcatctatgcccttatacacatcaaagcactgagattactcaacaagccaactttgaaaattacctttgtcatgagctttcttttggtctagaataagaattctggaacttgagtgaatctagcctccttcttcccacaggaccaggagatcttggtctcatggcctaacgtcgttgaatagcttgacactggaattagattaaccaggatttgaatcctgctttccccatttactggttacaagatgttgggcaagtcacaaaacctctctgagctttagtttcctcatctaaaagaaaggcaaaagctaataatttctgcctcataggattatggtgtggaaaaagtgaggttctacatgtaaagctcctgtggctggagctgtgataaataaatgttagatactgtcataattaactatctgaaggctgctgcttcaggagctgttagagccatcttacatagcttcattcttacagactgaaatctgtaaaaatagatcatgatacctttacattattgggacaaagtttttacccttcatcccaccctatccaccacccacaatgccaccaccccctcctcctcctctgcggagagaagccatcctccaggctttgaaaagtggggaaatgaaaagttgcagagttgacccaggaaagccccaggttgtgtgtcccaggcttgtcctaagaggtgtcaccttcatctgctctaggaccttctgctcctcagcccacattggtaagcatttccaacccctattagacttactctggggtcttaaaaatatacatttcactgattttactgcgcatgttcttccctgcctcttcttcctcacatgccccttcctcacttttgtatctaggataattaggttatattttgacctacgagtgctcagacctagccagcactatctgctgcattatctgcatcaccatcctggttcagaaccaagtgtgggctggaaggaaggacttcaatgctcccatcccaataaatacttattttctgatcgtaacactctttgtgaaacatcagatctatactggtttcctagggctgccataacaaatgaccacaaacttggaaatttaaagcttccaagaaagaatgcttccttgcctcttccagtttctggtgggtccagggattccttgggttgtctgttttctcctctctgcgtcttttccttatctgtctcttataaagacatgtgtcattggattcaggtctttccctgacaattaggatgatctcatttcaagatcctttactttgctgaacagaggttactagagggtggaaagggtggggcggaaggtggggtataggtatattgtaaaggatataaaatctcagctcaggaggaataagttctagtgttccataacactgtaggatgactatggttaacaataatatatattttcaaatatatatccaaatagctggatgagaggatcctgaatgttctcagcataaagaatgttttagattacggatatgctaattaccgtgatctgatcactatacattgtgtatatcaaaacatcactatgtatcccacaaatatgtacaattatgtgtcaattttaaaaaatgaataacaaaaatattcttaacttgtttacatctacaaagactcctttttcaaataaattaacactcacaagttctaagtgggaatatcttttggggccaccattcatcctattccaagatcctaatgagtcccatgagacctgtggcatgcctttctttcagcatccagctcacctcactccttcaccaaaacaatgccaagaatgagagaaaagcttccattccattccacaagccagatcttcccattccattcccaaactccacattttgcagaaacccaaccctggtagagggggtttggggagtgatatggggaaatagaataaacttccaggaataaaaaggtcccctggtctcctccctaagtcatcggcttcctatggaaaaaggatcactgcatgggacacgctgcccatcccattattcactctctccagcgaggccgaggctgaggaataggcagaatttggcactttccaaaaaacatttaatatttaccttctaggaacaaaatttacattttcagataaatctaggaagtgctgagttaaataaattcaggcaggtttctctattgcaggactggagctctcaatacaatatactatgaatagaggtagaaacaatttgcattatttcctaaatttacaagatcagagaacctgtttatttgtgaggcatctgatggccttagtgttcttccaaatacacaatgggagactctggtgtagatgattctatgcaataagtagctgtcaagccatcagggacatgtaaattaaaactacaaaaatacacctctttacactcactaggatgactataaccaaaaaggcagtaacaaccacaattgtattggtgaggctgtaaagcaacatgggccctcatacttagctggtgggaatgtaaaatggccagttgctttggaaaaaacttggcagtatcttaaaaaggtcaaatttacctatgactcagcagttcccactcctaaaaatacgacatatgtgcacacataaatggttatatcagcttactcataatagccccaaactggaaaaaacccaaatgttcattcaccggtgagtggataaataaaatgtggtatatccatacaatggtattattattagctagtaagaaaaaggagtgaaatactgacacatgtgtgaacctcgaacacattatgctaagtgaaagaagccaaacacaaaagaccgaatagtatataatcccatttctataaaatgctccaaaaagactcatacagagagacgacaactaggtagtggttggcagggactgaggatggattagggattcactgtaaatgggcatgaaggattttactgaagtgatgaacgtattctaaagctgaattgtggtgatggctgcataactcagcaaattaactaaaaattaaattgcacacttaaaatgggtgaatcttgtggtaggtaaactacacctcaataaagttgtttataaaatgtgctatcacggatggatgaaataaaatcgtattaacctacaaaagatacctatcaggctattttctcagccctacgcttgtccaaatgaaggtgctgagcaatcagctttggaagtaaagtttcaagaaccaggtttgtcatcatagttgggaaagttgagcaagctgcataaagtacctaaccatgaaacacctacctgtgttttgaaggaggcattgaggtattttctattgaaggatatcccccatatggaggaatttgcaaactgaaaacacttgtgatgaatccctaatttcactctgtaccctggacaaaacaagacccagcccatagaatttatttaaatggtggaattgattagaattccaggaccaatgcgagagaagttctaagggagagagattgggctctttgatctgcctggttccactctgacttcattctaattagcaaagcttttgaggcagactgataagcattccgggcaccgcacatgtctggccactggctaattaattaatttttgactttgaacagtgacacttaatttgaaaactttctaccatccatggatgaacgtggaaaagtagggcaaaaagatgtaaaaatatgctaaaggtgccatttcaaatccagctgatttccaagagggcaaaatgggtcagtgagttaaataaagagatggactgtggggaagggacaggggagggtgtgctatgccagctctgcttctgctgtgctgtgtgtgtgggcttagccatcgatcctctctgttctctcagtgttttctcagtcattttatttgaaaattaggcgtctcctcggcaccctcatttattgagaaatgactgtgtgcattgcccatagagagaaaaggggcagaaaacaaaaaccatttacagagaggagaataggagggtggacaaagcttataactgcgcagagagtttaagtgaacactgttcagatcagaggtctgcaaaccacatcccaaaggccaaaccagcctcctacctgttttcataaatataatcttgttgaaacacagccatgcccaatttgtatatacgttgtctagggttttcatgctactatggcagagctgagttggtatgacagaaactgtacggcccacaaagcagagaatatgcactctgtggccctttgcagaaaatgtctgtcagcccctgatctagatggagtcagaattatgccttcttggtgtaagtaactaaagggacacccagaaatctttttttttttttaatcttgaaagcgcttctttttctaacaaggagggagctaacgtttttcttagcacctctgtgtggctggtgcaagggccctttctcaaagattagcctcatcccaaatctttgaagtaaagatgaacatgcttatgtcagaaaaggcaactgagaaagctaataacttacctgcaagttacagaactaatgtttaaaccagacttacttatctgcaatatgatgcctccctgctatgtcaacattaagaggaagattttggcaagagcctctgtctgacattccctttgtaagggtcaaagggctttgggaatagactttagagtaatatatttgagcatatttacgcaatcatctgtgtgcccactctatactccaagcttggagagaaacccttctattaatccccctttcaagcaggtctaagtatcccagaccataatatttaacaaacctttatcaaacagttggggacttcaaaatttttcacagagagaaactcatcgctgtcactggagttactgcctctccaatggaaactctaaaaatttaggtccttaatctccctagacccagatgtaaaaagaagttccttcctctctcagcccaaggtcttatttcccgtatcaggatggatggccataggaacagaccctttcttcagaagacacccccactccaaccacacaatggtcttcatcctccaaggtacagacaaggcattcaaaacatctacagagtacttctaaaagcatggttcattcactaccctaagggctatgccaagactagtctaactcaagttcaaagtcctttttccagcctaaaatggagacatcaggtctgattatatttccctctcagcaagactctgttcccctgatcaactataaacaaacttttggaaaaagaaacccagacttctcgcaagcaagtaagcttcaggtatcattcaaccgaaatccaatttgagagagtagcaagtttcctctaactccacaaaggcacagtcctgctaaacataatctcatttttcatcattaaatagaactctgagtatttcaggctgtagcttctgcatttaatattgacaaagattactaagagctcatatggcacccatgtgcaaattagaaaacagcacctcctctcggcaggtgcttctgttaaaattaaagtggtcccttctctgggtgaagatgccccacccacactgggatgcaaggctgggcaaagagagcaagggctgggcttcaatgtcaccattgtgcagtgagcaacctgcgcagccatccatgactgtacttggttttctcgaggaacactagtcattttctttacaactgggccttatatccaaaggcccattctgatgactttcataaacaaagttgcctgtaaaatgtaaaattgatatccacccctaaagaaaaacaaatgttgagatttttctacaaaataatttgaacaacctgagttgaattcacaagtcagccaaccgccagctgtgtgattagacaaattccctgttcatccataaaacggaggcatcaatccccgtactactgagatctcaggaatcccagcactttgggaggccgaggcaggcagatcacgaggtcaagagatcaagatcatcctggccaacatggtgaaaccccatctttactaaaaatacaaaaattagctggacgtggtggtgcgctcctgtagtcccagctactcaggaggttgaggcaggagaattgcttgaacccaggaggcggcagttgtagtcagctgagatcacgccactgcactcctgcctggtgacagagcaagactccatctcaaaaaaaaaaaaaaaaaaaaggaatacttaaaatctctaaatagacaatgcaaaatgacttggtaaacataaaacggtctgtggatattaagcagtaaccacataaaaagacagaaacagcaaatggtatcattggtgcttccatggaaagacatttctcttattcttgatgtttttggccacagtattcttccagcaaaaatctgagaagggccattacttgtccctgattttccaaaaaggtcatccaagcaataaagggtttccaatgtggaagataattagctcccagagccttcccattccacctgatcaattagactaagtactaaacactcccaagcctgaagtgcataaaattgaattgtatgtatgctttcctgttatagaatggtaatgtgctgctttcagaatctctcacacgagctgggagtaatcggaaatttttttttcaagctacctccctgcctggtgataaggcaccggctagctggatgtgtttgactaggatttttaatttcttgggggggaaaaaaaccaacaactgcaatatgggtttttgtttggctcatcagtgttgctttaaagacttctgtggaatgcccaaattgcaactgggctgtcttaacagtgccttccaccgctggaatctgcaatccagaatcagtgactgtgccggggatcagcaccaaacgcaaggccggcccatttttctttgtcaaacgctccccgtgacaggaggagatgttagacagcagtgcaggatttttcttagcaacccacccaagcatagatgtacccctctctcctaggagacaagttattaaaaagatgtatttttgaaagcaaccttctctgcatgcaacatcagtgtcaacaaataaagggggagggaaggaaaggcaaagggggagggaaggaaaggcaaagggagagctgtccagagagaggaaggaaaatgcctctgtgggcacagtttaagaaatgatcaatgcatgtgtcaaaggctgtgataagacacactgagcttatcaaaaacggaagctccaatgacagagttcacatgtgacaggaagataagagaagccgggtttttcctctccctcttttctctccccaaagaccctgttttaatttcccactctgcatgttacattttcaggcccaacagagaccacctaacctcgttcaattccttttctaatctcactgtaaatgtttccaggagactctgatttgcagacgctgacctcagtgatatttggggaaataatgtgcaagtccctgttggagatccaaaacgcagctgaaggtttcagaaaacactgaacatctcaaaaaggagtgttaagaacactgagctggaaattaaacatgcacatacatcttggctcgatcataaacacactctgtgttcttgcataagtcacatcacctaccagaaatggagtctcctcttctgtaaagcagggagagatggactgtgctgtcctatcgagaatatatatatatatattttttttttttgagatggagtctcactctgttgcccaggctggagtgcagtggcacaatctcggctcactgcaagctctgcctcccagattcacgccatcctcctgcctcagcctcccaagtagctgggactacaggcacccgccacctgtattttttgtattttttagtagagacggggtttcactcagagatgtgtgccttgcccacggacatctggccttggaacttaagttgatgtaggcctggcttcccattgctggcatttgcatctctctgcataagggccctctcagctatgggagctccctccattcacacagaaggcagaacagaagtgccagtaaattgatggtgcccagcaatcacattactgagtatatacccaaaggattataaatcattctgctacaaagacacctggacatgtatgtttattgcagcactatttataatagcaaagacttggaacaaacccaaatgaccatcaacgatagactgaacaaagaaaatgtggcacatatacactatggactattatgcagccataaaaaagaatgagttcatgtcctttacagggacatggatgaagctggaaaccatcattctcagcaaactaacgcaggaacagaaaaccaaacactgcatgttctcaatcataagttggaattgaacaatgagaatacatggacacagggaggggaacatcacataccagagcctgttgagtggtggcgggcaaggggagggagagcattaggacaaatacctaatgcatgcggggcttaaaaaacctaagatgacagattgataggtgcagcaaatcaccatggcaaattgttacataggtttgttacctatgtaacaaacctgcacagcctgcacatgtatcccagaacttcaagttaaaaaaaaaaaatgtgttgcccagaagcagcacccaaccaatgaagtcccacaaagacaaacaggatgcttccagaggtcttcagcgaggctaaactccagttgcccagagcagtacttggtgacatcctttactggctgccttcccttccctgtctcacattctaacccttctccccgcaaagtatgtcctgggattaccacccagacatactctctgtcttgtatctgtcctgagatctgctttggaggaaacccacattaaggcagtgagctaagagttaacttcaggcattaactttacgaaagagcatagctgtatcaatgttcaaagaataatggaaatgttttccttaaattccctttcctcaaaacatgcagctctaattctttttcccatccaactccacattccattcataacacgaataattctgcatatttgtggagaagttttaactattcaaagtacttacacatttaaatgtccctttgaaatttacaaaaaaaaaaaaaatctgcaaaatgggagaagcaatagcattaacctcttggtaaatgagataaaccttaaaacacaaacccagagaagtgagttaaactacacaaggtcacacaccatattgatctccgttctctttctggcctcagtggcaccactctttggggtggcatcacctgttggggatcattcagtctcaggagtagggatgggttagagtcatttacaaagcccactgcaccccaccagaatagggacctactataagaaccctttgtgaggactgtcattttctatttccactcttgcacaagtgattactctagaaggggagaaaacagctgttccgataccacccttgatgagaaagaaactgattgagctagaagtttgctgagctagagccagtcaataacgttcaattctttatctcctattcatggagtcccaacactttcaggggcaagatgcaagtgaatggagcttctttgatacagtaattcagagaataggacagtgtattcacaggtttaaatgtcaatgatgaagactaatacaactgaagaaaaatgagccttgtttaaaacaaagagagaagttctcaaactttagcataaatcagtatgttacctggagggcttgttgaaaccccgattactggcttccacttcagagattttgattccagtagatctgggtagggcgtgaaaatctgcatttttttaagtttctaggtgaggccaaagatgcagtcctggacactacactctggggcgtcactgctttaagatattactttccaaatctgatgtgcatacaaataacctggacctatagttattatgcagattctcattcaagaggtccaggctgtctttcttttttctttttttttttttttttgagatggagtctcgctctgtcacccaggctaaagtgcaggggcccgatctcggctcactgcaagctccgcctcctgggttcacgccattctcctgcctcagcctcccaagtagctgggactacaggtgcctgccaccacgcctggctaattttttgtattttttagtacagacagggtttcaccgtgttagccaggatggtctcgatctcctgacctcgtgatccacccgcctcggcctcccaaagtgctgggattacaggtgcgagccactgcgcccggcctccaggctgtctttctaacaagcctccagtgatgctgacgttgccagtctatggaccacagaaagcaatgagactccaagccaagtgtctctcaaagggatgttcaactacccaccatagagtcacagcaagcttattaaaaatgcagaccccagaaggaagactggttttagaccattcaagctattataacaacttaccatagactgggtgtctcaaacataaatgcactgttcacagttctggaggctgggaaatctaagatccaggtggtggcagattcagtgtctgtctggaagtcccctggcttacagacagctgtcttttggctatatcctcacctggtggagggagcaaggcagctctctgaggtctcttttgtaaagccactaatctcattcataaaggctctaccctcatgacctaatcacctcccaaatgcccccacctcctaataccatcacattggggattaagtttgagcatttaaattttgggaggaacataaacattcagtctacagaaagacctactgaaacgctctagtcacggacccaggaatctgcttttaacaagcatattgagtgaccctagaattttaattcatggccctatatggtattccccagccttgaataattataagaatgacctgatgcatatgttaaaatacagattcctggccaggtgtggtggctcatgcctgtaatcccaatactttgggaggccgagtggggtggatcacttgaggtcaggagctccagatcagcctggctaacatggtgaaaccctgtctctactaaaaatacaaaaattaaccagtccttgtggcacctgcctgtagtcccagctactcgggaggctgaggcactagaattgcttgaacccggtaggcagaggttgcagtgagcagagatcgcgccacttcactccagcctgggcgacagagtgggactccatctaaaaaaataaaatacagattactaaacctcaggttagacttactaagttggagtagttcaaaaacaagcctgggactctggactgtgttaatcttccagatgagaaaaactaggaaacagtctgagtgttagtactcacctgcttttcacagtctgggtaccacaatcttccctttaagctttcataggatcctcccaacttagatgtcaacatataacaacacgtaaaggagttctttaactccaaaattctgacaaaaagtttagttgagaatgacaggacccatgctataaacacacttgccatacagacttctggacgatacagtataaagactgcacagtgggttagcacatcagtgcccagttttgtctctctgcaagcagggccatctcaggggcttgccttaagccctggctctcttaagtttgcaccaaagatgggattatttgagtgccttggactcactaagttgcagaaaccctctaaaaagggagaaagagagagccagtaaccctacttagctttggggtgacacagtcttcatgctggagactagctgggatttttagctgagccagagtgagttgggtcatcatcagttggacatccctgtggacatcaagtcagtttccctaaccctgcaaatagagaaagagagtgggaggaaagaaaggaggaaggggaagggaggtgggagacagaaagaggaaattgtgccctcattacaagatgacatttggaataatgtagaaattgaaaacaaacgtcgaacaacttgcaaattgcattttcctgggacttttctcttggcatttttgtttgtttgctttaattgaaagctgtgtgtttcaatgggctcacgtggcatgccatgatcagttattccaaacgacttgggctgcatgatgctctgtttcttgtcagttgcagagcacattttctgtttcaggaactacagtacaatcactttctaactatcatatagcaccgaaatggcttcggcactcaggtgcaatggcacttcctgagtgattgggagggtcgtgcctgggtcaaagatgcagaggggccatgaaaggcagatggcttcctgggtcactacctggggaaaaaaaaagtcagaaaactgaactgaaaaaaccagcttcggggaacagaacacagtactgaggggtcctctgaccctatagtcagaaaagcaggacaaaagcctaagaatgtggctggagcattggaggaattgaggcaagaaacaggtatgaagccacttatgttatttctagacaggttccaaccaccccatcatcttttatgttcttgaaactggaagcttgtaccaatgcatcccccaaatgggaaaagttatataagattactgaacccaaatattaattatttttaccttaccacaggtaaaaacaatttaaagaacacacacacacacacacacacacaagatttacttactgtgataagagttgatacagaaattgctatatgattgacactggaccaataatctgatttactccttgcaaccaccatacaatgtaggtattatttctgttattgtttccattttacaaagccaaaaaaactgacactgaaatagtttatccaaagtaacaacagaagtcataagaggcaaagcagagaccaaaacctgggctgcatgaagccagaggtgggctttaggtatgtatgcatttatttatttatttttgatagagacttgctttgtaactcagggtggagttcagtggcacgatcatagctcactgcagcctcgaactcctaggctcaaaccatcctcctacctcagcctcccaagtagctgggaccacaggcacaagccaccatgcctggctcaatttttactttttatagagattagccccttgcattgttgcccaggctggtcttgaagtcttgatctcaagtgatcctcccacctttttttttttttttttttgagacggagtttcactcctgttgctcaggctggagtacaatggtgcaatcttggctcaccacaacctccgcctcccaggttcaagcaattctcctgcctcagcctcccgagtagttgggattacaggcatgcaccaccacgcctggctaattttgtatttttagtagagatgggttttctccatgttgaggctggtctcgaactcctgacctcaggtgatccacccgccttggcctcccaaagtgctgggattacaggcgtgagccactgcgcccggccctcccacctctcaactactgctctaaattcccttcagtaataagatgcagtcagaaatgggaaaccccatacattgctatttataaatgtaaaacggtacagccactttagaagaatagttctgcagtttcttaaaatgttaaacataaatttcccatatgtagaaagaacccagcaatatcactcctaggtacctacccaagataaatgaaataatatgcctacaaaagacttttaggcaagtgctcacagcagcattaatcacaataacccaaaactggaaacaacccagatgtccatcaactggtgagtaaattaacaaaataggttaaaaaaaatgataaacaggccgggtgcggtggctcacgcctataatcccagcattttgggaggctgaggcaggtggatcacaaggttaggagatcgacaccatcctggccaacatggtgaaaccccatctctactaaaatacaaaaaattagcctggcgtggtggcacacacctgtagtcccagctactcgggaggctgaggcaggggaatcacttgagcccaggaggcggaggttgcagtgagccgagatcgcgccactgcactccagcctgggcaacagagcgagactctgtcttaaaaaaataaataaataaataaataataagaataagaataaacatacagtggaatacaattcagcaaaatcaaggaacagaacactgaaatatgctataacacacatgagcctcgaaaacatgctaagtgaaagatgcccaatgccagagaccacatgttatgtaatttcacaatatcagaagaacaaaatctatgagacagaaaatagatgactggttttgggactggtgatgagaaatgcaagaactacgaagaagcacaagcgatcttgttagggtgataaatctgttcttaagttgggttctggtgatggttccacaattctaaatttatgaaaattcattaaattgttcattcaaaatgggtgaattttatgatacgtaaattatacctcaagggagcttttttaaaaataaaaatataaactctaaaaatttaaaaagaaaataattagaaaaaaagaaatgggctgggcatggtggctcacccctgtaatcccaacactttgagaggctgaggcaggtggatcatgaggtcaggatttcgagaccagcctggccaacatggtgaaaccccatctctactaaaaataaaaaaaattagttgggcatggtggcgggcacctgtaatcccagctacttgggagactgaggcaggagaattgcttgaacccgggaggcagaggttgcagtgagcctagatcgcaccactgcactccagcctgggcgacagagcaagactccgactccggggaaaaaaaaaaaaagaaaaagaaatgaccattgtacttgctgaacacttgatcatgatgtcatttagtctttgcaaaatggcctccgttctccctcctcaagtgctatgatgtcacctcaggcacaggaattttcattcttttaaaacagggtctgacatgcaggagccactcagtaaatactcgctgcatagagcaagatgggcgacaggcagacacggattcatatcttgactcagttattgcagaatcatcagtttacttatatgacttaaatatattacaatgagtaataatacctatggcagacgttgctatttggctccccaatatctgtttcaattcccctctcttgccaccttccactatagcagctgggaaaagttactttctcagaggccccttgcagccaggtgtggctcattagactttaaatgactgtgtgtgtcattgtcgttggggatggagcgttaggagagtgattctggaaaacatttttactctactgataaaacgaacagtgcagctgatgccatttctgcttccttcttcctgacttgaatgtagatgtgatttaaggaatgcagcagccattttgtggccatgtggaaaatatcacaaaacaagaagttctggcctgtcattgctttggtttataactctttccttttgggtctcccaaaccatatctaagttctattattacatgactggaagagtgaggggcacctctggacagcccctgctttagcctcagttctaaatatccacttagtccctcttttcatggattcattggaaaatccgaaagcagcagtcccaatgggaaataaatgggtctaatttcagaaaagacaagcccatttctcttctccccagcaatctcataatactatggtaataaccaataatgatagcaggtaattaatacatattcaccacgatcaatgtctctcaccataatcccattcgtctatccatgatctttgtggaagaggaaaatttcactgtgagatattccagaaacaagcaaatggtccttccactggctgcctcaatgtcaattctctctgttctttcagaacaggaagtcagaacaccaagcaatcacaacagcatgaaggtctcctgccttgctctacagagggacatctattgttctgacctccagcaggtttgatttaaactgacagagacaggttccctttaggcacctgggagaatcatgatgcagaaggtcctggaatctgatggtaatttccagttagtgatcaggcagaatgaaatccatggtgcagtaggatgcactcctagaagacagctgagattaaagaatgggacatggagctgggcacggtggctcacgcctgtaatcccagcactttgggaggccaaggcgagcacatcacctgaggtcaggagttcgagaccagcctggccaacatggtgaaactccgtctctactaaaaatacaaaaattagccaggtgtggtgatgtgcacctataatcccagctacttgggaggctgaggcaggagaattgcttgaaccccggaggtggatgttggatgttgcagtgagccaagattgtgccactgcactccagcctaggtgacagtgagacttggtctcaaaaaaaaaaaaaaaaaaaaaaaggacatgggaagaagaattgggagagagtagcgagcagcttctgacatggcctccaaggacccccaccccctggtagtcttgcccttgtgaaatcccctccccttgcatgtgggccagaccaagtgactcacttctaacaaacagaatatggctaaagggatgtcatttctggtattcggtgtcttagtccatgtagactgctataacagaataccagagactgggtggcttataaacaacagaaatagttctttctcagctcacagtaagtctacaatcaagatgatactggcagattcagcgtctgatgagaactcacttcctagttcaccaatgggcgtcttttcactgcatcctcaggagacagaagaggctaggaacttccctggggtcccttttaaaagggcactaatcccattcatgagggccctgtcctcattaactaatcacctctcaaaggccctacctcctagtaccatcgtcttgggcattgatttgaacataggaattttgaggggccataaactttaatccaaggcattggattacaaaagactgatttccatcctattattctgtctctagctctactcgtgcttgctgtctcatggtgagaaccacattgcaaggagttgagagcagcctcgggctaacagccaccaagaaactgaggccctcatgctgacatctcatgaactaaatcctaccaaaaagcagagtgggcttgggaacagatactgtcctagttgaacctgaagacgattaaggccccaggtgacaccttgatgaagccagtgagaggccctcaagcacaggacccagccaagctattcccagatcctccacccacagacactgtgtctttaaaaactgctaagtaggccgggcgtggtggctcacgcctgtaatcccagcactttgggaggccgagacgggcggatcacgaggtcaggagatggagaccatcctggctaacacggtgaaaccccgtctctactaaaaatacaaaaaattagccaggcatggtggtgggcacctgtagtcccagctactcgggaggctgaggcaggagaatggcatgaacccgggaggcagagctcgcagtgagccgagatcgcgccactgcactccagcctgggcgacagagcgagactctgtctcaaaaaaaaaaaaaaactgctaagtgttgaggtcctttgttaccacagcaattgacgcctaatacagggaatgagtcatggggatattttttaaatgaaaaaaactccacatacacatgaatgaatgagtactcacaacctttcccttttccacactctaaaagggtttttggttcattctgtttgggggttgtttttgtttgattccgctttgggggttttgccttttgtttctttgtgctcaagcagctgctgatcaaatctgagcatttcctgtgttaatgagaacagtattggtaattattattatgctaatatttcatcagcgcttatagcaagccctgtgctgagctttgtaagcctcacaacaacccagtgaaaaaaggtaccagcattattcttcttttgacatttgaaccagagcaactccatcttgaataggagctggctaaaatgaggctgaggtccaccgggctgcattcccagacagttaaggcattctaagtcacgggatgagataggaggttggcacaagatacaggtcataaagaccttgctgaaaaaacaggttgcagtaaagaagccggccaaagcccaccaaaccaagatggcaagggagtgacatctggttgtcctcactgctacgctcccagcagcccgtgacagtttacaaatatcatggtaacgtcaggaagttaccctatatggtgtaaaaaggggtggcatgaaaaattcaccccttgtttagcacataatcaagaaataaccataaaaataggcaaccagcagcccttggggctgctctatggagtagccattcttttattcctgtactttctcgataaacttgctttccccttactctagggacttgccctgaattctgtcttgcacgagatccaagaaccctctcttggggtttggatcaggacctctttccggtaacactttcacacgtgaggacatggaggtttagagtgactattcttgcctgtgtcacttaactggttagttgtggagccaaggtacaaacccagggaacaagactctacctcttcaccatatcactgagctggacagagctgaagcagggaaaagtgacagaaaggctagaatgacttaccctggaaaggtcagggagcttctctgacagattaaagaaatatttaaaaggatacagtaaggggacatggaacacaagagctgcccacagctaagtttatgagaaaagtcagaaggagggagatttggaagaaactaataaggaattggactcactgcccagcaggctaaaggagctggaaaagggagagagggaagatagatgatagcaaagaaagaagggagagggaggcaaagaaagtgagggaggggagagattgattaatttagttatacataatcctgtgcatgagccctttcagcagttttaagagatgcagtcaacactgaagctgagaggtgaagccagctgggcttgtgggttaggtggggacttggagaacttttatgtctggctaaaggattgtaaatgcaccaatcagcactctgtcaaaacggaccaatcagcactctgtcaaaacggaccaatcagcactctgtaaaacagaccaatcagcactctgtaaaatggaccaatcagcaagatatgggtggggccaaataagggaataaaagcaggccacacgagccatccgcggcagtaggctgtggaaggtagttcttttctgttttgcgataaatattgttgctgctcactagttgggtctgcactacgtttatgagctgtaacactcgctgagaagttctgcagctttcctcttgaagtcagtgagaccacgaactcaccagaaggaagaaactctggatacatctgaacatctgaaggaacaaaccccggacccaccatctttaagaactgtaacactcactgtgagggtcagcggcttcatcctttaagtgagcgagaccaagaacccaccagaaggaaccaattccggacacaaaactattttcactgtacgagatgggcactgcaccaggatcacttttgctcccttcattctaggagtttctctgtgtatcgtttctaagatgccctctatttctttgactgttctttgtcttctgtgtggatctgagcttattcttaattatctcccattgatgccactgtcaccaacccagtcccaaccctcaccttgtctctcctgcattatttcaacagtctccaagaaagccttcctgcctccagtcctatccatggccttccttttttgtagactagtgccaagcaatgtaactgaagagacaaatctaaccaggatgttgctctgcttatttaaaccatcactgattccctgtttcacacagaatcaattccaagcttcaaatcattatggaaaagatcaccacctcttgtttgggctacagcaatcgtctctaagtggaacaccaagcagtaaacagtaaatcccttcctcacctcctgaccaccacccccccctgccccgggggcaggatacctctgcagaatggaaaagcaatcatgtcccttccttaaacttccagaggtgtggtatgcatgtgtaagcattacacattgcaggctcaagcttcatcctgtacaatttgcaagtaaaaaaaaaaaaaggcagcaaactttattttccccgatttcatcttgctgcaagcaccattctgctaggtagtatgaaaaacactaaacatgccagttttgatatcgtcatctcaggaagtttaaaacggccttcagttagtacagactctttaagataaatattcaatcatcccaaagatttaaactccgtaccagggctgtttcttccacacaatgtcacacgggtataagaaaatgtgtgtgtgtctttggattagaaggaggcctcaagtctaccagacacatcttgggacttctctggttttttcaacagtacaggcagactggcccatcgctgctgtctctcaatgtttggggtatcacaggaggaggacttgttgaattctgtgattctggccactctcctcgtgttacaaagtccctatctacagagtccttgctctgaccccagtggcagtccatgggttctctcagaatctccacatcactctgcagggatccaggctgcagggaacccgtccacccgcattccttcgcaaaactgaagggggtttcctaaaggatggggaagtgaaaatattcactttgtaccacagaaaatgaagaaagtgcccaaccgtgctctgaaaggcctcaagacttagcttccagttttgtacatcacttctagcgtatcgtcttagagagggcagtcaagacacgtatatttcagcatttttcttttttcaagacagagtctcactctgtcacccagactggagtgcagtggtgtgattttggctcactgcaacctttgcctcccaggttcaagtgattctcctgtctcagcctcctgagtagctgagactacaggcatgcacaaccatgcccggctaatttttgtatatttagtagatatggggtctcactgtgttggctagactggtctcaaactcttgacctcaggagatccacccgcctcagcctcccaaagtgctgggattacaggcgtgagccacctcacctggccagcatttgtttcttttgacttcaggtcctctctgaggaccaaagagccttcctcttgccactcagcacttcctctagcgcctccaggagctggggcatgaggaggatctgtcatgaaactctatggtctaagttggccaggcttgcacattggtatgcgaaaaggccttttggaatttagaaagggcaaacaaatgcagaagcatttatcttgtaataaagtttggctttaaagataattgtcttgccatttcctggagaaaaaaaaataagtcatctttgaaactcaacattgaatgatgagctttgttccattccatagcgtcctctccttccctagggcaatgtctcatggcttagcttttgtaacacaaggagtgccgagaagaaagaaactggctgttaagggagtaattaatcaccaagaggtatttcaaaaacattaaacctatcatatttgttgtgtgtacagtttgtacatatgtgtgtgtttgtgtgtatttgtacacaaatggtccatgttctacaccatgggtttccaaactatgccccacagtccaagtccagcctgcctcctattttttgttgttgttattttagtgtgttttacaatttttttaaattgtgttgaaatacacataacaggctgggcatggtggctcaggctgtaaacccagcactttgggaggccgaggcaggtggatcacgaggtcaacagttggagaccagcctggccaacatggtgaaaccccatctctactaaaaatacaaaaattagccaggcatagtgctgtgcaccctgtaatcccaggtacttgggaggctgaggcaggagaattgcttgaacccgggaagcagaggttgcagtgacgtgagatcatgccactgtactccagcccgggtgacagagcaggactccatcttgggaaaaaaaaacacacacacacacacaacataaaatttaccatctaagtcattttaagtgtacagttcagtgtctttaaacacactcataatgttgtacaaccatcaccaccatccaactctgcaattcttttcctcttgtaaaactgaaactccatacccattaaacaactccccattttccccttccctcaagcccaacaaccaccattctattgtctctatgaatttgaatataagtacctcatacaaatagaatcgtacagtgtttgtcttttgtgactcgcttgtttcacatggcataatatcctcaaaattcatccatgttgtaatgtatgtcaggatttcctaaggctgaacaatagcctattatacatacgtacgtagcacatcttgcttattcatccatcagtggatgctctcacattttagctattgtgaataaggttgccacggaagtcgatgtaaaaataatccctttgagaccctgctttcatttaattattttttggtatggctagcaagccgagaatgatttttacattttcagatgattgaggggagggggaacaaaagaagaagagtatttggtgacatatgaacaacttttgaaattccaagttcaatatgtatgaagttttattggaacacagccatatgaattcctttgtgtgtcgtccatcgttgctttcacacacgagaaaagaaaccatacagaccacaaagcctcttactatctggtcttttaagaaaaagtttgccaaccccttttgtatactggttggcactttgtttttttatcttaaacatatgttggagatcatttcatatcatactcctcctacttgagtctacttctttcaaaaaggttgtttcagaaatttgctgttacaaacaacaccataatgaatattctaagacatctagccttctatatataacatgtctctctctgaacctcccatcccctacatacacacagacacagacacacagacacacacagagacaaccatgagccccttgaaaacagtgacctcatctatttatctttatggttccagagcagaactaaagaaaaacatcaattgctttctttcaatacatttgtttttttataaacataaaattaaagactacttagaatcctctcaaagttgaacatggttcaaacaaaagaatttgaacttgagaaaatcctgcatttttttagtatggaaatctatcttctccaccattctttgtattcctatttgtctcctctgccttcttttttttttttttttttttagcaatttgacttatgtttagcagccattccccaagatagcatattcctctgtgacaagatttaattaaacttccagcaaaataattagcaaggctatcttaaaagaccattttaaaataccagagtgataccaaggagtgaatagagttaacactgtcatcagagatcaaagccatcagaagacgtgactgaaaatttaacctccagcagccgcctgatgaagaggtacacattggaacagttgtgatagcctctctctcgggtcccatcgacaaattcatttgacatggaaaatttcccaaaggaagcttaaaaatggtaaatttccattaattacatagcaaagaatgtactcttcatattttattatccattaggaaactttggaggaaggtgtaactgcctcttataatgtagactatccttctttacttggggatactgatgagattagcaaacagcttctcaactaatgtgaagacttatttggagaaagacactttgtaaaaactaccttgactgtgatggtggtgaccctgggaatggttgtggtggctatcttggcgaagagccccatggcgatggtgacaattccaaggctattagcttggtgcaaaattgcagttgtcattaaagtaataccaattcaggacctactaccctccacctggaatctcggagagaatgaaaaaagctgaagggatccaaagctagaagacttatgttcgagcctctgctccaccagtcagtcactctgtggtcacgaggaagtcccttttcctctttaaacctcattattcacctgtacactggctatctggtatggtttggacctgttcccctgcaaatctcttatcaaattataattcccaatattggaggtagggactggtgggaggtgactggatcatgggggcagtttctcatggtttaacaccttcccctttggtgctgtcattgagatagcgagttctcatgagatctagttgtttgaaaagtgtgcaaaacctccccactctctctcttcctcttgctctggccatgtgaggtgcttactccccctttgtcttccaccatgactgtaagtttcctgaggacttcccagaagctaagcagatgccagcatcatgcttcctgtacagcctgtggaactgtgagccaattaaacctcttttctttataaattacctagtctcaggtattttttatagctgtgtgagaatggactaatacggtgtcatactctcctccttacctgttttgcacagttgtgaggataacaagagatgttgttgatactcagtgtgatggtgactatagtgattctatacagcaaatcctattcttgtctttttcaccgtcttccatgaacatatccacctacaggcagccccaagagatctagaagtggaagaacaaaggccagattctggttactttgcaattaacacagagatatgggggctctcatttcttccttacaggtcaatagctcaatatggtaccttaattcttttcctgtgttaggaatatattcataaagccttatttactctttggagatgtagtatgaagtacttccaaacagtactacttccaataattggtggtgaccaattattgctctttttatctctaaaaaactaagaaaatcctagttatcatttcataaagagatattaagactggatatttaagcatttattgtgtatcggccatggcactgagtacctttgaagccagtatcattattattctccattttatgaataaggaagttaaggatggtgcatatttttctgcacctgcaatcttttaaaaaaaaaaaatccctgcctcacacccactatgcccttcccctctacctcagtcactgttgttcctcttaccaacatcaactgccccatgaatcagagatctacagaccctgttcctagtaacacaccttaataagcacttaaacagtccaatggactagcgcatgtaatggacctagcttgttacaaaaaccacaatgaccgtttagtacatggtagctgcaatctagccctgtggtccaattcaggagcttggaattctgcattcttggttcaaaccacttataagaagaaagaccttagccaaccaacgttgtcatttcttcaagactcgagttcttcatggagataacaatatatccactcactgggttgttgggaggattaaatgggttagatacatgtaatgtgcttcggaccctatctggtactgtaagcagcccatacatgcaacttccactactattatttcctgacaatgcaaagcttctattaagtgagtttttttctcctgatgtgctgtgttcattccagataaaccaaattaaccttaggaagcttattacctttaaatcttgattgcaaacatgctccctcccctctggcaagactctctcatcctctcaaatcctctgttaatatttctgattatttttttcttaaatagggttagattgttttcctcccaacaagctcagtagaaaaatagacatgagggaaaatctgttttagccattagctgtgtctctaatgctgccagcgacctcggtggggcccttgctgaccctccttacctcccatctgcatgcagatttcctttaattttaataaaaacagtaggaggtcaatcgaccacagcctgtgacctcgccaacaaaacaagcccccaacatgggactcaaagttcagggagcttccaagtgcaatttaaaataaatgctcacatagagctatggtcagcactcggaatttgtctcaaagtgatttgcatatttagaacaatattctccaatgctttggcccattggggagtgatttgcattcagggaggaaaggctaatattctagtcttagcaattattgaaacacatccagtcggtactctaataaattatcttaacccaattactaaaaacattgcaaaacattactgtgcatggaagaccgttctgcccaggaatctttattggcagggtaattaaaagcgtactagctatggcttctgctcaaatatttggggatgttttgtgccatttgaattagctctcttggactgagaaaagagatatctgacaactacttgctttatttatctctgccttccccacctccttgctttggggaccactcataattaaggtccccttcccacatcaatgccacctacaacttccttcctaccctaatcctccttgcagaaaaaagtacttacataggcccagtccctccccttcatgcctgctatcttttatcaaagcaaaagattttgttagccattatgtagtgggtgcctgctatacatcagaagcttctgcattatgagaataaatcctacagtaacatttcggggaatggtattcctattccatgcatgagaaaagtgaggattaaaaggttaagtgaatttccaaagttcgcacagctgatgagttgcaagatcaggatcaaactaagggctggtggttccaaggtcctcctttccttccccaacaaggatttatccactgcttatatgtgccaggtaccatgctaggccctgggaataaggtaggaacgacatcaggcagactccctgcccttgcagatttttgtatccattcatccatcctgtgtatcagtcagggtacctcagttatgctgatgtaacaagcccaaaatctcaatgggaagtaacaaacatggctttctcattcatgcttcatgtccatgagggttgacttagcaattcacatgtccacatctacctttaaagtaggtgggaaaatataatcctaccagaggactggaagtcagaaagttggaaatatttgataaaaagcattaatgacaacctcagctcctgtgacaaaggggaaggagtcctttttcagaacaggagctaggagctctccagtgaatttacaatcaagctgcaaagctggccgagttccccagcactctacatacaaatccgacattcatctccaaacaccatctttgtcagaccacagagacccctggcatcaaaccctgccatgatcacagggacatgcaacacacactccctcataattaggctcatcttcacaccccccagcatgcgccaggcagctggaccctgagccaagatatgagggtgcaaatgaatccagcctggagcatagaacagaggtggccagggccgctctgcctgttgaattaactctttagaatcacttttttttttctagatctgggcgtctttggcagacagccacacagatatggttctccctccatctcattaatgacatggtttgctgtaagttctcctttcaccacagcctagacactgggctcaaatacatcatctaatttaatctgcacaatgatgcagacaggaatatactaatgacttcattttacagataaagacacaggatctgaaagatgaaagaaacagctcaaaaagtggcagagcaagcctttgaacccaagtctttgtgattcctgaatacacagcagcctggagctgccagattcttggtcaggagcatcataataaagactctgactccatgaccctttgtgtcatgggctaaccaggacaagagacaaacaaaatgttccaggatccaaaccagaagtgactgatcccaattctagtccaaatcccccggcatgcaacgtgaaaaaaagaaactaattttcaagcacctactttgggccaggacaccagacaagtccagactgtgaatccccgtagtgcacatgggctaggcccacagtatcaccacatttaatctttccaacatcattgcaacttgaatattttaaggataagaaatctaagtctcagaggggatgagcagcttgcacaaggccatacagcctgtaggaggcagagctcatacatgaattctgtgctgcccaacttcatgttttctactccactatgatgcttgtttttaaatcccaggagaaagccaggaatgcctgttgggaagattcccacacacacgactcacacaaacatgggcttttctatgattgtctcagaaatagcacagcatcaacccggaaatagatttgaggtcttcccccaagttgaagtatgcctcactccaaaccaagtccattagtttgctaggggatcgcaataacattaccaacaacagaaataggaagaagaggaggacagacaaaaagaaggatgaaagaaaaaggggaagaggaaagaagatggaagaagagacaggagaaagatggagaaggaaggatgaagaggagaaggaggaagaagaggaagaaagaggcaggaagaaagaccattatcaccctccccccgcccaccaccaccgtaattaaacattaagtactaggctctgttcagagactttatgtgcaccagctcataaatctttcccagaaagctccaaaaggtagggagtactattattcccattttacagacaagcagaatgaggctcagaaaggtcaggaattcttcccaagatcagccagctactaggtggaagagccaagcttcaaacctacgtctgaatgcaaaatccattccattaaccagctcctgcatcttcctctgaagaaaagcaggaagagcttcatgtggaccagggcttcaggggacataaccatgcttcctgccaggaaaaaaagaaaaaaaaaaaaaagtaggaacagggttggttagtttccaaagaggattcctgttcaacattctgcttgctgcctccccaccctcctcttggtgccccactgaaatttcttttctggtggccacgtccctccccagctgctccccgtgacggccaagagcaactggcatctgattatggcccccctctagagaactgcttcattcctcacatcaaggtggggctatctctgtgctacatttgagcccagaactccccaagggaccagtgtgaagcttctccccatccttgctcagctcctccttcccctttctcctgaaaacactccccggataaactgcttgcccccgaatccctgtcttgggctctgtgtctggagaattggaccttaaccccacgtctcctgctcccatctctgcctctgctcacttggggctcttggacaccagcttctgacttctgctactcggcctcagaggtgggagaaacaggggagaaggcaaagtgaggcactcagggagccaaggaggctggaggcacaaaggcaggcggctgagggggcagccagctcgaccacgcaggcagtgcccggccgcccccacgtcagcctgcccttggcctcgtgcactttggataattaagaacagatggcccatcgccttggccaagcctcattaactccttaatgccgttcttctggaggccggatggtcagccggaaaagctcgctttggaggtcatctgattaaatgatgcccggccagagggctgcccagtccctcttctcaggctggcagctgccccggttgcttcattagagctgccattgtgaccagatgggccaggaaaggggctggggtgtgcttaagtgaggggaatgcgctgagtgaaaaggcttaggagtcagggaacattgccctgaggcattgggcaagtcacttaatctaagtctcagtttcatcacctcccaaatggctacagtcatagcaataacagggccaggcacagtggctcgtgcctgtaatctcagtactttgggatgccaaggtggaaggagcacttaagccaggcattcaagaccatcctgggcaacgtagcagtaccctgtctctatgaaaaacaaacaaacaaaaaaaatagctgggcatggaggttcacacttgtagtcccagctactcaggaggctgaggtgggaggattacttgagcccaggagtccaaggctgcagtgagctatgatcacaccactgcactacagctgtataatcaccactgtagcctgggcaacagagtaagaccctgcatgtaaaaaaactattttaaacaataatagttgtaatatttttctaatggcgattattttttcaataataattattctagtaataaaaataatgtgccaaacactttacatgtcatctcagttactcttcacaactgccctttgagatggtacctcttatgatctgtactttatgcatgagaaaagctgaggctcagagaagctaagtaacttgccaagtttacatacctggcaagagtcaggcagaatttgaacccagttctggacgattccagggtgcctgatcttcaccactgttttggcctgctataacaaaatatcataaactgggtggcttgtaaatagtagagatttatttcccacagttctggaggctgtagagtccaaggtcatggtgctacaggatagagggtcctaaacatggtagaagggcaaataagctcccttgggcctcttttttgaaagggcattaattccattcatgtgggccccatcctcatgatgtaattatttcctaaaggcaccaactcttaatactattgcattgggaatcaggcttcagcatctgtattttagggagacaaaaacactcagaccacagcaaccagcctgcctgtcttacagggagatacccgtctcaaaggaaaacaagaagctacaaaagcattccctagtccttggcacaggaaaaaatctttgactccctccaaagaaaactttaaaacccatattctttattttgtctatttttcacccagactatcttctcaaacctaaaaatcctaggcttatattgaaaacttcaggtccccattgtggaaaagagtgtggcaattcctcaaagatctagaaccagaattaccatttgacccagcaatccccttgctggatatatacacaaaggaatataaatcattctgttacaaagatacatgtacatgtatgttcgtggcagcagtattcacaatagcgaagacatggaatccacccaaatgcccatcaatgatagactggataaagaaagcatggtacatatacaccatggaatactaggcagccataaaaaggaatgagatgatgtcctttgcagggacatagatggagctggaagccattatcctcagcaaactaacacagaaacagaaaaccaagcgccccatgttctcacttataagtgggaactgaacaataagaacacttggacacagggaggggaaaaacacactggggcctgtcggggatggggtcgggttagggagagcattaggaaaaatagctagtgcatgctgggctgaataccaggtgatgggttaataggtgcagcaaaccaccatggcatgcgtttacctatgtaacaaacctgcacatcctgcacatgtaccccagaacttaaaaataacttttttttgtaaagaaaactccaggttccttgcaatgcttctagctacctggaacaagggaaagaggacacatgcacatctacacattttggataaagttgactaaggagaagactgagaactgaccacgtctttggtcaatgaaagaacccaagaagcttacacacttgtgcctcatttgagaatcctgggcacgttaggagagcggcaggtgggcagaacatgggcaacagatgtgggactcggggaaaagcatacggctgaacttgagggagcaggaacccactttctacacacaaccttgggattggctgactccagcaggatctggtgcctgcgtctgggcacaagcaccagagacccacaaaggaatggttaattctagtctctgcttttgaaattctaaagtgctgtgccagaaaatgttttatttcttgagctagataattgttccatgggtgtgttctgtttgtgaaaattcattgagctgcttacttatgtgaatgtacttttctgtttgtacagtatacttcagaaaagagtttttaaatgaaagaaaaatgcctctgatgaaaaacagaaagtgcttgggaaagcccaaactgctactcaggttaactgttttgatgttgttagcatgttttaagcccctcctcacccttatccagcaagtctgttcctcatcttaaaacaaatgggcactcagcttgctgaatattggcttgcttttgtctccacatctgtgcaggagagttcccccaaaaccacctctggaagagttcatgagcatcttacaggcaagactttattactctgtattctccaaaggcctttacatgacaaagatgttctcttccctcatcactttcgctccttgaagatggagacgatgacatggtttaagcaactggatggagttcctcattctggcaatcacaagattcgttgccaaaaatgctgaatgctcagagcattgagcttcctccaacccactcctcatcccaagcatcttctccatattctctgcttttgacttgacttctaagtccagtttgctaattccatttggatctgctaattcttctttccattgttccccacctcctccaacttcaaatcactctctcctccagtggttcccatcacaattagccttcaaccagttgtccaaggcaaaacctcagaatctccctagattctgccctctcccttacatgtaatatttaggtcctgaacccatctgcttctccttacctccacaggcatcactgcgatccaggccacctctatgattaccatagctcccaacttaccctcctttcaaactaccctacatccaacagctaggataagctttattattattattattattattattattattattattattatactttaagttctgggatacaagtgcagaacgtgcaggtctgttacgtaggtatacatgtgccatggtggtttgctgcacctatcaacccatcatctaggtcttaagccccgcatgcattaggtaatcgtcctaatgctctccctccccttcccccacaaacccccgacaagccccggtgtgtgatgttccccttcctgtgtccatgtgttctcattgttcaactcccacttatgagtgagaacatgtggtgtttggttttctgttcctgggttagtttgctgagaatgatggtttccagcttcatccatgtccctgcaaaggacatgaaccagaatgagccttttaaaatgtaaatctgatgaaagaagttccctgctctgatcctacaatggccttcccatctcacttacgtgtgatcacccttgcaagacctagacaggttgatatctgcttaaccacctccagaccagcctctcactcagccccaatagcagaggcgaatttccatttcttgatcacactcaactcatgactcacgtccaatatacatataccttttgcagatgctgttcccttgcctgcaacactttacccttggcttttccatagctggtgacttttcatgtttcaggtctcaaagaaaggtgacctcctcagagaagccttccttgaccacccatctaaattgctgtccaattattcttcattgcatcttctcgtcttatctccctcatagcacttaatcagaagctggtattttttatttgcttactgtactatctgtcttttgcccaaatagtaaggaccatgacaccagaggccctatcttattcaatgctgagcccctggtgtgtggcatgcagtcagggcttttttttttttttttttgagacagagtcttgctctgtctcccaggctggtgtaatctcggctcactgcaacctccgcctcctgggttcaagcagttttcctgcctcagccgagtagctgggactacaggcgcacgccgccatgactggctaaatttttttgtactttagtcgagatggggtttcaccatgttgcccaggctggtctccaactcctcagctcaggcaatctgcctgcctcagcctctcaaagtgctaggattacaggcgtgagccaccgcgcccagcaggacttgttgaatgaatacacctggcattctccccagcgtcactcacccagactgcctgcaagagacatacctggccctgacccacccccttcctgccatcccaattaaagaagggaaattggacatgaaataatgactcctgattcttcccgggctgctttggcttccttaacctcactcctcgcactcaaatttccaaaaccaacagaaagagcaaggtccttctggactcaggcctgcgttactcttttccaagtatttgtggtcatctaggctcatcccacatttcctattacactggaaaccaagaggtagccaaataatatggtaaatcaaagagtctgggctcgggagttaaaagcacctaaggtcgaattctggccgcatcctatttattagttatttgttctttttttttttttttttttttttttagacggagtctcgctctgtcacccaggctggagtgcagtggcgcgatctctgctcattacaagttccgcctcccgggttcacgccatcctcctgcctcagcctcccgagtagctgggactacaggcgcccgccaccacgcctggctaattttttgtatttttagtagagacggggtttcaccacgttagccaggatggtctccatctcctgacctcgggatccgcccgcctcggcctcccaaagtgctgggattacaggcgtgagcgaccgcgcccggctagttatttgttcttatactaatccttatcagcctccatttctccttctggaaaataacaagaattctgtctccctcaagacagagtctgtggcattgtggaattatttaggggtcaaccatttcaacgaatgctacatgaaatctatctagagagtggcacaaagaactcaataaatgcttttgtaattaattctaatttctcccagaagctggcatgtctcagcttacattttccttcctctgagaagattcgtttaactccaccaccctctaagtctgggttagatgcttctcctaagtatagatctggaaccctgtactcagtgggttctgtggatccccactgcattacaagtaaagctaagtccctacaccagcctatgagatgccacgtaacagagtccccatcctgcctctggccctgccctcgccactctccccatcattccctctgctgcagccacattggcctcatgcggttcctcaaacttcccagactctcacccactattccctcttcttagagcatgctcccccggctatttacccagttccctccctcatcccctcaggaccctcatcaaatagctcctcagtgaggctttccttggccagtggaaggctgaataatggctccccaaagacgtccacatcctaatccccagaatctgtgaccatgttacctttacatggcaaaaggaactttgcagctgtgattaacaaggatctttaaatgaggagtttgttctagattatccaggtggtttcaatggaatcacaagagtccttttacgagggaagcaggaaggacagagtcagagagagagcgagtgattggaagatgctaagatgctggctttgaagtggaggatgaggctatgagccaaggaatgtggatggccttcagaagctagaaaagccaagaaaacagattctcccctacagcctccagaaggaacgcaggcctgctgacctctttcaattttttttttttttgaggtggaatcttgctctgttgcccaggctggagcacagtggcatgatctcggctcactgcaacttcggcctcccaggttcaagtgattcttctgcctcagtctcctgagtagctgggattacaggtactcgccaccatgcccggttactttttgtatttttagtagaaacggagtttcaccctgttggccaggctggtctcgaactcctgacctcaagtgatctgcctgcctcggcctcccaaagtgctgggattacaggcgtgaggcaccacacacggctcaaatttttgacttccagaactataatgtaatatatttgtgttatcttaagccactaaatttgtggtaattcattacagcagtgatagaaaaaaagttcagccaccaaatctaaaattatattctccaccaattgtgcacatgtgtatgtatttgcataaaacacacatgcatgtgcactcacacaaaacacacacagacactccttatccctctgtcttgatttagttttcttcattcatctgaccaccaaaataaataagaaaaatagggcacatgtctcccacacgtacatacacacatacacacagagaaatgagatttccacgaagacactgatttgtggctatgtcttgtgtctctttttgtcactgttgagttccttgcacctagaaactggcctggcattattgagtgaatagagactcattaagttttgactgcatgctttatcttagaacatagacatacattctgttattatttgtacaaaatctctccacctgtcaactcttagcccttgaggtcagggacccatctctcttcctcactgctgtatcattccatcattagcacagcaccctatcctcccacaagagccccacgaacatgtgctaagccattgggccaacgctaccacattccacacatctgagccccagagttgtcagaattccaacccatcaagagacctcgcattttatttgattgcaaatatgtctaattcccggttcactcgagcagcaagaaaaaaaaaagccactcgagtctgtaatttacaaagcaaatctgcccagcagaaatattcatcttcagaagacagtgggattcaatcattttttaaaaggggaaaagaaagaaacttaacctgtttctcccatgttccagttgcatcgtttgcaaaacttttgaaagccctttgaggccagggctaatcattttgcttccaggggctcatttcctgaggtgggtggtacctttgtcaccaaggaaggaacgcagcaggcaggaaaactgagattgtggcagaagtcattcttggggaaaggatgtatgaagatctagtcaattccacccggcttgctaattagagtttcagaaatacagagatgctgtgtccctttgaaatccttagaatagttggatgaacaagcctgtcccctaagggaatgtgcaaggacgtatttaaattacgttatttttactttaaataaccaagtcgaaagagttggtgactggaagttaaattaggcaagtctagggataatgagtatgtattagacgcccctccttttccatttcctctctcatggatccatctcatccttgtctatttcctgcccaatctgtgggcctctaaaggataaggaccatgtgctatttgtctttgcatttctggcagtcattatagtcccatgatagtgcctgacacatgctagacactgtgttgaattcttaaatagatgcccagatgaatgaatgagcggatgactgaatgaacagatggatagatggatggatgagtgtttgaaactggaaatgagtatgcctgtaccaaatgcctgtgtcccaacttgcttgataaccatccaggatgtttgttttatctacagcttctcaggcccctccccaagtggttctgattcagcctatctcaaagttaacctgggaatatgttcttgaacattttccccatgtagctccgatcatcaggcatgcttgggaaacacatgccatctccatctgtttcatgcttccttacctgaaatgtccttatgttttattcaccaccccagggtaatcttcagcaggtgaagtttctcacattcaaaatgggaatcagggcctcttcatgtctagctacttcctactccctctccactgccattcaccccttccaaatgcagtcttatttttctattctcactctcttccccagagctttcaaagatttctaacataagaccgagatagcagagcccccagggtcagcattctgcctgacagccgtgcagcaacacggactggattccctggaaggttttgcgtctaaaagcagggcctcgtggctctcaggattcccttgcatgcagcacccatccttcctgcccatccactgagtataccaacctaggaaatggaggagatcgaagtgtgtgtttactgtgtctcatgatgcatgttccatgagatggaagatggtctgggcagcgattttcaacctttatgaaccaagcaggctcccgggctccactcttctcaagatgatagggcggtatcttgtttttctaggtttcatagttagacctccctctgcaacatttgatttttttttttaaaaaagggtgccaaggatcaaaaaggctgaaaactgctagtctaaagcatcatttttgagccagtgggccatatttcgacctttctttctcaaggtgccattagaacaagaaggaattgccttttaggacagtgaactaagtactggagttcctgtttacacagaggtgattgaacaaccttaataattcttgcgttaataatctattgctggccgggcgtggaagatcatgcctgttatcccagaattttgggaggctgaggtgggtggatcgcctgacctcagtagtttgagatcagcctgggcaacatggcgaaaccccgtctctaccaaaaacagtaaaaataaaaaataaaaaaaaattagccggatatggtagtgctcacctgtggtcccagctactcgggaggctgaggtgggaggattgcttgagctggggaggtggagactgcaatgagcccagattgcactactgtactccaccgtgggtgactgaatgagaccccatctcaaaaaaataaaaacaaaaaaatctattgcggcataacaaattaccccaaaagttaatacctacaaacatcaatgtttattatctcacagtttccacaagtgaggcacggatttgctgggtcctttcacagtttccaacaaggcggtagccaaggtatctgccgaggttgcaggctcaactgggaagaactcacttcctggatcactcttgtggccgtcggcaggaattagtttctttggggttacgggactgagggcctcagatcttctctcgctgttggccagaggctgccctcggttccttgacacgcacatctctccactgagcagctcatgacgtagcatctggctgccattagaggaggcaagcaagaaaagagtgcgggcaagatggaactcaaggtcttttggaaacctaatcttggaagtgacgtaccatcccctttgctgtgttgagttcatcagaggcaagacgctaggcccagcccatactcgaggggaggaaatcgtatatagacatgaataccaggggaccagtgggagctcttctttttttttctttgagacggagtcttgctccggtgcctggctggagtacagtggcccaatctctgctcactgcaatctctgcctcccgggttcaagcgatttccctgcctcagcctccccagtagcagggactacaggcgtgcaccaccatgcccagctaagtttttgtattttagtagaggcggggtttcaccatgttggccaggatggtctcgatctcctggcctcacgatccacccacttcggcctcccaaagtgctgggattacaagcgtgagccaccacacccggccgggagctcttctaaaagatgtccactgcaccttcaaaagctttgctatcaggtaatcctcggaagtaatgggatatgatgtggtcagccacacctgggttcaaatcttggccctgctacttactagtaccactactgttcataataacaataaccattcctgctattccttgttaagtactgtgcacatcttcacaagtgtcatttcatttgacccccccaaagcatccccttgagaaagtcctttgactatccccagagcatgaataaggaaactaaagattaggggaattcagcaactcaccagacatctcagagctacctctgtaagcagaaaaggccagattccagccacaacgcctctggttctgtgagtctgaagctatactctgaccactggtgtaattcctttgacctccaccaaccgtgaaacagagatgctaacactggtcttcaagggctagtgcagaggatgaggtaagtgaataaaatagtggcccatagtcagaaatcagtaaagggtaggtattttgtttaacaaacatttgccaagcacttcatctgagccaagcattgtgctgatcctgacttttcttttcttttctttttttttgagatggagtctcgctctttcgccaagactggagtgcagtggcgcaatctcggctcactgcaagctccacctcccgggttcacgccattctcctgcctcagcctctccagtagctgggactacaggcgcctgccaccacgcccagctaattttttttttttttttgtattttttagtagagacggggtttcaccattttagccaggatggtcttgatctcctgaccttgtgatccgcccacctcggcctcccaaagtgctgggattacaggcgtaagccaccgcgcctggcgatcctgacttttctcatacagttttgttcagtttccacgccgaccccatgatgtagctggagttaagtgcttacattgacttattcaagccaggctctgtttgagtgctttgtaaaatttcactcattgagccctcaaaatgaccttaggaagcaggtgcttggagcagatgccacaggtggcctcacccgtgtcactgcagggcacacaggttcaacttccagtctccagcacctgcgtttctttgccagggctctctcgggctggtgaaacttgctttatcctcatgtgacaagctgtgccacccctgctccggggacatccttcaacagatgaccagtgccccaggtcactcgtctctcctgaagaactatgagttgtgagttacacaatatctaccagagctgcccagagaaattcctgcctgtgtttcctctgtaggggctggcttcgtagcatatccttcgtgcctgccttctccctacgtgtccctgctcctctacccatgttctctgaaccttccaaataaattacttgcccccaaatccttgtctcagtgtctgcttctgaagaaatccaaatgaaggcagtgttatcatcatcatcatcatccccattttcaaataagcaaagtgtagcacagagaggttaattaacttacccaaggtcacacagctgggaagcagtgaagtcagaattcaaactcaggcagtctgactcttaacattatgcatagtgattacatttttaaaaaattcaacttttattttagccacaggaggtacatgtgcaggttttttacatgggtgtattacacccgggtaacaagcacagtactcaataggtcgtttcacaagccatgcccccttccctctttcccctctctggtagttttcagtgtctattgcacccatgcttaagtccatgtatgctcaatgtttatctcctacttataagcatttttctttctgactgagctgggtaaatggaggagaagagttaccttatggtgccaaggaaaaactgtctacaccaaagctctgtgtgtaaccagtggccgggcatgcaaatggttccatgtattactgcaaagaccagcactcttctctaatgaaaatgtcagctccccaacacagccagctgtgattccattgaaaaatgtgattacggaagccatgctaatggtgttaacatgttgcaaggatttctggtgtgcttgtaaacctaaaaccgtaattgccaaagagaactcgtctcccacaaatcaaacccctctgtattgacaattacatccggtgttgcacggaatttaatgcctaaataatgaagtcgaagaacaatgctggagcctgagcatttgaatatatttgattgattcatttctcgctcccatttaataacccacttagtcagtgacggttaagtgcaccagagagaaaacatttcacagattaataactagatgtgggtacaagctggcgctcccctaatagcagcacaaaaataggttatcgtcaaaaatctggatttaatgttccaaaatggggatttgtgcttttcttttatatggttccatacttattaccacaggctaatgaaacagaaatcaaaaatcaggagctaataaatgcaattccaggggagtattttttttttatttaataccttccaagaccgtgatctttgttcaagatctttaatgctcaaattacaatgtgtgaatattaagcatattcgattatgattgaactctctgaaaagctaatttatgaaccctgcagcctaacacatttgtgccatttaaaaaaggaatatgaccacagttcatttataccaatttctccagtacagagataaacactcctaaactgcctatatgaataaagttatgagactgtaactttattataggctgggatgtgtgatttctgtggagagatatataattaaatgatattgactccgtgtgtaaagcaactttggcagaaattttgcattggggaatgttctcttaagttcctttcttgctgttctagtgaaaaaaaaaaaaaaagtggtcagacaagggaccttactcagggcagactgaaaaaatggggcctcctccctagctgtaattctctttctgcaataatttcatgacctcttgtggaaaaatattttcccctaataaactcagttttaatacaagtttaacaaatccttatccctttatttgttatgagctttactatcttttattatgtttaccatggaatgcccaagccatcaggtataatgagaactgctttgtgtctttccacgtgtccagccagcctggaaggacacatcgatgacactgtgaggaagaataaggaacacgtttctcatgtgctgtgaaatactctggcctggagaggtcctggtccattcattctctgggttattgacttttgccacagcctaatttaaaaaaaaaatgattggccaggcacggtggctcacgcctgtaatcccagcactttggggggccaaggagggtggatcacttgaggtcaggagtttgagaccaggctggccaacataatgaaaccctatctctactaaaaatacaaaaattagccgggcatggtggcagggactcgtaatgccagctactcaggaggctgaggcaggagaattgtttgaacctgggaggcagtttgcagtgagccgagatcgcatcactgcactacagcctgggcgacagagggagattctgtctcaaaagaaaaaaaaaattattgcaaagtgtatatatgataccaatttggtaaaactgaaatgcaaaattaaaactcaggctccagtaaatattagggcaagactgggtaaaatgtaatgcggagatttacttctccagaccctacacatttattccagtgaaggcttttgactcagccccctggcagtcaagatacaaagggacactgcatccattatatgggttccccaggcaaagcagacattgcctggccctgagcatgtattgccactaagctataaagtgcaggtcagggacctagtaactactctccctgcccctactctgccacacacacacacacccacccacccacacacacacacacatatacacatacacacacacacacacacacacacacacacacacatacacacacacactccatgggcaggttccccttgagctcgcactgtctctatgcaattcagtaataaatttatttattactaaacaaatggtgccttcacacaaggaagaagacatctcttcccctagaggacacagccagagaaaacagcttggcaaacaaatcctggcttgatctcagcctctgtgtactcctttggctggatggtgcgcaaggactcggatttaattctaaaactttgtcatgcaaatcttgaatgaatggaaccacagagagacgggacggacatagttttcaacaatgagaacaatattagattccctgagggagtgtttcagtccttggtggaagccaagatacatgtctaggagaaaacagttctacagaggccaagataatgtggtactaaaatccctggtgggctagttcaaggctatctaatatggtagatgagctgagtgtgcttcacccagtcttcctagttctactactctcaacgagttcgtaatacttcaggatagatcacagatgctgggaaaccgttcagcaaagccatggtgcaagaggaaccattaatagatcaacgtctggcccaggagcagatctaccaggacctatgagagttttcttttcttttcctttcttcttttcttttttttttttttttttttttttttgagaccaagtctcacattgtcacacgggctggagtgcaacggcacgatctcggctcactgcaacctccgcctccaggttcaagcgattcttttgcctcagcctcccgagtagctgagattacaggcacacgccaccacgcctggctaatttttgtatttttagtagagatggggtttcaccatattggccaggctggtgtcgagctcctgacctcgtgatctgcccgcctcagcctcccgaagtgctgggattaaaggcatgagccaccgtgcccggccctatgagagatttctacccagggacaagaatggaagactggaggcctgagatattggaacaaattctaccttctctcttttattttcataaataagccccttttccctcatgttccctagcttgaggggcttgatttaaagagccactcgagcgaacccaagagcatagaaacaggttataaattatcaaggtatcctagaaatcatttggttgtatggagtgaaggataacatgagttgtagctgcttaaagagcaatgacagagttgactccctttggcattggcggaaaaaaagagaacgagaacagggagaattcgttcaagccctggaacttgcttatttgaagcaaccctccataatcctctgacactgaaaatccaaccagagacaccaagttggaatattgaactattttccaaaaacgtggtatcactcagtgggaaggttccttgttcctataaaagttccccccaaaaagatccgccctctggaaaagtccttaggaatataccaaatcctaaggcagttacaagggaggagtctttgttgatataattaatgctggccatccaggaagcagtatgcaaattatgactgcactgaatggacagaacctggaaaccaggacaaaatgccaaccaatgcctgtgcaataggttttaatcctcccattcctattttcactgttcatctgggactaaaaatgtcttcaccctcccactcaataagctgggagggaaggtttcaccatgaactagctgatacttgagctacagaaagtcagcctgtgcgagcaaagatcgggctgaacagaagctaattcctgccccaattcctagagttttgttcaaacctattgtattatggtcaacatccggaatgaacaactaataattgcagcaatgccttcagggatttttgcctgtttacatataaatagttctgaccagagctggccaccagcaatggttaatttaatttactatcccttggcaaaagaatagtcattggatttccagcacttttaaccttggtagacccttgggaaataaaaattagattgagagaaaattaccagtggtggagaacagtataaaagtgacaatgacatatataaacctccggcaggagtggaataaagtggcatattattgttcgctggctcccaaagttcaatatttcttgtgtgatttacacttctgccattgtctcaccccctggagtcattctggccactcggaagtctctcccaaaatgcacacccttgttactgtcagagaaggggcatattacctggctaagcagcaagaggtgtttagacaaagagccattagaaaatgggtttcaacaaataagagtttaaagaggtgtctggaaatatgagactgaaaatatatgggaaagaaaagtcgataatccctgccttcgcagtcgtgtgtgtgtgtgtgtgtgtgtgtgtgtttgtgtgtttaaagaggtgtctggaatgagaagcagatgagtgtcttgggtgttccaggctactggttgcacttcctctatagaattatgtcaacataatctgtgtgcaaactcagctctgattggagggtcatgatgctatctcagcctcactgaccatcagttggtgctcccactacatgaaccacctgtggtacacacacacacacacactccccacacacaattgtttctttttcctaaacctttgctcatgtggtgttatctgcccggaccacccttcctcccacctctgttttgcctgtctggctcctaacttgcccttgaatacctagcccagatatctcttcctctaggaaacttttcctgatcacctcctggccagatgtgtactttctttagtatcagcctcctgaatttgtcactcttattatttgcatcaatctacttatgtgttttttttttcttttcttttgagacagaatctcactctgttggccaggctggagtgtaatggtatgatcttggctcactgcaacctccacctcccaggttcaagtgactctcctgcctcagcctcccgagtagctgagaatacaggcgcctgccaccatgcctggctaatttttgtgtttttagtagagatggggtttcaccatgttggccagcctggtctcgaactcctgacctcaggtgatccatcctcctcggcctcccaaagtgctgggttacaggcatgagccactgtgtccgaccctacttatgtgtctttctatcccaccttcagaatatgtaatgagactactgtgaccttccaaaagaaaaaaaacaaaaacaaaaaacagaacatttaagcctggagagagaggtcagagtataaaacaaagaacagaggcaagaaagttaggaaactcctaagtaacatatccaactagataggattcctggtacaggcttttcttttattgcacataccacagttgtatttttattatatttgtgtgatcatctaattaatggacacacacacaactgtaaaggaagagattgtgtctcccttcttttctatatcttcagtacctagcacatagatggtaccttatagatatttatgtaattaattagtttataaattaataagcagacatataatggataagagagaaaaaagtagacataagctcataaatggggctaaattccaaagttcatttgtatgtgtctccatggcacaaggatagacaggaacgccacatagaaataatggatattgagttctacttctgataaacttatatccaagcctgggaaggtctgattctaagacttacctttaaacaaatattgaaactggcatgggatttctcttgcccaatagaacccaaagcccataatttactgaggataaacagacttacatgataaagctgtccagaatccaccaacaccttcattttacatgtaatgaggtggagcaagatggtcctcactccccagatggtgtaataacatcattagagagaggattgcatttgtttcggagacaccttgacttactgtttgggatagaacacaagaccccgaaagtcatgtgccagtcaccaaagtgccttgaataaaggcgatcacagtgaaccttgggttgttttcttcaccaagcactatcatgaacagaatttgtaagtttgaagtgaggaagaattgttctgataatagagaagagaggagccagggcattcctttgggtgttgggggagaaagacacaggagtgaagtaacaataagagacatgaggatttttccagttgctcgatctgggcaatgtgatataaactcgcttttatgtctcctctacattgtctttagtaaattaacgcttaactcattaaatgctcttctgtgagtgggtctttatgtgcagcaggggtaagaggggcctcaaagagaaggacaagtgaacagctgacagctaggtgtcaaaggaatgggggcaggattcctagctgagctcatttgctaaggaacccttggctagtcatagactgagccatttcaaatccatcagtttcatctctctctctctctcctatacattaaagatttcaattagccagttagcagggtactgcagggaaaagggaaggaagggtgagtttattctgatgagttgttttcaacatttactgacatctaatacatgtcaaacaatttacatggattatctcatttaaatttcacagcatgtctatgaggtggttggtgttatttttattatgtagatgaagaatggaaactcaggctcaaggaggtaaattgtcccaagttgtagagccagtaaattttagagtctggatttgaatccccatctatctttacaccatattatgctatctcttaaaaaagggctgggtggttgctaaggaagatggagggaaacatatttacactgatgtggggtggcggtgggaaatgatgccaccaaaattcaggaggattttcctgaaggtaactgttgttgccataaagtactttaatcctctagtcaaccaaaaaggtgccactggtgagatggataaccacggacttgtgaattgcaggacttaattttggcataattaccaaaggaagtcagacagtattgcgggaatgtaggctttggaatcaggcaaatcctcatttgaatcatggttctgatttattatctaaaacagttcaactctaaatttccctttagaaataataatcataaacataaatttaacaattagtcaaaagaagagctgctcttctgaatcagggaacaaccgtcattagagaataataactctaaatctttttcactgaattcacagcagccctcagttaacagaccataagagcttaatcttgcaattttcttaattcctagaaataaactgaaacctctggtgcctgtgggatgaatcttaattttgtggaggagactctgttgatattggtgactgttttgtgaccttgagcaaatgacttcacgtctctgagcctctggtctgtcatctgtaaaatggggataatcacatatgacagttaattttgtagatgatgtgagataatgcatgtaaagtcctgagcacagtgcctggcacaaagcaagcactcagtaagagggagtgatgaggattgggatgatgatggcaatgacaaaaacaatgatgcaacaataagaccaagataagacaatatgttgatgttgatgtggcagtgatggtggtaatagtggatgatgatgatgatgatgatgatgatgacaaagacaacagtgcaatgataagaccatgaggagcaatgagcaatcatcatgatatactgtttgttgctgctgctgatgttctgtttgttgctgctgctgatgttgtagtggtaaacaatacagagaagaagaaacaagaaggaaggaggaagggaaacataaaaaaaggatttgatatggtttgactctgtgtcccaacccaaatcttaccttgaattgtaataatctccacatgtcatgggagggacccggtgggaggtggtcgaatcatgggggtgggtctttcccatgctattctcatgatagtgaataagtctcatgagatctgatggttttataaagggcagttcccctgcacacactgtcttgcctgccgccatataagacatccctttgctcttccttcatcttctaccatgatgtgaggcctccccagccatgtggaactgtgagtccattaaacctctttcctttataaattacccagcctcaggtatgtctttcttagcagcgtcagaacagactaatacaggattaaaagaagaaagaagaggatctccataaaacatcaagtgcaactcataggtaactgggtttcacatgcccaaacctaaggtgttctgattctccaaccagaacagatatccttttcctgattagaggtgcaatgccaaccacatcaatagacatggtctctgggatccctctaaccccattcaccacctggttctctcttcccatcaaggatgaaaaagggattttttttttattctctgtgtgcggaggataatgcatctgtaaactcatcataaccccatagccagatgcttctgtgcagtggagccagcaccatcaaggctaacaaaacacagcatcaatcctcaagatcctagtttctgggtggactgagaccatgcctgggaggagctggccaaaccacttcctcagtgttatcatttatgaaaccaaaatgaagcgttttcaataattataaggacatgaagtagatgactaagatcatacaagcaaatgtgctccgagttcgttctttcaagtagtgaccatgaatatcttaattttttattatgatgaaatgtagaattatcctcatgattaaaagcatgacttttaatgagtcatttaatctctctgcatgtctccttgatgaaataataactttatgtagtagtaccaaccttataagttagaagcgagccttaactaagataatttacagagtttaacatactatctttcctatagtgtctttcagaaatattagctgataatattattactattatgtaggagacaaaaagaaaattttaaaatatacccaaaatacatatctgattatgtgaaccccctgcttcaaactcccagtgatttcctcccagtgctaaggatggaatccaaatgccttaacatagctagcaaagctctttatgacctggcttctgcttaactctcactacagagtaaaccctcctaaactgctctcacacctttcaggtttcaagtcacttccgtgtttgcactcttccatccaactgttggcccgcctagcacactcagccctcaggctgggggaactgccttcctccccgagcccacagccctttgagcctcccccatcacagtgtagttgaatgatttcctggtggtttatctgttacctcaactacttgggactgagatggtatattaatggttcttcctcgccgtctagcatagtacctggcacagagcaaagcccaataaatgtttgctgaatgaagggaggagtagtgtgattgatgttagcatgggacacagagaaggggtgtggcaggggaatcagagggagattgatggaggatgacacctgagcaggatctttaggaacaggcaagatttacccaggcaggtttttttttaaagcaatggcaatacagaaagagagaacagcatgggcaaagcacagaggtctaaccaagcatggcacctttggggcaacttcatatattcacgcagcactgcaatattccagagtaaggaaataagagataatgtttggctatgtgtgccaacaagataccttgtctttatcctgtaaagattaagcaatcattgaagaatttaaagtagagcactgatcagatcaggcagaagcatgagattaatgatcctgttaacactctttgatattttcctcttctttcttcccaccctcccatccttttctctcctttcttctatcttcttcctctgtcttctaaaatatatcctttcattttctacagtttgcctttacatggattttgttgaccccagatgttagaggaccatgaattaagccaggcaggactcccagcatcagtcaggattcaaggggataaaatttcattctgatgacccggagcactaatgaacacttctccccaacacgagtcctctaaaaatggtctgaaatgaggcagaaatagtacgttatcttgatataaagggaacacgttcatcacttgcttaaactaattatttgtctgagagtgacggtggcaacactgaccttttccaatgatcaaaacacttatttttaaatggaagatgtaactcttctcatccctcctctttgttgaaatgtctgacctaacctcattcagtgacgaatacccagaaaagcctgcttaacagtgtgattagtgaagttattctaagatagtgatgaccaaactcaaagtcctagactattttaagtgttcgagttagggtttaggattagagtttagcgttcagggttagggtcatggttaatgttaaggttacgtttgatagattcgattaggatgaaagttagagttaagaataaagataagggtagggctagattagagttaaggttagggataagatcagggaaacttctggagaaaagagaatgagattagagggcagctaagattccagccactcatatgtacacactccaccccaaactcattgtttccctatttcttttctgtttagtttcacttgaaataataataaaaggaatctactcttctctgattcatagacagggtttgaaactcacagaactagagaaactcccaagccatgtgtgagagtcaatgactgacaccacagtccatttttcaggaactcagtagtctcatgaataaaaagtatttagacttctgcagatgacaccccacttaccaagctaaagctgtctcagatttggcagaagctgccccatgacacagggtttgaggcagggatatggatcatccacttgcagaccccttgggcaagtggatgctctgtataactttccttcttgactggcaggatccagggaatatgaccaaaaatgggaacagggccatgcttaccatcttttgcagtaaatggaaataaggaaaatatttaagaatggctatagtcttagccaggtagaaaggccaaagaacaggattctggatctgagaggttaggcaaaaaccatttcatgaagccaagaatgtgggttgggaggagaattgatcaggcatggtaagtgaacctggagaaatttttgagactatggacctttataatagagcttggttcagcaaaacggttctgtaaagggccagatagcaatgctattttaggctttgtaggctatattcagcctctgtaataactactcacctcttgctctagaacaaaagcagtcatagatgagacatatatgaatgactgtggctgtgttccaataaaactttatttaggaaaatagatagcaagccagatttggcctgtggaccatggtttgttgacccttgtactagggtatttggagagcttgttttgtgaacccccaaagagaacagtctcctaagaattaaaccaatatagaaatcttgcagaatgaggacattagaaagcaagaccaaggctatagcattattagaaaccctgaatccagccatacctgaaactaactttctctggtatcctcatttacgtgaaacaataaatcctctccttttattgttattgtttaagtagtgtgagttaggtttctgtccattgcaacaaaaaaagtccttcttggtatacaatacacacaggctaacagaaaaaaataatcaggtctcattacaaatcttctgattcccattccagtgctctttcatctcaacaagcagcagatagaaaagaatgccctagttgagatatcttttgtagccaaacatcagtgttgccaatgtgaacctagagtttgctccaaaacattcctgcttgttggagtgtcattaagggaaagcgtgtgcctaggaaatgctgcccgcggatgaagaaagttgacagaacagccctgaagggccagatggattccagacagctgtgacttgatggaggccctccatttggcaagaccagggagagcccagcatgaacgacatcaattagcaacctcttttgagagaggatgattacagcacaccactgcaatcaagcttcatgcagccactacatgtaacggttattgagcctctgtagaaacacacagacatgtgtggtatgatttttaaaagagaatagcagaatgcactgggattctcatacattcctgaagagattgtgaactggtgcaaactctctagaaagcaatttgacaataggtatcaaacacctttaaaataaaaaatctcaagacatttgatgcagtcgtcatccttcacccctgtaagaattgatcctgagcacatatcagaaatgcaaacaaagatttctgcacaaagatgttcatcacagcattaagtataatagcaataaaagaaagcgtacaaatgtcaaagttaggaaattaatgaaaaatattatgatacatagccataagatagaaaattatggcagccatcaagagtatgattaagaagagtctttaatcacatgagaaaatatccacactatggtaggcgacaaggcagcatacaaattgcatatataatatgatcaccagtaaatcaatatatggcatgagtttttatttttatttacccgggtacagtgatgacatgtttgagttgaaggactcagggctccttttatgggcttatttgcatggggatgtttggggctacagaagagtcaaggaggtaggagggttcctagagggaggagaaaacaaggactattaaaggtatgtaataatgtgatgatgtctgatccctcactatgatacttttgaggttcccattgagaagttctaggcagaatttgaaagacattaaatgtcactcttcaacgaagcctttccattcccccagtgacgaggtcacatgcccctgatctatgctctcaaagctttttgtgtttctccttccaagcacataagagatattatcattgtctatttagatgatatgtgattctcactcagttctgcattgttgaatatggtagccactatacagagcatgtggctatttctatttaaatttaagtcaaataaagcaaaacttaaaaatgcatttctcgctcacactggccacatttccagcacacaatagccacacgtggcaagtggccatcatcatggacaagacagatacaaaacgtgttcctcagggcagttttattgaacagtgctgtccaagactacaatgttatgaggtctcgctcacatgctattcctagttcctagcacaaatatctggcatattacaggcattcaataaaaatatatgctgaaggggccggctgtggtggctcatgcctgtaatcccagcactttgggaggccgaggcaggtggatcatttgaggtaaggagtttgagaccagcttggccagcatagtgaaactttgtttctactaaaaatacaaaaattagctgggcgtggtggtgtgagccactaattccagctactcaggaggctgaagcaggagaatcacttgaacctgggaggcggaggttgcagtgagctgagattgcaccactgcaatccagcctgggtgacaaagtaagactccatctcaaaaaagaaaaaaaatatatgtaaatatataaggaatattaataatattaatatatattaatgaaacattaatattaatatatattaataaaatatatcaatattaacatatactaataacatatattgataaaacatatatttatacaaatatatatttaatatatatttatacatatatatatatttaatatatatttatacaaatatatatatttaatatatattccttccttcagcatatctgtggagatgactttataaaaaaggaggtcctcagtacaggaagaggaaacacacacacacacacccctcagatatgttcctttttcaaataaccagcaccattaagatctcatgaacgtatttggtagggaataaacacaataaataatgatgatagaattctgagctctgagtaggcattcaaacaggcaggatggatcctgaccgtgagggtgtctgtgatgacataaatcatagcagatccaacatctcaggaccacatctgacctggaagcagcatgaccctgtcacagggactggagcacttggcaagacagagctcactgaggagctgatggtggccagcctagtctctcatcaatgacatttttttttccctgacagctaaaagacaaaaggtttgcattcgtggccgtgtacgtggacatgagggttctgaaccttagggctctcgaaggcccatcccattcaacgtctctctgtctcctctgcccaaagaaaaagccaataattcaaaaacctcaatgtggagctgcatgaaattgttctgtaacacactttcttacctacaggaggggctcagataaatgttgaatcaacagataagtctgcagccataataaggaatgagatcaggtccttcacagggacatggatggagctggaggccattatcctcagcaagctaacgcaggaacaggaaactaaacactgcatgttctcgcttataagtgggagttgaacaatgagaacacatggacacaggaaggggaacaacacacactggggcctgctgggggttaaggtggggggagggagaggattaggaatgctgggcttaatacccaggtgataggttgatgggtgcagcacaccaccatggcacatgtttacctatgtaacaaacctgcacatgtaccccgaaacttaaaagtaaaaatttaatttaaaaaaggaaattacaaaaaaaaaacaaaaacaaaaacaggtaagtctttgtcttggttggatggtagttggtaagaaacagtcgcatattcattcaacaaatgtttattgggcactaactgggtgttaggaattattttaggcatttggaatagacctgtgaacaaaacagaaatcaacaaaaatgtctgccttcatgaaacttacacgccaggctggttttcagccccggctggatattagaatcatcagggaagttctgaaaaatctcatttcttgggacacagctcagagaaattctgaaactctatagttcaagatggggaatagggatatgttgttaggaagtttcccaggagagtcagggtacagtagcctgggagcctgggaaccactgttgtaaaacaatggttctcaaagtgtggtccctggaccagcagtagtggcatcacctgaaaacttgtagaaatgcaaattctcagctgggcacggtggctcaagcctgtaatcccagcactttgagagactgaggcgggtggatcacgaggtcaggagatcgagaccatcctggctgacacgatgaaaccccgtctctactaaaaatacaaaaacaaaaaaaaaaattagccgtgcgtggtggcgggcgcctgtagtcccagctactcggaaggctgaggcaggagaatggcgtgaacccacgaggcggaacttgcagtgagcagagatcgcgccactgcactccagtctgggcgacagagcgagactccatctcaaaaagaaagaaagaaagaaagaaatgcaaattcacaggcctctccccagatgtatagaatcagaaaccccgtgagtgggacccagcaagctgtgttttcacaagatctctatgggattttatgtgcttaaatttgagaaccattgctctaagcaaaattacctagggagatgagttttatgagacagaggaatcctcctctgcatcttttcccaatgtgcttctgccaagtcactaaacctggagaggcatcccaagagcagcctccccaggttggtacctgacagccacactgggttttcagcagctctctccagccactcaggacgctgccccacttacctaggctcctctccccactcagttccccgattagcataatccttcccagctgctgaggcctgcagactagacatcctccagttgacctccccatcataaactgagatatgatggtcccccacagctatctgaggtcttggtctcccatagggctgcacagaaagggtgcacattcatccaccaaggcatgacccgctgcggcacacacacacccagaacctcattttacacaacacacacaaacacatccctactctatcacacatgtaatgtcacaaacacacaatcacatattcagttacacgtacattcacatcctcttactctgttctacacagagacacacacatacatgcacacacaatatcacgggaccagtgattctcaaatgtatctaaacattggccttacctgggagctttaaaaaattctgatgctcaggccacagctcacaccagttaagtcagtatctctggagctgaaagccaggtacatatctggctttaaatctatccaatgtatatatttatcacagtttctttatccacttactgactgatgaccatttgggctacttccacatttttgcaattgtgaattgtgctgctataaacatgtctgtacaagtatcttttttgtattatgacttcttgtcctctgggtaggtacccagtagtgggattgctggatcaaatggtagttttattttcagttcttcaaggaatattcacaatgttttccatagtggttgtactagtttacattccaactagcagagtagaagtgttcccttttcacttcatccatgccaacatctattatttttttattttcttgattatggccattcttgcaggaataaggtggtatcacattgtggttttgatttgcatttccccgatcattagtgatgttgaacattttttcatatgtttgtgcccatttgtatatcttctattgagaactgtgtattcatgtccttagcccactttttgatgggattatttgtttttccttgctaatttgagttcattgtacatatggtggaatactactcagccataaaaatgaatgaattaatggtattcacagcaacctggatgggactggagataattattctaagtgaagtaactcaggaatggaaaaccaaacatcatatgttctcactcataagtgggagctaagctatgaggatgcaaaggcgcaagaatgatacaatggactttggggactcagagggaaagcggggagggagtaagggataagatactacaaagtgggttcagtgagtactgctcggatggtgggtgcaccgagatctcacaaatcaccactgaagaacttacttatgtaaccaaataccgcctgcttcccaaaagcctatggaaataaaaacttaaaaaaaaaaaaaaaaaaaaaaaaactcagggaactgtaaaaaaaaaaataaacaaaataaaattctaccaaaaaaaataacgtacccaagtgattctaatgtgcaaccaaggttgaaatctactactctacaccatggccttatggctaacagaaaaaagaaataagagggtgtcaatttcctttcacaatggaaggggcaagagaaatggagaaaactgaatttaaacgacttccaaacatctctggtggaatccccggagtcataaatatccagaccacttgtctggtgtttctcgtacacgtcccaccatgtctttttccatttgtggatgtccattagtcaacgaccactaggaacacactttcatcaaacaaagttgggtttattgatccaatgcattggaggaaatggtgcaccgtggagaaccatgaggcatcagtgtaagagactgagcagagcttcttgcaggatttgggcttgtgccgtacactgtggaggaggtttcaaggaagcagggattggatatgtcaggaagggaggccagttccatgactagggcttatctaggggtcaagaggaatgaagttgacctaaaactctactttatttattattattattattattattattgttattattgataaagaagcaggcataaggcaggaaataaagatattttatgattcttatgctttggacaatgttcttgcttttgtttgtgctcagacacaattatgggccagtcttgtgtttgtctttctccatcattagctgcagagtggtccttatctgacgtttatcatttgtgaaattgttcctgttcaggaggacagcgggagagactagctggacatgccaggccagctcccgcctgtcagcagctgcctttttctttcccctatctcatcctctgttctccacattaactctgtgttgtttctttgcttctaaaatgtgtctgcttcttccacaaggtgatgaagttcatcttttcaacgtcctttataacacatggcacagtgctaggcacatcggcgagggaactctaacattctgaaaagaacatgaggttttgatttggaatcagaagacccgctttcaattcctgctttctacttgctaagtatgcaatttgggcaagtggctcaatttctctgagccccagatggggatgataatccctgtctagttcactggatttccaggaaaaggaaaatgagacaactctgcaaccacaaggagttgacaaagcagcagattctcgagaaatgtgcaaagggtaagtcaatgaagagaagaggtgattggtttgaccaatacctttatcaagagttgcaaaggacaatggcttaagagacctctaaagatgccatagtggatacaggaagtcgaaaaacaggtggagttctagtcacccaggtgatccttcagctcttagaaatggccttcaagataagcaactagaggttgaatttgtttagaatgccgcactccagcagtttctgcacgcctactatgtgccaggcattgtgatacagatgtagaaaaaaaaattagagttttttttttttccccaaagatgcttctagtcttttgggagaaagaaaggtttcaacttgacataataaacaatagaggcacttacaaagtacagcacagcatagagcaaacaggagttaattttgtcagtggctgggcagaagaagagccactggagatggtagggaaaaaccaaagaaaaaggagaatgcttcagctgggatttggggttttgtttgtttgtttgtttgtttgtttgaagtgaagtctggctctgttgcccaggctggagtgcagtggtgtgatctcggttcactgcaaccgctgcctcccaggttcaagcaattcttctgcctcagcctcctgagtagctgagactataggtacacaccaccacgtccggctaatttttgtatttttagtagagacggggtttcaccatgttggccaggctggtctcgaactcctgacctcaagtgatctgcctgcctcagcctcccaaagtgctgggagtgcaggtgtgagccaccgcacctggccaagctgggcttttgaaggatggataagaggtttccaggcagatagatgaggaaatgtgaaggggaatattccagcagaagtgtgaggggcagtgggttcaaaggtacaacagtatgaactactctgatgtaacccgagatcttgaaacccatttataaataagcggtgatatgagtgggtatgagacagtcatatccaccccagctcataacaacattgtttagggcacagccctgggctcttcccttggcatttgtctttttagcagacattcagaagctaatttaggggcagctgtcaagagctttgagcttcacagaccatgtgagtgaacttcctctgggtaaccaaaacggagagaaatctggccaaatgtactggccagagagaacttccttaaaggatccttttaaaatacactacatacaattcagaggagcgggtacctcctgggtaccttccactggggtggatattctttccagctcccccttgctgaattcacaccatagccaactggctaatgagccacttgagccacgtccacatgtcagctgtcccagaagcagttaaccttgaaacaattgtgccccgcccccgccacaaaggcaagcatacagtaatgctcacttctagaatccctcttctgggtgaccgagggcctgatgaagacacaggtgccacaacacatataaagaggccatcttcattggtccaggctactacaacaaattatcatagactgggtggctttaacaccagaaattcctttttcacagctctggaggctagaagtctgagactagggtgttaggatgatcagattctggtgagagctctcttccaggttatcgacagctgactacgtgtcctatccccacttggcagaaagaggatgggagagtgctgtaggtcccttaaaaaagggcactaatcccattcatgatgctccaccctcacaacctcattaattagttcccaaaggctccacatcctaataccgtcatattgggggttagaatttaaaaatgtaaactttaggccggccacagtggctcatacctgtaatcccagcactttgttggggctgaggcaggcagaatacttgaggttaggagtttgagaccagcctggccaatatggtgaaaccttatctctagaaaaatacaaaatttagccgggcacagtggtgtgtacctgtaatcccagctactcgggaggctgaggcaggaggatcccttgaacctgggaggtggaggttgcagtgagccgagatcatgccactgcactccagtctgggcaacagagggagaccctgtctcaaacaaacaaacaaacaaacaatgtacataaatataaattttgagtagacacaaacatttaattcaatacaaagtccaatatacacataattaaaattggtatatgaacaaataaatttaactagaccttgactttctcatctgcatctctagaagtttacatattcaacttgggtttttagaaaagcatttaaccatctcactaaaaaaatgagagttatcagtttcagaagaatttaatattgagtgctgtgagagaagatcagagaaaatcctgattaggagtaggaagctgtgttgaggaagtcaggtcttcaagtcactgtgccatcctcaggcaccacctacaaggggcactcagcactctcagagctgttctgattcctagtctgaacttcccctcccaaaggctccacatcctaataccatcacattgggggttagaatttaaaaacgtaaattttaggccagccatggtggcttatacctgtaatctcagcactttggggggctgatatatctttcatatagctttccatttttcccacgctgcctttgacactcctaggtatcaacctcgctctgtgctctcctattatcctaccctcttccctctataaaccttaggcttaaaactacttccctgactcgatccctactgatatttttctctttttacattttacatcagcatcctggaggtataatttctagataataaaatgtatccatcttaaaagcacagcttgatgagtttcaacaaatggttattcacataaccagcatcccaatcaaaatacaaaacccaaatcggtgccctcattctcctctgtagtcagccctttctgtgactatagattaatgttcctgttctagaattcattaagaatggaatcatacagcgtgtgctcttttgtgttttgtgtctgactgctcttattcagcgtgatgtctctaaaattcatccacattgttgtacatgccagtcgtttattcttttttttttttttttttttttctggcggagtcttgctctgtcacccaggctagagtgcagtggtgcgatctcagctcactgcaacctccgcctcccaggttcaagtgattctcctgcctcagcctcctgagtagctgggattacagtcgcccgccaccatgcctggctaatttttgtatttttagtagagaccgggtttcaccatgttggccaggctggtcttgaactcctgacctcagcctcgatccacccgcctcagcctcccaaagtgctgggattacaggtgtgagccactgcacccagccctcgtttattctttttgtggctgaaaagtatttatttgtatgaatatacacattcatgtatccatccacatattgaaagatatttgggtttttccagtttttgagtagtacaaatgaagtagctataaacattcaaagtcctgcactgcctttgttctatgtgcgaaaaatagttctttcatatatattgtccagttgtctaacgtctcatggtgggcaagataatctttagttattatcaacaaattggcctccctgccgcacccagacctgctgtcctcatcctattccaggatgcgctgtttggctcaaccctaagaccctcctctcccagagaagcatttctaccaggcgtgccgctgccctaaaaatagaaaacagatatttaaaaatcagactttggtaatcaggttaacatcaaccaatgaaaagtcatggtgacggcatgcattccctgacacgatgtcacaagaagggcacttttctccatagtattcttcaccaagactgcaacaccaggttgattaatcatgagaaacccaaattgacaggtaacataacacctggccagtactcttgaaacctgtcaaggtcaagaaaaaacaggaacgactgagaaactgtcacagaccaaaggacaggaaggagacatgaccacgaagtataaagcaatatcctaaatggggtcttagaccaacaacaacaaaaaatgacattaatggaaaaactggtaaatccgcataaagtccagagtttggtggagagtaatgtaccagtgttggtttcttggttttgacaaatgtacattccatgttgatataagaggttacaaaagaggaaactaggtaagggaactgtctgtactatttttgcaacttttctgcaaacataaaattattccaaaataaaaaattaatttaaaaaatgtcaagctgtaacagtctcagcccatgatggccaataaagcaataaccctgagctgtggccgttgagtctaagcctgctctgctgcccctacacctgcattttctgagaaaggtgaatgacccctcatctgtttgcacttccggtttattttttctttgctctttgtccagatcttcttgggatttgtgattgttacatcactgcattgttaatacagccagaaatccttcccgtggcctttcccacaggttgggtgataaactgccccaacccaaggagggagagacgctcctttgaacaaagcagagacgtgttcacattcaattccagctagctccaggaagaggaagagaaagctgtgggggcacataccctccaaagttctttgggtagcattatggcctctaataccctggcttttccatcattttccctttttcactggaaagcaaagcaccccagagtgggtaaggctgccattttacaaaccctgcgccctgctctgtagttttatttcccaaggttaacgatccaaataaatcggccctgtcttgcctctgctaagctgcttgagaaatgttttatagtcaacatagatcagattggtaccttattcctttgaaagttgtcctcggtagaagttctcgctctacctaatgaaccaatattagtttaactacatgttattaattaaaagtggaattttatgcagaatctttttcccctactaaagaagaaaaaggaatattgtacttcacagattcttaacagaatagtagtctctggatttatgggcctcttttaatggacatcatgaaatatcttttaaggctatcctacccttagggacttcattcttcttccacacaagatctggtcacaggtaactctctatagcccaggtcatttagctttcatgtgtgggagaagacctttcatcttaggttctcaaccttttcttcatcccaaaccttttcctggtaagtcaacatgaattgtgtgcacaagaaaacaaatgccatgtctcctggccattctggccacagatttaggggaatgtctttatttgggttattccagaagtaaaccctgaaataaggattcaagttgcaagtaccttattaggaagtgctccaagaccacatgagcagggagaagtaagacagggaagcgatggaaattcatataaagggggtgttatcaggtaattcatacaaacgggttatgtatgaataagttatcatataaagggggtagttattagtatgggtaactggggcttatctacactggcatactctggatccaatacagaatgcacacctcggagtcatccaccagggagactgggagctgggtcttcattcctcatctttcaattgtcacaggttggcagctactcctggggggtgttaatttcccaaccctcctggcctccccttctagcctctgtccatgggcagagtggactccaatgatcaaagagagccttcaagcaaagagacacaggcgctggcagttgcaaattaggccaacttccagggaaactgtgagagctgataggagatggctggccaccagaagtacatgcaaatcagtgcaccaaggcagagatggggatgcagcccagccctccagccctctggccatgttggataaatcacgcttctgcctttagcatcaagagaacacctggcatgatttcagacaagatcgggcacgttcagggttgtatggccatagacacctggcatgatttcaaaagtgtgatgggttagtccagctccaggaacctgctggctggaagtcagcatgctgcctctctttgtgtggtcctaggtagtgacacagtagaaagatgatgagccagtaggactggttctgccactagtggttaccttaggaaagtcacttgacctctctgaaactcagtttcttctatctgtgattgattgattgacagatagatagatcgatgagactatctaagatgtgatctcattagtacttaccctgaatgaaagctaatatatctcatctataattaagaaagctagggtgtcctgtgttgctgagtcaaatgagataatgtactcatcaggctctgttatgaactaaatgtttgtgtttccccaaaatttgtaggttgaaattctaatcttccatgtgatggtatttggaggtggggcctttagcatgtagttttacatgaggtcatgagggtggtgctctcataatgggattagcgtccttctaagaagaggaagagacagaataactctctccaagaacacaaaccacagaaaggccatgtgaggacacagcaagaaggaaactgtctagaagccaggaagaggaccctcagaatgagggtctgcagaatgaatctgcagacgacttgatcttggacttctcagctaccagaatcatgaaaaatacaatctgttgtttaagccactcagtctctggtattttgttacagcagttctagctgacaaagacagcatcctacaaaagataaggtagtgttgataagaactccataaggatggcaaaaatacagcccaaagtaacccagggtatcctgggttactaaagatattgtaaccaatgtatgaaaatggatatgagatttcaggggttgtaagaaacataaatatcaaatggaactcatgatctttgtttggatcctggctttaaaaaaacaattataaatatatatttgaaacaaatggagaaatttgaacatggagcaacatattagatgatattaaggaatttgtatttattttgttaggtgcaatatggtatatggtactatggttttgtaggaaagtgatctcttttttttttttttaatgcagtcttgctctgtcacccaggctggagtgcagtggtgtgatcttggctcactgcaacctccacctcccaggtttaagtgattctcctgcctcaggctcctgtgtagctgggactacaggtgcccaccaccacgcctggctaatttttgtatttttagtagagacggggtttcgccatgttggccaagctggtctgaaactcctgacctcaggtgatccgcctgcctcagcctcccaaagttccgggattacaggcgtgggccaacacacccagccaatctcattattttggagatgcaagttcatatacgtagaggggaaatgttatgatgtctgcatttaatgtaaaataattgagtaaaatctggcaaaatgctaacaaatgctatgtggtagctatattcattatactgttttctctactttttatatgtttgaaaagttccataataaaaattttataatgttttaaaggaacttttaaaatatatttttcaaatatcaaaaaaagtagacagcacaattgggatttatttatgttgctgtattgaaccctagttcatttattttttattgaaaattttattgggataattatagattcacatgtagttgtgagaaataatagagtttccatgtatactttacccagtggtaacattttgcaaaactagggtataatatcataaccaggatattgacattgattgaatctaatcttcttccaaattcccttgttttacttgtactcattggtatctatgtgcatagtgaactgtatacaattttatcatgcatgtaaatgcgtgtcacgatactgaaaagttccatcactccaaggatccctcatgttgtccttttaaaaccacgcccatctccccttcttcaccgcccccatctctaaagtctggctcccctacttttaaaatttttgtcatttcaaaaatgttctataaatggaatcatatagcatggagcctttagtgatcagcttttcttagttggcataattccccggatatttatttgagttattgcatgcatcaaaagtgtagccctttctcttgttgagtcctgttccatgaaatctccctatcacggtttgctaaaccattcacctgttgaaggatgtctgggctgactccagtttgggggctattacaaataaagctgttataaatatttgtatacaggtttgagcatacattttcatttctctggcagaaatgttcaggagtataattgctgggtcatatgctaactgtatgattcattttatttttaaaaactgccaaactgttttccaaagtggctgtatcattttacattccccaccagcactgtgccagggatccaggtttcccacaaccctgtcagcatttgctgttgtgactactttttattttagccttctgatagatgtgtagtgatttctcattgtcttaatttgccttcccctgatggctaaagatcctgagcatcttttcctgtccttatctgccatctgtatatcctgctctgtgaaatgcctgttcaggctttcccatttcctaattggactatgtttgttttgtttttactgttgaatcttgggagttccttgtatatttagatcctaacaccttgtcagatatgtggtttgtaaatattatttcccagtctatcatgtgtcttcacatgagctttctcagagcaaaagtttttagttttgatgagatccaatttaagctcatggattgttcactgttctatagtaatccactgtggctataccacaatgtgtgggccagaccaagtgacttcctgctaacaaatagaatatcactaaagtgatgagataattgaggttaggctgttaaaaaaaaaaaaaactgtgacatctgtcttgcttaccctctctcactctctcgctggttcactctaagagaacacagctgccaagttgtgagctgctcaatggagaatcccaggtggtaaggaactgatgtctccagccaatagccagagaggatctgaggctgccaataaccaggtgaatgggcttggaagtggatcctacccagtcaagccttgagatgatggctgtagcccagccaccaccgtgatcacagcctgtgagaaggactgaaccaggggtacccagccagttcccatcccaaagaaacagtaagaaaataaattgtctaattttaagcttctaagtgttggcataatttgctatgcagctaatacacacaatatgtcttatttatggccatttaagatgtttccattttttattattataaacagtgaagcaatgcggattcttgtagagatgtacttaagcacatatggaatagtttcttggggtgtatgcctggtagtgaaatttatttattcactatggaatatcaaatgcaaaattttactagattttaccaaactgttgtctacagtagttgaaacattcccaacaaaaggtatccccatttcgccacattctactcaacttttggtactgccatattgatgggtgtggaatggcatcatatttctcaaaaaaatttttgagatagggtcttgctctgttgtccaggcaggagtgcagtggcacaatcattgctcactgcagcctcaaaacttcgagactcaagtgatcctcccacctcatcctctcaagcacctgggtggaaaggtgcacagcaccatgcctggctaattttgttcgttttttttagggagacagggttttgctatgttgcctaggctgctctcaaatcgctgggctcaagtgatcctcccgccttggcctggaaaagagctgggcttacagataggagccactgtgcctggccacttaattttcaaatttaattaccctaattaataaagaagatctcagttcatatttatcggtctttggggtttcttcttctgcagattgcctgttctcatcattttccccttttccctttggttgtgttaaattgttaaattaaataagcaggaggccattggcctgaggctgtctctgtactttgagttcgtatgtaatggactacaacctaatttagcgtgtaaacaaaccaaaatataatttaggagtctattttttgtaacagagagccaggtctccaccaatcacaaacagccaagcctcaccaatcacaggcggccaaccgatcagaccatgtccaaataaggcaaagcccagctgtaacctatcaagctatttctgtattttacttccattttctgtctataaatactcactgcccactcagagatgagctctccaaacttctcctggttctgcatgctgtgtgattgctgtcattctttgcccaaaaaaactctgctagatttatttttgttaaaagtttttaacagttgtgtgtagttggaattgacttgtaggagttccttatgtctttaggaaactaattctctgtattgcaaatgtattctgctagtcactggtttgttgttacactttgcttatattgtattcaacatacagaagttttaaatttagtgtagccaaatttatcaattgctacacttcagggttctactttcttcatcttaattaagcaacatgtattttcccaagatgtaaagatattccactttagttccttctaaaagctgtaaggctttgcttttgttacatttagatctttgatccacctggagtttagaatatgatgtgacctaaggatgtactaagaaggcttttctgatttgataatcaataatcctattcatttaatactttttcccactgattttacttttctcctgctgatcttaaatgccgtctttgtcatacaaccagtttctctctctctctctctctctctctctccccctctttctctctctctctctctgtgtgtgtatgtgtgtgtgcgcctgtatgtgtgtgagagagaatgtgtgtgtgttatggggttctagactctgttctgttcacttcattagtttattgtctatgcctgtgccaataccacagtttgttaatggatatatgttttgaagaggttttgatatcaagtagaaagagccccagctctgttctatttctaaattatcttcccttctctttgcccattattcctctgtatggttttcagaattggtttaccaaacaccaccacaatcattgtttggattttgatggataaaatttattattgtgggggggggagtaaatttgcataacaataatattgagtcctcccacaagataaaaaacatcctaagcagagaaaaatcaattcttacaaaacatctgaaaatggttgtattttatgccctcatccaagcatgtaaagactgtctatagagcacctgctaagcttgaacttggctctctgacctattatctatgtacatttataacaactcccagctgtccatcagacacccatgttagatgtcgaaatgtggttcttagtgctgtttgtcagtattctacacagaaacccaggaatgcccaaaccctttcctgccaatcagcaccagcgacctttatacacaaaggacaatagaagaataaaaataagaataccactgtattaagatcaaagcaaacacccaatatctcagtgtaataattatctgtgaaaagtttgaatcatgtagcttaagcattttacccaagcaagggcttctcctccccctctataatctaaatcttggaacaacttagaggtaagcagaagagagataaaggagaaagaagactggcctgaagggcaaattctggtctaacttgactaaccaactttaagctcagaagaggtaataaaaaaaaaaaagatggagataaagggtggcctgacattaggtctgtaacaagaatcacaagaggagagagtagagactaggattctgcctaaagtacacaatatccactgcatctagtaaaacagcactcaattaatattataggtgccaaccaaggaatagcacctcctccttccttgagtagagagttaggaagatggcaatggaagtgaacttggtataagcagatgcaccaactcggattccctccctcaaatttgttcacaggccattcactcactcagttgttgttcaatcatttatttctcaaacactgttaagtacagtcagtcctcactacccacagattccaaatttgagggatcacctgtcttggtctattttgtgctgctataatagaataccacagactaggcaatttacaatgaacagaaatgtattggctcatggctctggaggctgggaagtctgagattgaagcagctggcatctagcaagggactacttactgcttcatcccgcaatggaagggcaaagagaggaggacagagagacaaaagggaaccaaactcatccttttataaagaaccaactcccaaaataacaaacgtactcctgtgataagagcattaatccatttatgagggcagagccctcatggcctaataatctcttaaaggtctcacctcttaatactgttacaatggtaattcaattttgacaggagttggggaagggggtaaatattcaaaccatagcatcacctgcctactataatttatttatgatctttaaatgctttggaggtctttgcagataaatgaagaagaataaaaaagtttgaggcactcaacatacacattcccagtagaggttaaagcaacactctgccttcttgcttcagctctcctactacaaataaatgtccttcttgcaatcaacttagtcccatatttttgcatcatatatatgtgtgtgtgtgcatatatatatatgacgcacatatatatatatgcacgcacacacatacatacagtatatatactatatatggtatatatacaccatggattactattaagccattataaagactaaaatcatgtcttttgcagcaacatggatagaactggaggcctttatcttaagtgaaacaacttagaaacaacttagaaacagaaagtcaaatactgttgtgttctcacttataagtggaagctaaataatgtgtacacatgaatgtagagagtgaaataataaacattggagacttggaagggtggaagggtgggaggtaggtgaaggaagagaagttacttcatgaggacaatgtatatcccttgggtgacagttacactaaaagcccagacttcatcactatgcaatatatccatgaaataaaactgcatttgtaccctttaaatttatacaaatttatttattttcttttattatactttaagttctatgcagaatatgtgtgcagaaagtacaaggttgttacataggtatacaggtgccacggtggtttgctgcacccatcaacctgtcatctgcattaggtatttctcctaatgctatccctcccctagccccccaaccctctgacaggccctggtgtgtgatgttcccttccctgtgtccacgtgttctcattgttcaactcccacttatgagtgagaacatgcagtgtttagttttctgttcttgtgttattttgctgagaatgatggtttccagcttcatccatgtccctgcaaaggacatgaactcatcctgggaatatacccaaaggattataaatcgttctactataaagacacatgcacacatatgtttgttgcagcactgttcacaataccgaagacttggaaccagcccaaatgcccatcaatgacagactggataaagaaaatgtggcacatatacaacatggaatactatggagccacaaatttttttaaatgtcgtaagaggtaagactagattgggtgccagaaaacctggatttgagtccaggttctcctacacaatgaatctatttcttggatatatcatcaaatttatcttggccttcattccttcatctataagactgatagcttgccttctaagtcggaagactgtccaggagacaaaagggtgtcctttgcaggaacttcaatatgaatggcagctgctggagttatgtagggcactaccagtgcaggttaatgcagagaccctgcctccagcatgccatatttcctcattttcaatgattacaatggcatttgggttttcttcatctctgcaagcttaattggatcaagctctctccccaatgcctcagaagatgttctgtgtttctgtgctgatgtaggaagtttcttgacctgtaagatcctggaccttgataaatccattcccaaaataaaggccactatgtggggtttcttgtgagacagttaaaattctgctgattcctccctgactttactgccaactgcttttacattctaacagacggtctgaccttttcagagtctccgtttcctcttctataaaaagaggatatgcaacaattggaattccataccaccgggatagaacaaacccattacagggtggggacgctttctttgcactcttagaaagtttaaattcataacacatgctcctgtcttcagccaaagtgtaactccaaaattgtttaatttacatttaattatttattctgctgttttgccttctccagttactaatagataattgcataagaggaaatgaaatccaatacacaatagtagtgcgagatcaatttacaggcaaattcctggcttggaaacactgaaatgggacacaagtgattcagtacaaagcaagcagggagatggtacccccccacacacagccctttaattagatccttaacttatttaatgacacctctgggtctggaaagctgttattgtttaagcgtttaatgtaccatacaattcaggggaaggagattgggaaggaaaacgacaaaatgcttttaggactcaagttattggtgtgacctgcctggcatccccaagcaatcctggtgatgacattttgcgttctttcccccttctgtgtgtcagatattggtggaaagacgcttccggaaacgctgtgcagcaattgccctcaaaagtttattttacaacctagcaatgatgtatatttccacttcctgcctcagcacattcataatcaacaagaagtattgttttccctgcagttattcttcaccttgggtaaaaaaaaaaaaatcagagtccaagaagaatgggcaagaaatgcaattattggccaggcacagtggctcactcctgtaatcccagcactttgggagggtgaggtgggtggatcacctgaggtcaggagtttgagaccagcctggccaacatggtgaaaccccatctctactaaaaacacaaaaattagccgggcatggtggtccatgcctgtaatcccagctacttgggaagctgaggcaggagaatcacttgaacccaggaggcagaggtgcagtgagccgaggttgtgccactgcactgcagcctgatgacagagcaagattctgtctcaaataaaaagaaagaaaaaagaaatacaatcatttttctaaaaccggatgtactttattaccagattttattttaaatggaagataggagcttgctctcaataactttgaggtccccctcccgctgcggttgcctctaagcatgcttggtttcaactctccacgcattcatcaacctgtttccagtgcttgtctttctgggtgagggtataggaataaaatgcaacctccctatcagaacaagcatgtattctaggtgagcagtgtctggattcaatcatcttctttctgctcttctcactagagctgtttctattgccggcagtgtctcattcaatatatttttctgtctacatttagcttctccttgtatttctcctctcattccagttatgcattctttgtgaccttttccacatgaatcaaacaccagagattataggtaagagagctgaaaacacgggcgagaactctgagacaacttaatagaactctcagctggtaaagaaactcccacaggtaaagaaactgaggttcagggacatgtttgggccagaattgggactagacgccagggtatcccagcagccaactaatcccccctcactaggaataaatagttccaattttcctaacatctgaggttgagaggtggggcgcatcaactgtgacatgtctgagctgcatagaggatggggtattgtgttccaatgcagctttttctctgatggaaaacctgaaattcttcagagacgtgcgtaactaacgtaatcactgtctttgggcagggggctgttccctgcctcaatgttctcatctgtaaaatgaagaaaacaacagtattctcacaagaattaaatgatacaataaagataaagcatttagtatagttttttgtttatttgtttgtttgtttttgtttttgagatggagtctcgctctgtcgcccaggctggagtgcagtggcgcaatcttggcccattgcaagctccgcctcccgggttcacaccattctcctgcctcagcctcctgagtagctgggactacaggcacccgccaccacgcccacctattttttttttttttttgtatttttagtagagatggtgtttcaccgtattagccaaggtggtctctatctcctgacctcgtgatcctccggcctaggcctcccaaagtgctgggattacaggcgtgagccaccgcgcctggccagtatagtttttgatgtagagtaagtgcttaatagacgttagttatcattaaatcatcattaccatcatcatcatcatcttatcacttattgtttggagacctctgttatactttgatgcttgaatcattctgtaaaacagcagtaccgctggaagaattcttccagtcattcattgccagatatttatgtaaagggtaattggcaaaatagcacttccttcctctgcatggtgggaaatgatgcccttgttagcttttctttcctgctgggaaaatgctaggccataaataaacattgaaatatgaaatactcaatgaatgaatgaaaataacatgggggtataactagaaaaaaagtctgcaaaatgttataatcaactttgagttttaatatactattaacagtgacagaaataactacaaagagggctcacagaccagacaaatttcctctttggatggccaaacatctgcagtaactgttcttctttattcttctccttcccagcctaaaggatttggtatacctctgttaaggcctgaagatgtgtttgcctggagtaactacagccctctacaaacaaaaaatgaaagtcggaaagtgaagaattagggttgccagacaaaataaaggaagcacaactaaatgcgaatttcaaatagataagagaattattttagtacgtctcaaatactgcatgagcatctgttattttgatacttggttttgctttgttttgtttctaaatctggcaacccttcaaataatacccattttccctatttggcatataaaacataggtaatttagtagtctgtctggcagtgtctggtaagaacttatttggattatgaagagatgaaacaagaccactgtacagataatcagggatctccctgagaagaaatagaggtggcctccacaggctaatgaatccatcgcctgaaatcgtaccacttacagaacgggttaaggtttattttgaaagaggaagaattagaaaagacttagatttgagagagtgtaacatatttatagaagcctatttttatgaggtatttttagactagagcgttacctgattcccatggggaattctatgttttaataaactccaaagactcaataatgggatattatatttgtgctaatttcactatcccaatataccttagtatttgggatatggggagagatattctgacccaaaaaaattatgtgccagacatttaatacacgttacttcagctagtccacagaacaaccctgtgaaatataaattggggttcagaaagttgaaaactaactgaaaaatgtgtacataccatatgacctactaatgccaccctcggttatttcccctcaagaaatgcaaactaggctgggcacagtggcccacagctgtaatcccagcactttgggaggccgaggcaggcggctcacttgaggtcaggagttcgagaccagcctgggcaacatggtgaaaccccgtctctactaacaatacaaaaattagccgggtatggtgacacgtgcctgtaatctcaggtactcgggaggctgaggcaggagaattgcttgaacccgggaggcggaggtttcagtgagctgagatcgcgccactacactccagcctgggtgacagagtgagactctgtctcaaaagaaaaaaaaaaaagaaatataaacttatgttcatacaaacacctgtacacacatgttgatagcagctttacttgcagttgccccaaaatggaaactttattcataattgccccaaattgcccctaaatgcccttcgatgggtaaaaaactttagcaaactgtggcacaccgatacaatgaaatgctattcgacaatgaaaaagaatgaactactgatatacacaacagtgtagatgaatctcgaaggcatcattttgagtgaaagaaaccagtttcaaaatgttacctactgtgtgatttcgtttatatgacattcttgaaaagacacgaccatggtgacagagaacagaccacaggggttggcatggggattagagcatgactaatactaggatagcaggacggaggtttctggggtgatggaacagttctgtattctgattacggtgattatataaatatatgcctatacagtcatagaaccgtacatgaaaaaatcagttttactgtatgataatgttaaaaaataaaattaacttaaaacacagaactagcaaatttgaggattggcattcaaatcttggtcacttgaaccctgtaagaactccctaaaagcaactataagtcagttgacaacatgtttcaagatggcaaggatactgatacatacatatacatattatacgtatatacacacgcacacatacacacacacatacatacatacactacgtatgtgtgtatatatattcctcttccaagtgcttagcatagcgtctggaaagttctacaggaatagcttgaatttttggcctgtaatactctatttgcttaattgctcaatgcccctgccagctgggagcttgactaatcacctacgctaatataaagtcagtgccaatggaagctgtcatttttctgtccttcagctggaggactttctttttttttttttttttgagacggagtcttgctctgtcacccaggctagagtgaagaggtgcaatcttgactcactgcaacctctgcctcctgggttgaagtgattctcctgcctcagcctccccagtagctgggattacaagcgcctgccaccacgcccggctaattttttgtatttttagtagagacggggtttcaccatgtttagccaggatggtctcaatctcttgacctcgtgatccgcctgcctcagcctcccaaagtgctgggattacaggcgtgaaccaccgcccagcctcagttggtcatggttttcacctgacctttcccttgagcccctggctcaacagccccatgtcaatgtctactagtcacctcaaactcaacatggcctaaacagaactattgagttcctgccccctacataaaacttcaaacaaaaaaactccaaattaaagcaatttttctttcccatgtcagtaaatggcaccaacattcatccaggtgctcaagccaaaagctgaatatcactcttgattcctccattccctcacctccccattgccagctcatccacccccatcaaatccatcatcgtctctccatctttatccctctcatcctgatccccatcttctacctggaaaactgcaagagccttgtctttgacatcccagcttccacacttgccctgctatgggtcattttctgcagaatgagctggtgttttaaattaaaattgcatcatgccactaaagccctacccttcttcctttcatgcttcaagtaccactcattgcctggactgctatgatttgacccttcctcacctcactgatcctctttcaaatgtccctttcacataggcttcaggcacctttgcttttatactggttatcaaatatgccaaactacctcctactctagtgcccctgtcttcactgtcccctcagcctggaccactcttcccctagatcatggctagtttctccatttcatgaaggtctcaccttaaatctgacctctttgcatgcaacttatttaacctcccaatccagagaagcctctttcagatcaaagagcatttattattttcattaaataacctgatattcttatttacaagaataagttgtctgctgttctcctctggaatataacctccatgagtacagagttttcttctgctatagcctcagtgctgagaatgctgcctgacacctagtaggtgtgcagtaaatgtttaatgaatggattggaaagaaaatgcatgcaatgtatgcaaagaaaaaataattggggtatccttggagaaactctaaaagactgcgtaagtgggctgacagattccagaggacacatttaaagaaaaaaaatccctaaggtacaaaagatttcagaaaaaaactacagtccaggggcaaaaaatgtccttcactctctgtgttaaaacttcaaccccaaacacttgggagcttcttccctcaaccaatcaggtacctcctctgagggtaaagagcatggcagatattccaaaaatgaattagtatgtttattaggtcacatcccccgagacaaaccacttgtctcatcaaatttacagctgtctccaaagcatggaaaatcctctccaatcagcaagttacatgggccgacttaacatattgtacaatgttgatttatggtgacaattaagaacgtattaccaaagtctatttcaccattaacacccctggggactgaataacttctaaatcttccggctgctacctcccaaaaggcttggatcttggctaaggatttagagattataaatttaacaaaggatgaaaactgcaagaggagagtcttgaacagcaaataatgagtttaaccagcttctcaacttctcggtgagatttataacgccttcctgcctgagggcaaggaatcttttattttgaagtttatagcctctatcacttattgttttagctccagatgtgagagtctggcatttggatgggattctttttggaagccagtattcatcagttcagcaaatctttccttctgacagtctttttggagaacagtacagtgaccagaaggcaacgactgtcacttccaaagataggcacctactacttcaacaagttgctggatgtacagaccctgcattgcatattcatctgaccaaaaagcccaaggaccagacttctaatagtctgacatgaaataactctaggactaattggttccatggttctagagttggattctcaccagtggtgcagctgggtcacctttgtgatcaccagtaccagcaaagaaacatgagccaatcattatctacgtagggttgaactggccaagtttgagtgccaatcacatccaggtcacattttcccaaagtatggatcagagaccatcggaatcacccggggtgctttcaaaggaagaaaaaccctctataccaaacctacttaatcagaatctgtggaatttggagttaggaaactccattcttttttaaaatattatttatagaggtggggtcttgctgtgttgcccaggctggtctcaaactcctggactcaagcgatcctccctccttggcttcccaaagtgctgggattacagatgtgagccaccacccccagtcggaatctccattcttaacatgctctatagattattctcatgcactctaaattttgggaaactcaagctttgttgtaatgcatgcaacccaacctggaaggacaagtcacctactctgggtggagacctcaagtgccaccagtaagcatctctctgcctttcgttattttcttctgaaaatgtaactcatcctcagggccccatggagagaaaggaagatgaaattcctgaggagagttcatctctctgagatatttacctttcactggaccacccactagcataacatttctgtacaatcatgctcagctttgaggtgaaatacgtgtctacaaaatacttggcactcttcaggttgttagaatatttttagaaatgaaaataacttgagaactcagtaatgaatatacaatagaagcatttcaggtatcatgaggttggtggaagaaaaataattttactctatttataggcagaactatctatcctctctctgactctcccccagaggagaatcatatgaagtttggctcctaggacatgtattagggactggaaattcgtcccatatgtgagtccaaatttcaaagttatccagtaatgaggatttcagagtgtggcattttgccacggggtgaactgaccaccaagtgcaataagtgctacgtgcaagcatgcatacacatgtatacacaaataagcctgggaaaggtactattctgtttggcaggaattggcagagaatagtggttcaatgaacacaaagtttatagattccagtcaccagaatctatctatctatcttccttccttccttccttccttccttccttccttccttccttccttccttcctttctttctccctccctccctccctctgtcccttccttccttccttccttctctctctctctctctttcttctttttttttttttcttttttttgagatggagtctcactctgttttccaggctggagtgcattggtgtgatctcagctcactgcaacctccgcctccccggttcaagcaattctcctgcctcagcctcctgactagctgagattacaggcgtgcaccaccacacccagctaatttttgtatttttagtacagacagggtttcattatgttggccaggctggtctcaaactcctgacctcaagtgaccacccgtctcagcctcccaaagtgctgggattacaggcgtgagccaccgctcccggcctactctggttaccagcatcttaactataataatcaaaaagcatcaataaacatcagatattcgactgtaacatttctcttacaagttacagtttcacaacgtgacttggatgtgatatggcacactgatgtgactattgtggtgactaacatttgttgggacttttacatgtgtggtaggtgatcgtcactaccacgtacgagttaggtgaactttttaatcttcattttacagatgagaaaacaaaacatttaactgacctgccaagattatagaggagagaagtgagggagatagggttgaatccagatggtctcactccagaggcaacttcttcagtaaagggccacgtaagtaaatgttttagtctttgtgagtcaaatggtctttgaggaaaggactcagctctaccactgtggcatgaaagcagccatggacagtaggtaaacaagtaaatgtcgttgtgattgtgtgtcaataaaactctatttacgggcaccgaatttgaatttcatgtaattttcacatgtcttaaaatattactttggggttttttttttcaagtatttgaaaatgtgaaaactatcattatcacatggtccatacaaaaatgggtgatggggtggattttgcctgcaggctgtagtttgcagaccccgatctaaagtattgacccttccaagatttagatcctgccttttcctaccattttgtagttgtgataacttgagcaagtcatttaacttctcagtttgcttgctcttagtcacttaatcttttaccttgatcgatggtatgcagtcagctattcatacattcatatattcatttaacaaatatttattgaacccatgcactgggctagatactggaggtgctagattttgtccctgccctccctgagcttacatttcagaggaaataacagataaataagtaagtatcttactttcaggacaaccaaatagggtaaggagctccaaccctatcaaaggcatcatggggaaattagaaagtagagactttttggacatgggcagttccatgccaggagggggacctcaaatcatactttcacctctcctgccctagactgatcctcttgggagagcactgaattatctaaattacagaacctagtacattgctctaattctttgacaaaagatgaatttgtttttcattgccatgttacaagttatcatacacttagcagcttaaaacgacatatatttattatctcaagttttcacagatcaggagtctagacaggcttagctgcctcttctgctcagagtcctatgaggctgtcaatgaggcatcagttgggctgtgttctcatctagaggtttgagtagagaaaaatcagcctccaggttcattcggattgctggcagaattcattttcttgtggctgtagatctcatggtggcttgcttcttcgaggccaacaggataatgaaaatgagtgttctcagagtcatatatgtagtaagatagtgagggccatgatatcccatcacctttgccatacaatataattcaatcaagccagtgacatcctatccatcacctttgctgtattctgttggcaagaggaagtcacaggtcctaccacatggaatgagaggggatcgccaagacataacactagaaagcggaggtcactggggttgtcttggaatcctacctgccataaaatatgccatctgaaacataggaccgatagtggtgcctgggtcaaagggttgtcttacatttaaagagcttaaaacagagcctggcacaaaggaagaatcttttttttttttttttttgggacagagtcttgctctgccacccaggctggagtgctgtggcatgatcccagttcattgcaacctccacctccagggttcaagtgattctcctgcttcagcctcccaagtagctgggactacaggtgcaggggcaggccactatgtttgggctaatttttgtatttttagtggagacagggttttgccatgttggccaggctggtctcgaactcctggctgcaagtgatctgcccacctcgacctcccacagtgctgggattacaggcatgtgccactgtgcccggccaggaagaactcattttgttttccttatcatctgccactatcattattaagaaggttccagccatgtctcacacagctcagagcatcctttagcctcttcaaggtgatttgggatactgggatactcctgtgcagagagcaacttcccttctctacctccagggatgtctatgcaacacttactgaatccacattacctctgacatcttgaacttctcacgctggacctaacagctctgtgccatctcattttctaggtggaaatgtttccttcagagatagggtatgtcaacttttgcccataacctctgagctcccaaattccaattttctttcattcaacaaattcatcttacaatcttttattgtgtgcctactatatatcaagtgctaggctttctccttctcagtaggtctgtgccaatccataaccccagaactttttctcattttgcctcttttaatttggcaaaaattaaaaattaaattaaaaaattaatttttaaaatattaaaaaaattaaacatttggcaaaaatctgtcgctttttcccattctagttaagattaggtttgtgttttaagggcattagctgcagctttgtgctgttagagaaatagtgcatcttattgacctgctctcttattttatagaactgcagagaactggcctggtgcggtggctcacgcctgtaatcctagcactttgggaagctgaggcgggaggatcacgaggtcaccagttcaagaccatcctggccaatatggtgaaaccctatccctactaaaaatacaaaaattagctgggtgtgatggcacactcctgtagtcccagctacccaggaggctgaggtgggagaatcacttgaacctgggaggtagaagttgcagtgagccaagatcatgccactgtgctccagcctgggtgacagagcaagactccatctcaaaaaaaaaaaaagcagaaaactaaagtttcttttctctcttctctccatatacacacatatatattttttttcctactgccttatctgccttatcctgccgtttagattcaaattgctccctgcctcctttctaagtgattcccctcaaaaacctggaaaattagttgacgggttttttttcttttttttcttttttctttttcctttttttttttttttttgcctctgatctcctagaaattcttttagcaagatttccctcaaactacaagattcaagtgattgtcactatataattagtaataatagaactattaataatgatgatattaataacaagtaatactgctagagctcttccgatattccagggtatgctctaagatctttgtacattttagcctatttaaccctcattttggatatcaggaaactgaagcgtagagaaattaagtaactcgtcaaaggtcacacgacttgaaagtgacagctgagattcatgctcaagctaattccaaggtctacacttttaaccactatgtaattttgcctcttcacatagaccatgagaaaaatgttagtggaaacagaattccatatccagaaatagactatgagaaaaatgttagtgaaaacagaattccatgtccagaaatatactttgaatccaaatgacagggcaaggtagtagggtaatacggggagaaaaaggaaaaattttaacttttcacccctatgaaatgcgactgagggtcaggtcaataggctgggctctatctctgatatctcaatgctctaaatattgcttttaccaaatcatcccagatgaagtgcaacatgagaaaaagtgatgctgaatccaagttaaaacagtcatgatgggagagggtatggattcgccagaactagagtcaaatcctagtctaagacttaatacccacttgaagattgggggacaagaagtgtatgcccaatttcatttgaggaaataaatgtctgttcctaaaatcaagctagtaaattacaaatggattctatgggtttttttgttttgttttttgtttttgcagttgcaagatttaatagagtgaaaacagagctcccatacaaaggcacccaaagagggtagctgttgccagctctaaggcctgggtttatatcccgatcattgtccctcctgctgtgctctcaggcgatagatgactggctgtttccttacctcctgttttcgcctaatcagtattttagtgagctctctttactacctgatttgttgggtatgagctaagttgcaagccccgtgtttaaaggtggatgtggtcaccttcccagctaggcttagggattcttagttggcctaggaaatccagctagtcctgtctctcagtccccactctcaacaggaaaacccaagtgctgttgaggaggttggctgatgaccactctaactgcttcctgatgaattggggcatagtaggggtcatgcagttgagatttccttgggaggggtgccttcggtgtcatcaacatcggagtgtgggctagcagaccagtccaggggtccatggtagatcttagtcatggactgcatctggggctccatttgaagaacctacaaatggattcttatccattaattagaacatgctgctatgtctaagatacatattctagatagtgatattatttattttattttatgtttacttatatgtattctagaaagggatgttatttattttattttacttctattgctttatattttttcaaggcaacaaaatcaagatatacaaaattataaataatatttaattattaaatattataatattagcaccaggtgtggtggctcacacctgtaatcccagcaactttgagaggccgaggcaagcagatcacttgagctcaggagtttaagatcagcctgagcaacatggtgaaaccccatctctacagaaaaaaatacaaaaaattagctgggtatggtggcaagcacttgtagtcccagctatttggaaggctgaggcaggaggattgcttgagctgtggaagttgaggctgcagaaagccatgatcgcaccactgcactccagcctgggtgacagagagagattctgtctcaaaaaaaaggttatagtattagtactcaacatgggaaatttcacttcatttcttttttaaaataattaaaactttttttttttgtaatatttggcaggagaatccagtccatttattcagcaaatagttacttacattgtattagtccattgtcacactactgataaagacatacccaagactgggaagaaaaagagttctaatgggacctacagttccacatgactgaggagccctcagaatcatgacaggagatgaaaggcacttcttacatggcagtggcaagagaaaaaatgaggaggaagcaaaagcagaaaccccagataaacccattagatctcgtgagacttactcactatcatgagaatagcacaggagagactggcccccatgatttgattaactcctcctgggtccctcccacaacacgtgggaattctgggagatacaattcaagctgagatttgagtggggacacagccacactaaatcacacattcacaaggataatatttgctatgcttctacattgagccaggctctgtgctaaacccttggtctagaatgggttatctagaccagacccattctttaagcttcaggtgcttactctctactgagtattgaaccataggagactgcaaatattcaatcattttttacttataagaatggcaatttcctataatccaaccttataataaggaaatatatcaaatgattacacaaatggaagtacaattataatgtgagataacagccatgtaggaaaatgtaaggttctacataaatcaggaaaaagacaaaaggctagtttcggaatagtgttggagattcttcttttctaccccatgttgctttccaagtgcagagagttccattaatcaatcagtcctaacctccctccatcttcctcccctggaaaattagggagagaactgctgctgggccccttccttctccttcctcttaggagctaaccactacagaaaacctgctttgctctgttcctctatgcagtgtttttgttttgttttgtttttattgtggtaaatatatataacatacaacttaccattttaaccatttttaaggtacagctcagtggcattaagtacattcacattgctgtgcaaccattaccaccattcatctgcagaacttttatcatcttccccaaattgaaactctgttcccactaaacaactccccattctccctctctccagcccctggcaactaccattctgctttccgtctctataagtttaacaactttagatatctcatatgagtgaaatcatacagcatttgtatttttgtgactggcttacttcacttagcataatgtcctccaggcttatccatattgtacaatgtgtcagaatttcctttctttttaagactgaataatattttattatgtggacatatgacattttgtttcatttaatgacattcatttatcaatggacattggaattacttcctcctttggccattgtgaaaaatactgctgtaaatatggatgcaaaaatatctgtccaagtccctgctttcaattgttttaggtatatactcagaaatggaattgctgaatcacatgaaaatttcatttttaattttttaagaaaccaccatactgttttccattgggatcacacaattttacctcctcactggccatgcacagggttccagtgtttctacatcctcactgacacctgtattttcctttaaaaaaaataataaaagcctttctattccaaggggtgtcaagcggtaactcattatggttttgatttgtatttccttagtgattattgatgttgagcatcttttcatatgcttttcagccaattgtataccttctttggaggaatgtctatacaagtccttcatccatttttaaatcatgttttttgtttgcttgttgttgaattgtaggagtcctttatatattctggatatctttctcttatcatgtatataacctgcaaatatgttctccaattctatgggttgccttttaagtgtgttgatagtgtgctttgatgcacataagttttaaattttgatctattccaattgatgtatttttccttttgttgcctatacttttgatgtcatatcacgctgaagttttacaaaggcaggcccaccatggggcatcccggggggtctggtgatgcctgtgactaagtggtaagtctagttaattctggattcagtataaaaattttacccacagaaatgagccatattttccaacgtcagtttttctgatttaacaaagatgtattttgatctccatctgaatcactccttgactttttcttaatttgtttagtatcaacttatgcccccatccaaataccaaaaggaagctgggcatatgcggtttttggaacgatatctcaagaatgcatagaagttaacaatttaagggaaaagacaagagtagatcgttcaaggcagggcaatgaaaagagagtatacaaatgtcctatagtaggagaagtataatatgattttacaaaaacaccaaaaaaaagcctaataaaggccgataaaaagcacagagaagagaacaaaaagaatggggtgaaagatgaggttccagacaggagcacagccagggtcccacaccggcaggatcttgtagaatattgtgtctgcccttaactagaaagagttaagcctatgatccttaaaggtttgcttaccctcattcctgagcataagtaatgaaagcatcagatttcccctagaaggcgaagattcctattgaacaatacagataagcatgccattttgctgccaccaaagccttaggtcagaaatgctttaattggctaagaagattcccttatatcaaaaacaggaaaacaaaatcatgaaaaaaggcaacacaaattaaactaacaaaataaagtgcttggagtgggaagacatcattattattcccctaaaattgtccaaaaactaaaacaaaaaataatcttcccaaaatgcatttggctattagaaatataaacacttagctgggcacggtggctcacacctgtaatcctaactgggacgccaaggtgggcagatcacgaggtcaagagatcgagaccatcctggccaacatggtgaaaccctgtctctactaaaaatacaaaaattaggccaggtgtggtgactcacgcctttaatcccagcactttgggaggccaggacacgcggatcacctgaggtcaggaattcaagaccagcctggccaacatggtgaaattccgtctctactaaaaatgtaaaaattagccgggcatagtggtgcattagctgggcacagtggcctgtaacctcaactatgtgggagactgagccaggagaattgcttgaacctgggcggtggaggttgcagtgagccaagatcgcaccactgcactgcagcctggcgacagagcgagactccatctcaaaaaacataaaaataaataaataaatataaacactttgtcctagtctttagaaagggattagaaaaaaaaaagaaatacattgataatactttcctctgaacacctcaatcaacccatagtagctaggactacacagagctacattatctcgtttaactctcacaacttccccaagaggatgggtactaccattatccctattttgcagattagaaaatcaaggcattaaagaactgaattcccaagagttattctactaatgcataatgaattggttaaaaatcaggcttgtctgttgccagaatttatgttactaaccattataacagccttgtttgcacaaattctatcccagagaaaagaacaggcatctttggccagcttagagaaaggacccttccctaaatatgaggagattttcacattgtgttgtcccttcattcagccaattccagatcctgatgagagacctgaagagtatgcacagactctgctgagtgactgggaacactgagggggaaagggaagatggacaaactgtaaagaatgtagatccaatgagaagaaaaaaagactaggaatgaaagaaaggggaaaggggtcatcctcctcccaaaagcgtatccattttaattaagctagttatctgcagttgcttttttatctaaacattagcttctcccacctaaagattgaaatgcagaattaaagagaggtattttaaaataagattagtccttcctcattcgtttattctctaacattaatttacagagccccttctccatgccaggcactcgtctaggcagttgggatagatcagtggatgaaacaaatatcccttcctatgtaaagtttacatcctactgaagggagatagacaataatcaataaacaaaataaataaaaaatataaaatgttcaatagtattttttgaaaagttgattaataagggacatcaagagtattggaacaggaagaggaagcatagttgcaggagtaatatgtcctcattaaaaaagtcctcatgtagtgctcaagctgccccttttgtgatcactcccttcaggttgtttttagtcaagtattacctcaaacacattccctttcaagttttccttggtcctggcatcaggtgcaggaggacaatgacatcaactcattctcaaggctggggccaaaggagaccataatgtgtggcaggactgctgaatccaaccaagaagaggactgactctgtagcttcttttttgtgacttatccccagatatccctggatggaaggggaggagaaaaacccaacctgaggaagccagcccatgggggtacagacctcaacgtcaaggtggttataaagacagattgaaagaggaacccatgcctttttctacccacatttatcttcactggctgggagagagttagcctagacagcaagatcccatgggctggggctaaaagagtgtctcttcatccaaaaccatggatgaggatgaggatgatgatgatgataagatgatggtagtggtgatgataaagatagtgagggtaatgataatgacgatgatgatgatagtgattatgaggatatgatggtgatgatggtgatgataatgatggtgatgatgatgatgatgttgatgtgatgatgatgatgatggtgataatgaagatggagataaagatgaagatggtgatgataatgatgatgaagataataatgatggtgatggtgatgatgatgatggtgaagatggtactaatggtgatagtgatgatgatgatggtggtaatgagactgacaatgatgacaacaacaactattactatgtatcatgtcctgggcctagcactttatgaacactaaacaatcagcttacatgacaaaccaatgagaaaaatattactattatccccattttactgaggaagacattgaggcttctgagatacttatttttgtctcatagaaaataagtggcaaaagccagatttaactgtataacatctgggttccaaaatggaatcaggagagtattgatgggaatggagatacaccatctggtaagccataaaagagagacagagtagttggccaaatcaaagaaccacaaataaaagaaaaactgtaatattagatacatgatatagtttggatgtttgtcccctccaaatctcatgttgaaatacaatccccattgctgacagtggacctggttggaggagtttggttcctgggggtggagccctcataaatggcttcatgtcctcctcatggtactgaatgagttctcactctatttgttcacatcagagctgattgttaaaaggaggctggcacctcctcccttctaccttgctccctctctcacctgtgccacatccacaaccccttttgccttccaccttgattgtgaccttcctgaggccctcaccagaagcagatgccaccactatggttttcatgcagtctgcagaaacatgagccaaacaattttctttataaattatccagcctcaggtattcctttataacaatacaaaatggactaataccatgcatatttgctgccttcccttttcctcctgtttgctaaggatgtacattttctgggtctaagtagtgagtgacaggagaggcagattacagaagtctgaggggcaatgttaatctaaaaatataaactggaagcaagtaggttagcaagaccaccatgcacacagtggctgagttgagaattaaaagttctggatttgagaaagtagaggagaaactatcttgaggaccaatgtctcgagggaaacagggagaggaggctaggataaaggtctgctctaggttgtagatggaatttcccatgatatttgttgagaaacttcagtaaagatgtgaactgggtcttcttcattcaacttttctttcactgttggggctctttcctggtgtcattcattcagggaagatggggcctcccaactagctctccccagtcagttctcccttgtcatttccccccactttctatttttcagtctgtagccagaatgatcttttaagacatatatgagattgcctcgttatccacaacacacactttaaaacctatgcatcatgagagatttaaactcctgaacatggttgataaagttctctgtgatctcacctctgctacctcaccgacttcatctctttgtcatttgatctcttaccattcttcaaccactgcctccttttgaattcaccttgctcctggccacctcaggggctttgtatgtgttatttcctttgtttttagttaattcctatccactttccacatctcaactcaaacatcatctcctcagaagacttttccttgaacaccccctcatgaaccccagactccagcaggccttcctgtcatatgtctcattagcccttatgtttttcattgcattgttatcacagtttatgtgtgtgatccatgctctccttagactctcccctgtaactctcattaaagcaaaagagtattttagttactattgtatattcaaaaattagcacaatgcctagccccctccacccccaaacatgagaaaaataaatcgggaagagtggcctcgggtttcccgtcttaacctgagctttgagaaacatagatatccacaggaatgctcttgcctggtgtggtctctttgctgagaaaaactataagccaacaatgtaggggcttctgcagggccataagctaaatatgaataaaacatactttagaacatgggaaattcatgtcatataacagagtaacatctggtttcaacatcacttcattcatttaactacctgtgttgaccttggacaggttacaaaggtgatctgagacttttttttttttttttttttttgagacagagtttcactcttgttgcccaggctggagtgcaatggcatgatctcagctcaatgcaaccactgcctccccagttcaagtgattctcctgcctcagcctcccaagtagctaggattacaggtgcctgccaccacgcccggcatggcatatttttagtagagacggggtttcaccgtgttggtgaagctggtctcgaactcctgaccttggatgatccacccacctcggcctcccaaagtgctgggattacaggcatgagccaccgtgcctggccctgagactcagtattctcatctgtaaagtggggttaatgatagcccaggccttactgtcttgttgtgaggattcaatgagataacacatataaagggcttaacacagcacttggcacatgcaatactccattattaatggtagctatgccaaaccagataatctacatcagggctgtccaatagaacttgccacaacaatggaacattcttctgtgctgtccaatacgatagccattagctacctgtagctattaagcatttgaaatatgactagtgtgactgaggaacttaatttttagtttatggctggtggccaccatattgaattgcacaccactctagactggagtcttcactctctggttctgaggggtggtgctgtccctggtgctaaaattcttgatgttcagattacttgttcgtttcatgggcaaaggaagcactcctttgtaaatacctctgagtagcttccatatcactagacaacagctgttctatggcttctcggagaagcttgatgtagtcacaaagagtgagcaataagtcattcttactcctctataattccaaattctggttatggtaatagctagtacttattaagcccttgctctgtgacaaagtccatattagaggtttgtctcaatctgcttgaaattctctgaggtagaccccattacaatccccattttgaaggagtctgtttagaggtgcacaactcataagcggcagatcctggatttgaattcaagtagcctgattttggagtctgtgccataaccaccagctagactaccttctcatactatgttccagtttgtcaacaacagaaatgaactctatttcacttaaacagtaaagggattattagaagtttccccaattgctcacagaatcaaagagaaaattagactttgaaagtgggggaaaaaatcaagggaaaccaagtggccaaaatcatctaaactctcccccagaagagcccattaagagtgtctcagctgggcacgggggctcacgcctgtaatcccagcactttgggaggctgaggtgggcagatcacgaggtcaggagatcgagatcatcccggctaacatggtaaaacctgtctctactaaaaatacaaaaaaaaaattagccgggtgtggtggcgggcacctgtagtctcagctactcgggaggctgagtcaggagaatgacgtgaacccgggaggcagatcttgcagcgagccgaggtcgtgccactgcactccagcctgggtgacagagcaagactctgtctcaaaaaaaaaaaaaaaaaagagtgtctccacctcctctgcagctcgctgctttatgtcagtagcctgagattcaaggacctaggaagaaacatattattagctgaacttaggtctaaaaagcccatactctatcatccagagatcatgggaagcaaatactggccttccaggttctatagcagaaggagctgccaaggatatcttcaagatcagctataaatgattccctaaacatagtaaatgggttagacattgagtagccaaaaaattataaacatccactacctactacccttacctgaatccttataaatgttgtcattaatagcgtgtttttctttccaggctacaaggtattgcttctagccaagtaagcataatcaaagcccaggctcctcatctgagtatctttaaaccttaacagaaagtatcatttgggatttttttttctttaagtggttattttccatgctccaatcattcaagtgctgccttcacaattttctgtcatatgggtgcatcactgctctattatttgcttaatatttctcttcaaacagactctacattttacttgattcattttgaaaggaaactttatattactgctgagaacatggggttagcatactagctatatttcatcttctgatagtcattaaaataaacataaaactctgaatgttttttaagtttattcaggaaccatctaaaagcatcctctgctccagagacgctgctctaatacaaataaccaccttgcagttttccataaggttgcagtgatgtgagatggatagcaatgcccggagagaccaggggaagctcaatttttactaccagaattcagagtcagggatctctgggaaatctaccttagcattctctcttcttccttgtgtggccttaatcaaaccccatggttcttttgtttcttggcccactcaatgccagcacttgagtaattaacatgtaatacagccaagcacgcccttccatcacagacacacgtgtcctctgcactacccaaaatgctatttaggattaacatttatttccttctaaggaacagaaatcaaagtctagtttctcttgcactttctgtgtactgcctttatcccagacccaacaaactggcaggctaaccaaataaacacagaatcaaacaaacatgagccttcaaaacaaaaaaaaaaaaaaaaaaggaggcgaggagcacggggaagtggggaaagaggcaattctattcaggaatagactcttttctttccagttaaagcaatgagcacatctattgacacaacatagatccacctaggactacctttgccctgcaaagatataaatgctgcattaaaactactttctgtttgcatagaaagtcctgtaaacagacctgctgtgaatgcaaagcaagaaacccagctggaaggagaaaggcttttggaggaacctgagaaggagatgttagatttgtctgccctgtacaaagatttgctctcttctcatcttcctctctttctcccctgactcctcctcctctcccctcttccccgctcttcttcttttcctctttctcttcctcctacctctccttttcttcctccttctcctccttcttctccctttctctcctccttctccatcttctcctccttcctatttcttctggagtcgatgagcgagcaggtggccagaattcatggcctggaaaattctggatcccatcaacaaagatgctgtcttggaaaaaaagctgccatgctcgttttcccaaactgaaggagatgctctccacatctctgatcttgcatccaagaagtgggcagaccacaggaaattctttcagagcatttagccctaagttcccctgtttaatatagttgactgaattcattaatcaattaattagtaagtcacactgctccagactaatacatatgccaacgcagcaagagactggaaagacacaggggaaacgaggaaagtgaagaggcttcccctgcaatactggagtatttattttgagtgtagcgagttcagcaaacatctgtttattcagaatacgagcaaccagggaactcgaactaaccagaaaggtttctcagaattttaaaagaagagttgatgctcttaaccataacatgctcagcccttatgagattttgaagtgctctctgaatcaaaagatttttttcccctgtgaagttttacagtaaagtgtgttccaactttctaaaaatgagctgaaaaggtatgttttctgggactgttcccagttaagttggatattctattcaccaaataacccacttctcaaccattccagtgcacgtgggccaaggaggtggggaaaacaagatggaaaccatcataatgggcttatgctaggaaggctgtgttgtaatttaaagaatactgatctttgagtctagaaaactgcatggaaaccctagctctttggtttaccagagcagtgactatttgtgcaagcctttcagaacctcagctcccaatctgcatagtgaaaaaatcactttatctttacaaagtggctgtgagagtgaaataagaaagggtatgtatgaatgctttgaatgccatagcacagcactcacatgcaaggaataattactgtcatttataacaacacactctcaaccttgagttatcctctcattctttcttctctttttccttctctctcccgcttcctggggagcataatgatgtctgtgataactattacacatgaaaattacatctctccattagttctctttacagaataaatttcattgaaatccattaaaatatttcagacaacaagcctaccttgaaagtgttgttaatcactattttattttgagatgttagtctaagggggaaaaaaggggatagactttagccatttggtactaaggtggattttgttagaccactcctttcaaactgtcaccaaacagaaagatggagaaagaaagccggacaatcagcaaatacctggcaattaatccaaggtcaagatctctaatttgtttataaaggtggtaatgagttgggaagggaatgttttacctgaaattcagtatccacccaaatggcaagtttatactctgcttagtctcaaggtatggaaatgttttaaaactttttcatattattccttgagtctttagggattgagcctctggatggatggatggatggatggatggatggatggatggatgattatatagattatacagacagatgatagatagatagatagatagattagatagatagatagatagatagatagatagatagatagatagatagatagatagacagatatcgataggatagatagactcacatctataatccaagcactttgggggtcgaggtgggcagatcacataaggtcaggagtttgagactggcctagcaaacatggtaaaaccccatctccactaaaaatacaaacattagctgggtgtggtggtgcatgcctgtaatcccagctactcgggaggcagaggcatgagaatcacttgaacctgggaggcagaggttgcagaagctgcagtgaaccaagattgtgccactgcattccagcctgggtgacaaactaagactgtctcaaaaaaaaaaaaaagatagatagatagatagatagtcagacaacagatattgatagatagatgcagagataaattcagatgtagaaatgaatacgcagatgaattaaattcagatagagtatttctcctgtccatgagggcatgcaaaacaaagagaccaaagaaaaatatgcaatatggctgaaggaaaccaaaaaataatcttaccccaccttctcatttttaaaaggtaaagccctgaaaaggggattaacttaccccaggtcacaaagccagtactgccactgttattactaacagctgatatgcattagcacctacttgcactaggttttggacaaagctgtccaagtgtgatatcttatttaaccttcccaggacaatcagaatgctggtcttactgactagaaaactgaaactcagaagggtgaagccatttgtccaaggtcactcaactggtgagatgcagagacagacttgcaaccagaggaataccctgagctacactgaacctaagactcctggtttccaaactagtacaaggtccctttatatatttcaacctgaaattttaacctaaaatatttctttccttccactggtaattggaaaattcacttttgtaaatgaacttacaaaaaaataattaccttcccaaattgcacattctcttttttctagtgaaatctattgcacgcactgaggactcgttcagcaggggccgggctgccccataaataagtcgtgcctaggttgatctgtgtggctgtcactgtatatataatagaagagacagtgtcagggagcagccaacattcacctccttgagcacatgtttccaaattgcccttgacaggttatgagcagagcatttcaaagggatgcattaaatacagcacaagtgctttgagaatctgcctttctacatcctgaggctggcactttgatttcttccaattccgtttggtttcccacttcctacgagaaggaaggaagctgagagcaactcctggggcagctggtctggctgcagggttactcccctggcttgtgaatattagaacaaaactatgagttgatgaggtacatggtatctgaggctaataaatatgggttgaaatcctggctctacaatttactagccacatggccctcagaaagttctttagcctctcactttttcaactatagaatagaaataatagccctctcctccagaaggttacagtaaggataaaataagcatgttaataacagctaatatttattcagtattcattatgtatcaaacacttcactaagcattgaacatgtgtggattacttatataattctcatacagaaataggcaaaattgttatctcaatgtcacagatggggaaacggaggcaccgagagtttctctaactgccccattgtctcatagcaagctttgcaccaggctttctggctgcagactaaaactgcttagtgaccactctgcgagcagagagtgcctggcacatagaaggtgctcaataaattttagggtttttttgtttgtttgtttgttatttttgtcattgagttacctcgtaattgctcacctattcagaaagaacaagtgtcagtgtcttggggaagaataacagaattatcatttactgaacctcagatgtgtgccaaatgctttacttgtattttcttatttaatcctcacagcaaaactgcatgctggtcctattattcccattgcctggatggggaagctgagacactagaaggccaaggactctcccaaggcaaataggagagccaggattaaagtcccagtccatccaacttcaaagttcacaccacactgacaacctaaacaaaccctcgatgcttatatcatctaaatcaaacaaaccatttctgcctccccactttcatcatcgtcatgtaagtcacagattcttaaagtttactgtgcacacagatcatccgggcatcctgttaaatgcaggttctcattcagcaggtctgggagggagctaagattctgcatttctaagaagcacccaggtagacaacacttagaatagcgaggatgtaagagagtccttcaaccctttccatgttttctcactctttgccacttaagactcaagaggcttctgaggttggagactgagagaggaaattagttccaccttcttcagctctatggagtcagattttccaaagcacccctttccccaccaaaaccatcctcaccaccaatgtcaccatcacacacgcacacatacacacacaggccctctcaacctctcttgaatttttatgtctttttgacatgtggttgttgggcacatttcatattaaatcactccaatgtcaaaagaaaattcaaattgttactaagcatatttaactccaaagaagaattctaccataaggctaaatgcagcaataccagcaatttacaactgaatagtgccttaagtaatgataatgagcctgatgacatttggttgtacatggttaaatctttcgtaaaatagtccctctccactctcaaatttaaacctagtgaagtatttaaaaggttcttcataaagcactctctcttgccagcccacagttttatagctgtggttctttcctgtccagcctcatctcctgattctttcccacaataccctgttttcccagttgtgctggacttgcagatctttgatccccatgatcattcctactcagggccttggaccatgttctttcctcttcctgggctctcttctcccatctgtaattccctgcagatctctgtctcccaacccagagtttccttccatagagaaggttttgaagtcaagatacactcaaggactctgctcaccactccaagatattgacttcatatcccttcatatcctactctctatagtacatcaatccctgggtagaataaatgtaataacagtctctgccagaaggttacagtgaagatgttagtcatagatcacgtttgttcagtactcattatgcacccaacacttcactaagcactgcatgtctgtatcacgcatataattctcacaaattataggagaatacatcattctcatataataacccacatgtgtaacatgatcccatatagtatatgtaatatatgtatgtaatatacgtacatatgtatatccatccatatacatatacacacatgtgtatatgtttacatgcacacacatgtatatacatatacgtatgcacatgtacgtgtacacacgtgtatatgtgcacatatgtacatatgaatacatatgtataaatgtgtgtacatgtacatatgtaagtatacatgtataaatgtatacatgcacattttatctatatatgtagacatgtatgtctacatgtacatgtcgacatatatacatatgtacttgtattccatatatgtatacgcatatatgtatgtaatatatgtagtatatgtataatatatgtatatatgtaatatacatgtataatatataaccccatgtatgtataataacataatctcgtataataaccctaagtcacagatgaggaaactgaggcatagagaggttaaacaactggcccattgtctcctagcaggctttgcagagagagggcggtggagaagttaggagggacccatttgagcatatgtttcagaagtgcaagaaacaccagttgatgtggtccttcagggagacttgccagcaggagagaaaactagaatgaagagcagaataatacagtgagaagggaagaaggaaaatgagggaatccctgaccttaacaccaagcctgctattctccccagatcttcccacctactccttccatcactcatgatggaagtcctttggatgataaaatcacagagtaccaaagtggctcatctgacagatgaagaaatgaaggaccagagaggacgggtaacacagccagatggctgtgtgtttggccgcccctgcctttttatctgactgtaccatccagagaacactctgaaggactgtgaggcagagaaacaccacaaattctgccacagagcctcaattcactccaatccctttaataggtcttgttcagacaaccttgtaaagctacagaatatggtttctctttctttgatactggaagtgtcaggagtctctctggccatttatttgatgtagaggttgctaaatgttatggcaaatagccatatcaatctggttaatggctgagcattggtgttggctgaaaccttaagacctcaccaatgagaaaggaaaggtttcctggtctccagaccatgctgtacatgaatatctggaacaggaaagtcatgtggtgtgatggactctgtccctggagctaaggagtgttctatcttagccttgattctgttgctaacttgtgtggccttgaggaaatcagctactctctctgggaagctttcacaaaaaggaaaaagaggctaatataaatagcccagaacttgtgcatacagactttagaagcaaatgtaccctttcagaatttgctgatgcccatgaattccttctctcctctctcagtttactgtggctacagctctcatgcttactgctgtgtaacaaccgcaaaatcccagtgggtgcaacaagaagaatttttgtagctcacgcatctgcagttgcgctgatgcaggctcagctggcctggctgattctgtctaggcttggctgcagtggctgcctctgcttcatatgtgtctcattctcttccagctctgaaagatgatcccaggtagatgtatctcgtgataatgacagtgacacagtgacacagagcaggcagaaacatgtgaggccccttaagtcttagctcagaactggaacgctgtaactctcaccttattctactagccaaagcattacacacagccaagcccaaagtgaaaggtcggggaaatatattatactccagtattttggcacaaggagctataaagtcatgtgggatggggcatgcacagagccaatgaattaatccacctgcgctctttaacaggaaacatgggtctccactgggccagtttcctccctgttctgcactatgtttttcttacgttgtgcctccagttccccacctggaatcactcccccatccacctatctaaactctgtttattccacaagacccaggccaacagccccctcaaccgtgaaagcttctccagacccacagttggccacctgaactgttccaatcctctggcttgtgggtaggtgtctcctacctctctggccaactagcagctgacttgtagaagaccataagtaataagtcccatcaagtggtgctcactggtgggttaggatgcccgtgaagggggtgtggcattggtgattaggtttcctaagaagggagggaaacattgactatctcttctgtaactgccctgcccttagggagctgaatgatggcatttccccttctgggttcactgagtcagaaccacccctttgtccactggtcagggtgctgcactttgtcacactggccccggggcagccctacttgcccccttcagcttgtacatgcccccttcagcttgtacgaagacccttgattctccctagagcccacacctagcccatgtaccagggcagaaaagcagacatcatagtgaaagaggagagttcccttatccctctcacaaggcatgcagcaggggtgcggctcgctccttcggttgctcagctgctcaaacccctaggggtaccaggcagacaggcaggtgcagaggccatagggagcgcttttgggtgatcttctttactcagccttcagattctaatactaatctctttgtgaacgcccttagagacacagccagaaataacattttaccagctatcttggtaccccttagcccagggatgtgataaatcaatcccataaattaatttatatgtccatgtattaagttgacacacattacagctggctttagggttattaggagtcaagaataaaatacatgtcaagggacccattttctgccattgtgcccaatggatgagctttctttctacaccccactgcatctcccttagcctcctggattttcaaggtctcactgacctctggctacaggactaggcctggtgggtgacaaaataaacacagtcagaacctatgtgggaaggaacccacgtaggttccttcccatcctccagggccaatctctcaaagtccagtcctaaccatttttttttcccaaagtcagaagcagccccgcccagcctcctgcatgctgggctatagatcctttcctcctcttcatgttaagtgcccaggacaattttgcacacacttctcagcggcggctgcagcagagactgtaaacctgtacgcagaattcattagctctgccgcaggtcctggtgctcaccttcctcagcactcttgtttctaagaggcatctgtgggttctggctgagtaaaaagaggagtccagcatcccctgatattcagccatggctccagtggccacctggagcacatcaaagtgggctcctgactttgcaggcacgaactagagcctggcagatgcatttgaggtctggccgtgccacctctgctcagagtacaatttaacagatttttttccatactgctctgggaagtggggacctatagagatttggtaattggcatcctaagtcctagcatgctttgatctctgcagcaccttgctgctctaattgcttagagacccattttcctatcccaagaccacaggccagagactctgcaataacctgaaggcaagagatattaaactgtctcattgcctctgctctgaagagaaagaagttttcaatttcagtcgtagtggcagggcaggacaattctagggatacctaggatctaagaagtttcttccataagtcagggctggcccatgaggacaagggattcaacagggttaccccccatgtggaatgggctggcttgggaggttgtgcaaattaacgggatgcaaactgatcatccgtcaagccagaaacctgggcattatccacagttctctttctttcctacacaccccatcaatcagcaagtcctggcaatgttacctgctaagtacctcttgaatctgttgcaccctctcctcattcccatgaccacagcttccgtccatctcttacccattttctgaacgcctctttccagtttgagcctccagccctctaaaccagggatcagcaagtacagcccatggaaggatgggaccaaatctggcctatcatctgcttgtcttgtaaataaagtttattggaatgcaaccatgccatttgtttgcatattgtctacagcagttttatgccacaacagcagaactgagtagctgcaaaagagatgaagctcatggagcccgtgaagtcaaaaaatgtgtctactctctggccctttaagaaaatgttcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggggtggtggcgggcgcctgtagtcccagctactcgggaggctgaggcaggagaatggcgtgaacccgggaagcggagcttgtagtgagccgagattgtgccactgcagtccgcagtccggcctgggcgacagagcgagactccgtctcaaaaaaaaaaaaaaaaaaaaaaaaaaaaagaaaatgttcgctgtctcctgctctaaaccaccaccagttaagttcatgtctttttctctccttcaaaattcatcaaccattcttcctgccaactaataaaatttgaaattccttgccacacatgcctcattctttatgaatgggttcttagctagttcaggaattataacttagcaggcaacagactttatctacttcgtatatttctattgtggcctaaattgaatttgaaatattaaattagtggccaactttttatagaatgataagactatatataaaaattcatatttatgacttatcttgaggaataggaaattctggcaacacctggcccttcattgacaatgagcagccacaatcaatgcacatccaccctctttaggtaaagccacagactccacctctcccctattgtcctacacctgtcctgcttcattcgtacaagcatgagtttgaaaagccctgctcttccttctttctctgccaatcggccctcttcctagaacagttttcctatagctatactgcaagacagagtccccaaagaagccgcgctccatcccacctccacattttcatgcacgctaccttcttacattagtttgctggggctgctatcacaagcaccaaagacttggtggcttaaacaacagaaatgtattttctcacagttctggaggctggaagtccaagattaaggtgacagtagggttgtctcttctgaggcctgtctcctgggcttgtagatggccgtcttctccttgtgtcttcatgtgcccttccctctgcgtgtgtgtgtgtgtgtgtgtgtgtgtgtgtgtgtctaatctccccttcttacaaggacaccaatcctatgcaattagggtccaccccaatgacctcattcaactctaataagctcttcaaggacctatctccaaagacagtcacaatcttaaatactggaggttagagttagaacttcagtatttggtgggaaggcacaattcagctcttaacatcccccttccatgagtgcctttccctactgtatttacctaaaaaatatgcattgttactccaggaatcagaccatgcacaacctcctccaacagcccctgcagggttggttttctatcatatgtttctttgcaacttacatacacctttactagagaactattatcttgcacttcaatgatttctattccccctttcttccactaaactgtcagcttctaggtggcagtaactatatttttttcatccctgtttattcaataaatatctactgggggcctaccatgtgccatgcactgctaaagccactgaagattcagcaacgaacaagacgggcaaggtccttgactatatgggctcatattctagtaagggaaaggaatggtaaataagtcaaaaagcaatcgtgataaattgcaaacactgtgcttaatccattgtaggtgttcaaaaagccttaaactgaatgccatggggagaatgcgttcatctgggaagaatgggagaagaggggtctaaaaccctgagaacattttcaaacctgaaattttgtgattttttctttactctgagttgctgagggagttattatgcagaaggtcaaagaaggctcccattgtcctgaaagctcatgtcacttaatgatgcagaaacttgggtcactgcatcccttcacctgtccttaaatcatgagacctcacagcatccctgagaagagacgtgacaaccaagacaaagcccaccaaatgtctcccatcccacggtctcaaaattcccacagccaggggtctgtttgccagtggacagacctagagatgaggtatattttcctgcattcaatttttggataaatttacggggcagtggagaatggggtaagggcgggtgattaggcctcgggactcgcactgtgtaaatgatgcccatttcaggtgcatcacagcccatatcagcctttaaggaagagaaggaccatttctagaaattctctagtaataaggcatggtatcagcatactgggactcgtgctctgctaaaagcacaaagcctgcgggagctcagcatggccacagtaatgtccattcccttcctatctgttgtccataatttttaaaaaaataaatgctatttgggtaccaatgtataaagttcatattgtagaatgtattaaatggattaaaatgcagaaacaaaattcatccgtggaactctgtgtcctcacatatttattcatacaaaatttagaatcatttttgtcacattaaaaatttacattacgtttgtaacaatgtcaaatttatagattaatctagtgggaggtggcttaggaatcccaagcatatcattctaaaatacatcaagtggtcttttaaaacactcagtacactttataaatatattccattatgtcctgcatatcaattatcttctgctaggtggtttctattacttggtaactacactcaatgaaatctttttaaatgataatattttctacctgattattgttggttaaaaaaaaaaggaaaaattcagccaaacgactaaaccctcttattacttctataagtttttagttgattccatgagattttctacatagatattcttatcattttaagtaacgattatttttccatgttgattccaagacttattcctagttcattttcttcgataattgccttggtgagcaattataaataaacaatgactgagagagcagtttgttcccacattcgatagaaatgtgtttagtggggctgggcgcagtggctcatacctgtaatcccagcactttgggaggctgaggtgggtggatcatctgaggtcaggagtttgagaccagcctgaccaacatggtgaaaccctgtctctactaaaaagacaaaaaatagccaggtgtagtggcacatgcctgtagtcctagctactcagaatgctgaggcaggagaatcgcttgaacccaggaggcagaggctgcagtgagacgacattgcactccagcctgggcaacaagagtgaaactctgtctcaaaagaaattctgaaaaagaaagggaaggaagggaagggaaggggaggggaggggaggggaggaagaaagaaagaaagaaaagaaagaaaagaaaagaaaagaaagaaagaaaaagcaagcaagcaagcaagcaagcaaagagaaagaaagaaaatgcctttagagtctccctgtattaacaggcataacattggttggctcttcgtttggtttagataatattttggttatgtttttaaaaatgcattttcagattcaagcctttattatcagtgagagatgtcagattttatcaaatattttcgattttatcagtatttaagatctgagatgatcttaagatttatataatactttcttctatgctacagattttcataatcctttattttccaagatgttacaggaccaatggtggagttatttgatcaaagatatgcacattggaaagtctttatgtgttttgttaaaccgcatccccaaaagattaggtcaattgacacctcgcccccagcagtggatgaaaatgcctgttatactgaactctcactagcaatgtgtttttaacaaccaaaatctctcttaatttataagactattgaatgttagatacaaaatacacaaggtatactacctctttcctatcctcttactgtacttcttaaaaagtgattgttggttctcaggtttatgttatctgctgacatttcatagagattttaacaccgttcctctggaagagctctaacggaatatctagaaacattttggggtcacataactctaatattctgaaaaagctattggattagggcccactgcaatgacctcatttaatccttcagaggtctataaggaccctgaagacagattcttagatattaggggttaggacttcaacacaggaatttgttgagtttttgtttgtttgtttttttgagacagagtatcactctgtcgccaggctggagtgctgtggcacaatctcggctcactgcaacctccacctcccaggttcaagcgatcctcctgcctcagcctcccaagtggctgggactacaggagtgcaccatcatgcccagctaattttttgtatttttagtagagacggggtttcaccatgttggtcaggatggtttcaatctcttgacctcgtcaacacaggaatttattttttgtttgtttgtttgtttgtttgagacagagtatcgctctgtcgccaggctggagtgcagtggcacaatcttagctcactgcaacctccacctcccaggtaaaagcaatccttctgcctcagcctcccgagtagctgggactacaggagtgcaccatcacacccaaatcttttgtatttttagtagacggggtttcaccatgttgatcaggatggtctcgatctcttgacctcgtcaacacaggaatttgaaggggagaaacacaattcagtccacaacatcccttttccaggaatgcccttcccttccttattcactgaacaaatcctcattcactcttactttaaacatcagatcgagcacagccttctctgacagccacaatttcttcccagaaaaatgtgcctacatgcaaatttttttcactagtttcagaagactcccagatctagcaggagtgtcacagacccacaaagaagaaatctgacctattttattatccctgttttacagataagaaagctaaagcccccccccaaaaaaatctgcttttcctaaaaactaaaataaaacaattttttttctcattttaaaggccttctcccacccccaaaagaaaatcgaggagaaaagcatatattgctttctacttaaaacatagatattttgattttgaaaaagaaaagtgctttgagaaacagtggcttgatctgagtgaacacagcgcgtcccaaggtgagcactttaagagggttcacgtccaatctcatggggtgaggtgggaaaagtgctgatcagggaacatgaaacccaagatctggtcctcacagacaacagactgaatgtaaatcctcgaataactcaaaagccccatgagcctcactttccacatccataaagtcgggtactaatgtttgcctcacagccacgttctaaggaataaatgaaatttctggacacataaggaaatgctatatacgtaggttgctgctatatattgttaaagattatttttcaaataaattcagcaaatacatatggggcacctatgatatgccaggcactgttctaggtgctagggaataaaccctagatgggagagttgggagggctgctcctctggagtttgcaatctggcaggcacagccaaccttaaagtggggatttgtattaggcccttcttgcagtgctataaagaaatgcctgaggctgggtagttaataaagagaagaagtttaattggctcatggttttgcaagctgtataggaagcatagcagcatctgtttctggagaggcatcaggaagcttccaatcatggcagaagatgaacagagagcaggcacattacatggcgagaacaggagcaagagagagagactgggacatgtagagggggagatgtcacatgcttttttatttttatttttattttttgagacagcgtcttgctctgtcgcccaggctggagtgcagtggcataatcttggctcactgcaacctccgcctcccggattcaagcgattctcctgcctcagcctcctgagtagctgggactataggtgtgtgccaccacgcctggctaattttttgtatttttagtagagacagcgtttcaccgtgttagtcaagatggtctcgatctcctgaccccgtgatctgcccacctcggcctcccaaaatgctgggattacaggcgtgagccacagtgcctggcctaaatcactagatcttgtgtgaactcagagtaagagacggctcacttatcaccaaggggatgacccaagccattcttgagggatccatgcccatgacccaatcacctcccaccaggccccacctccaacagtggggactacaattcaatttgagatttgagcagagacaagtccaaactatctcaggattcaaatgggataattgtcaggaacaaagaagtgcaagaagctgagggtgcttacagggacaggaaccaaccccactggaactggtcaagatgtcccatgtaaggagagtagagtaactgaaacctgcaggggaaggagggtttgtccagtaaaaggaagagggcattttaaggatcaggaattaagagagagctttgcatgttaaatgaacttttaaaagtccagtgtggggtgtgtgtgtgtgtgtgtatgtgcgtgtgtgtgtgagagagagagagtgttatagctgtgtgtgctgtgagtgtgtgcaggctgtaggtttatgtgtctgttaataggttgcatgtgtgtttgagggtatgtgggaggggttgtgagttgtgtgtgttgcggttgtgtttgtatgttgtgggttgtgtgtggtgtgggttatgtgcattgtaggtcacatgcatgtgggtgtgtggcttcatattctgggttatgtggtgggttttaggttgtggggagttgtgtatggagtgcggttatatgggggaggtgtgttatgcttatgctgcaggttgtatgtgtgtatgctgtaggttgcatgtatgtgagtatgagttttaggttatgtgggaggggttctgtgtgtgtatgggctgtgggttgtatggatgtgtgtgttgtgggttgcatgtatgtaattgtgtggcagattgtatgttgttagtggcattcattgggtgtgtattttgggttatgtggtggggctatagggtgtgagcagttgtgtgtatttgttgtgcatcagtgtggattatggagtttgcaagttgtgtatgtgggttgtggggtgtgagaggtgtatgtgtgtgtatgtgtgggtgataaggctaaaggggtaggctgagtcagactccacatgatatagaagacactgttggttgcccttcttcaatgaaagttgcccgacttccaaatgccagaacctgctctgctttgcctggggactttttctgggtctgggtccccccttgtccccactgtcagcagtgccagcgaattcacgctccccacccccagagtcctccaatcaatgtctgagcaggggtgggtggataaataccccagctccctcacccctcgggggagataatgctgacatgtgtgttctgtgccactcttcagctttgcctggcaggatttagctctagatgcacacagtggtcccgtgcttcatagcgaccctttattggttcttttccttcctgtttcactttcacacccctatctgggtgtttcctgagcccttcctcaaaaaaaagacctggtctcacatccgttacctcattggtctacttctaggccaacccaagctgagacagccatgtaagccatcctggacttcactctgagggcagcgggcagccatgagggttattgacaggggcatcccataatccattgttttaaaaaattaaatgaataaaacatatggttccagcacctttctatcatccacaattcgtgccttggaaaagggtgcctatagtccatgcacaaaagctccccagtcaaggaaggctatgtgcccacctgccaggccaaggtggtcccaccctccagcaggtccttgagattccagagcattcaggtgactcatctgagggcacaaagctaaggagccatcaagcccagggtgcagtcccagccacctgcacacctgcatctcagccccattctcaccaggatgcttctgcagtaaaaccttcaaagtcattttatccaaaccagttaagatcaggaccccgggccaactcaaaacctgtcagtcacaactgctgtttcgagaggacactgtcactttcacttagcctccactgggaaaatgaggaccaaagccatgtccctccctgggacgggagccaggggcctgtttcttttgcaagtcaggcagctgctcacaggcctacttgaaaggagaggatctgggcagttgtaactgtctgatcctgcctggcacagttctccaggggagcattgtccctgtcatgcgggtgaagcccaccgaggtcgtcactctctaagcatgacagacagacagtgcagctcagctggctcgtgctcctttgaaatttttctatgtcaggctcatccttcagtgtggatgagaaaggacagagctggagcctcagcagggctgggaagaggatatcagaatggtgtgcgcacacgtggaaagaaaaggaaattgactaggagatgagtggcccctggtccgatgggatggacaggaacacccccctccatgctgtgggggctgtcggtcccgccaagacacctgcttcctggcggtcccaggaggacaggcattgccagaaaaatggagtgtggtgcaaccctacatgtttttcctgtatatgcattcttaaatcacttaccctctcagtgcttcggtttcctcccttataaaatagggctaataatacctatttcaaagcattgctgggagacttaaatgagacagtgtgtataaacaccctcaggcagatgctattagatacgccttactttccccatcaaaactaacatttggagagtactcactacacaccaggtgctgtcaaaacatctttgctgttcaaccaccctgggaagcagatcctacaattcatcccattttagagatgaggaaactgagagaggttccataacattcacaagatttagcactcgcaggaagtggcaaaagttgcatccccggcagatctgactccagagcccgacctttgagcctttccaatttctcccctatttacaagggaaacagaaagcccacttttcccaggaagagcacttctgtgtcatcaggcatgggtcatgttcatcacccatgtatgatgtcttttaaggacataaagctatagtgtcattggtagtgtatttgatagctctggcttgaaaatcccataaatcaaaatcatgatgctgtacagcagtggttctcaaagcgtggtccacggacctcagcatcaacagtacctaggaaggtgtcagaaatgcaaatcccgggtcccagcccaggcctactgagtcagaaactctgggagtggagcccagagatctgtgtcttaccaagccttcctggtgacactgatggatactatagtttgagcaccaatgccatagtagagtacaaattttctttttcttttttttttttttaagacagagtttcgctcttgttgcccagaccggagtgcaatggcacgatctcagctcaccacaacctccgcctcctgggttcaagcgattctcctgcctcagcctcccaagtagctgggactacaggcgtgcgccaccaagcccggctaatttttgaatttttagtagagatggggtttcaccatcttggccaggctggtctcgaactcctgacctcatgatacacctgcctcagcctcccaaagtgctaggattacaggcatgagccaccgcgcccagcctagagtacatattttcactctccaataactacaggtcatgaaggaaattgtaaataaataaataaataataaattgttactgttttatttccaggtgggattggtaggaaataggagcagtggccatgttcattgagggttaacaagttcattcattcattcattcattcattcactcggtatttatttcttgggaactatacgccaggcactatccaggaaataataaaatgtagttaaacagacacagacgtgtgtggttcctacttttataatctaacagttcggtgaggggcaggggcagtcatgtaacaaaaatgacacaattattaaattgtgtttgtagcaagggctatgaatggggaaaggcatgaatctggaaagcagaatgggagcccccgatcaaatcttggaaaacctctcagaggaaatgacactggagtcaagatactggccagtgaagccagtcgggagttgggggaggcaatgaccgtgatgaggaaagggagcgagccctctagcagaggagacagcctgcacaaaggctcccagcgcagcaaaggcagggtgccctggggcagggaggggctctgcgggtgatctcaggtgcgcccccagtttctacgtgaatccctccacatccagctccctcaccttgtaatgggcaaagtcagaacatccacccacagggccccacgtgatttcggctgctcacagaggacacttttcccacctaaggccccagacacaagttcagcttcctcgctgcactcttaagccagcaggtggagagttttgagttcccatttccctggtggctaagttccgcgtgaagccgggagctatgcacacacaagacacgcctgggactgctgagctgaagctcctgttcattactgtagcttttcatttcctctttctttctgctgcttgaagctctgccttctttttcccaagctcagctacacttcttttacccaacacttctttgtaattaaagagaagcagtgagaattaatttgccacatcagctcacttcattgtattgatttttttaaatcccacccctcccaaaccaaatcaggtatcattgcagtgcacttctagagtatcttgtgcctcccatcaaaacctgaacacacaggatcgtaatctgtgctttaagcatctcctatctgcacccccaccccccaccccgccaagctgcaaattccacacaggtatgaactttctggcttttgctcatccatattcccagcacctaacccagtgcatggcacataataggtgctcaataaatgtttttgaatggatgaatgagttcattgttaaccttcacacaattctgtgaggtagactgccaccttgttaccctttttgaaggtgagaaaatggaggcttggcatgtttagcaactctctgaaggtcaaatatcaagttgcagatcttagattcaaaatctgggctgctacatcccaaagatcaatgtcttctccatgcatcacactgtctcttcaacaacccttaaactccagaagggcctaggtgtgtaggtgagtgcgactggacagaaaacaggaatgcttctttctgccttgagtcaagacactgtttgtatgattggaaatgaagggtgggagccttggtacatggaaggaaaattgggctggtgacagaatggggtgaatgcagacatccctgcacagtggcaacagggaggagatgctcttatcccagtaaaatttaatccctcataaaaatagcaccatatttggtagattgcatccctcctgtaatgcaaagagcagcaggattttccagatgaaaagtcagcttagactggtgcacacttgccctcagggctgatccctgaacacagagctccagagtgtgcaaagatggcctcttagggaccaaactgtcaccaggaaaatcacaagaagagaggccaacaattctctgtgactctcaatccaggagctccaacttaactatgtacgacattcaggattctgaaaccttagcaaatttgaaattatgattattacctcatcaacataacagttgagtgaagaaaagcagggtataaattgcatttcacgatgatttccaccttggttaaaagaaaaataaaaatatatgcggcatgaaaaagccccaaaattaaaggcaacacatgaaaagcttcaggagtagaactcagagtattttttctctctctctcattttctatattgccctaattttcattaatgaaactgcctctcataaataaaacaaaattccattttaaaggaatataatggtgctcagtacatgcttgttatatggccagttcattctattttacataacccgggatagtgcatattatcagcctcattttataggcgaggacattaggttcaaacagactgagtagcttgaccaagctgtagctcctaagtgcaaagccaaggtttaaaaataaattttgacctactctaaagcagcacttgccaacttggcatgttagaatcatgagaagctttttaaatcctgatgtccaggccacgccccaaaccaattgaatttgaatccttgagtgtgggactcaggcatcagtatttcttaaatgttctcagcaattataaggtgtagccaagattgagaactaatgctcacaagcctatgtcctcaaacacagtgctatattgcttctctatatacagaaatctattgtcatttgttgggaatatagataattattattgaaaaatcttaataccatcaaatattgcctaagaaccctattgatttctgagccttgtccacatgcccagatcaattcatggaaagagggtagccaccctacagaagagtagtagttcaacgatcagagcaaggaaaagaataatgatgccaagaatagatttctgaaggctgaacccattcagaaaggtttcctgagaaatccaaaatctgaacagaacaataacaagtaacaagatcaaagccttcataaaaagtcccccgctaaagaaaagcccgggtctgatggcttaactgctgaattctatcaaacatttaaagaactaatgccaatcctgatcccaaaaacagacaaagacatatcaaacaagaaaagtacaggccaatatctctgataaatattgatgcaaaaattctcaacaaaatactatcaaactaaattaaacaataccttagaaagatcatgcatcatgatcaagtgagatttatccctgggatgcaaggatggttcaacaaatgcaaatcaatcaatgtgatacatcatatcaaaagaatgaaggataaaaaccatatgatcatttcaattgatgctgaaaagcatttgataaaactcaacatccttcataattaaaaaccttcaaaaaactgggtatagaagaaatatatctcaacataataaaagctatatatgacagacccacagctagtatcatactgaacgtggaaaaacataaagccttttctataagatctggagcatgacaaggatgtctactttcaccactattatttaatacagtactggaagtcctagctagagcaatcagacaagggaaggatataaaggacattcaaagtggaaaggaagaagtcaaactatccttgtttgcagatgatatgatcttatatttgaaaaaaactcaagactctacaaaaaatctatcagaactgatagattaacaaattcagtaacattgcaggatccaaaatcaacaaacaaaaatcagtagcatttctatatgccaatagggaacaatgtaaacaataaatttaaaaaagtaatcccatttacaatagatacacataaaattaaataccgggaattgacttaaccaaagaagtgaaagatatctctaataaaaactataaaacactgatgaaagaaattgtagagtacaccaaaaaatgaaaacatatcccatgttcatggattggaagaattaatgttgctaacatatttatactacccaaagcaatctacagattcaacgcaatctttttcagagtaccaacaatattcttcagaaaaatagaaaaagctatgctaaaatttatatagaaccacaaaagacccagaatagccaaagttatcctaagcaaaaagaaacaaacaaacaacaacaacaataacaaaaacaactggggaaatcacattatccgacttcaaattttactacagagctacagtaaccaaaataatatggtactggcacaaaaacagacacatagaccaatggaacagaatagagagcccagaaacaaattcacacctacaatgaactgattttttacacaggtgtcaataacgtacaccggcgaaaagacagtctcttcaataaacagtgctgggaaaactggatatccatatgcaggggaatgaaactagatccctatctcttgccacatacaaaaatcaaatcaaaatggattaaagatttaaatctaagacctcaaactatgaaactactacaagaaaactttgggaaaaatcttcaggacattggtctgggaaaaaatttctcaagaaataccccacaagcacaggcaaccaaagcaaaaacagacaaatggaaccacatcaagttaaaaagcttctgcacagcaaaggatacaatcaacaaagtgaaagacaactcacagaatgggaaaaatatttgcaaactacccatctgacaagggattagtaaccagaatatataaggagctcaaacaactctacaggaaaaaaatctagtaatctgattcaaaaaaatgagcaaaagatttgaatacttgtttcccgaaagaagacctgaaaatggcaaacaggcatatgaaaacgtgctcagtatcattaatcatcagagaaatgaaaatcaaaattacaatgacttattatcttatcccaatcaaaatgacttatatccacaagacaggtaataacaaatgctggtgaggatgtggagaaaagagaaccattgtactacactgtttgtgggaatgtaaatttgtacaagcactatggagaacagcttggaggtctctcaaaaaactaaaaattgggctaccatatgatctagcaatcccactactgggtatatacccaaaagaaaggaaatcagtatatcaaagagatatctgcaacaaaaaaactcctgtgtttgttgcagcactgtttacaatagccagatttggaagcaacctgagggtctgtcagcagataactggatacagaaaatgtggtacatatacacaatggagtactatgccaccataaaaaagaatgagatccagtcatttgctacaacatggatggaaccgaagatcattacattaagtgaaataaaccaggcacagaaagacaaacatcacatgttctcatttatttgtgggatctaaaaattaaaacaattgaacgcatggacatagagagtagaagcatagttatcagaggctgggaagggtatcgagggtctggggggaagtggggatggttaatgggcacaaaaagaaataaccagaaagaatgaacaagacctactatttgataacacaatagggtgactatagtcaacaataacttaattgtacattataaaataacttaaagagtataattggattgtttgtaactcaaaggataagtgcttgaggggatacataccccattctccatgaggtgcttatttcacattgcatgcctgcatcaaaacatctcatgtactccataaatatatatacacccactatgtgttcacaataattaaaaattttaaaaatttaagaaaataaatagaaaggttttctggttgaccagttcctacaaagacaggaagaacttaagataagtaaaaaggagagaaagtgactgtggagaagtttcaataaaccaagtccagagtgaattcaaatcaactgcacccactggtgatagggtaccaggaagcagcagaggatgactgcttatttacacaactcaacaagaaggctcagaagaagaaactgagatccctggaaggacaagaggaacagatctgagactggttcacagggaagaggttgaagctaatgcatacatggatcaagatagaggttagagcaccaggtttgggaagaacaaagactaagctagctcaaatgatgactcccagcattaaggtaaacagaaaacatttctagaacccttgctatacatgagtaatttagattattgttcctctctccttcttactgtaggcaaggtatacttcctagtcccatcaatccgagttttggccgtgtgacttgctttggccagtgggataaaagcaaatgttgttgtgaatgaaagtttgacatgtgcttgtttgcttgggcttgccctcttgagcttcttccttttgctctataaagaataagtgttgggtagtggctggtccaagaaacaggagagatatgtagaacaagccttcaccaatccacagggttagaggcaagcccagcctaggtcagccaaactatagccaacctgccaatacatgcacaggaaatagacagttattgtggtatgccactgaaattctgaggatgttcattacatggtgctattgcagcaagagctgactgagacatgtgattctctccttgcatccacaccacagtccaggtaagtaagcactgtcactatttccattttatagaggaggaaacagtcttggggaagttaaataacttgcccaagagtggtaagtggcacacctgggtttctaactcagatcttcctttaaagcccaagcttaaaaccactaccctatgccacctccctgaaactttattatcaagagggctgaggactgcaacggcagagacttttccagggcttttatcagataccaagtcatagtgagagcaggtggaatttaagagccagagaacagaggacaccaagtggtcacagtgacattgctctgaaaacttttctctccatgaaatggcacagggacactggggttatgtttccaatggtcaagatttaaagggactggcacctccaaagctcttacaagcctttctgtcttaacgggagcataacacctccggagagaatgatgctgtgaggtctcagcaaaattgagcaccccgtaatacagggtttctcagccttcactctattgatatgtggagttgaataattctgtgttttggcagtatgtctctgtgcactgtaggatgtctaagagtatctctgggccgggcgcggtggcttacgcctataatctgagcactttgggaggccaaggtgggtggatcacgaggtcaggagttcgagaccagcctggtcaatagggcaaaaccctgtctctactaaaaatacaaaaattagctgggcgtggtggtgcgcccctgtagtcccaactgcttgggaggctgaggcaggagaattacttgaacccaggaggcagaggttgcagtgagccgagatcgtgccactgtactccagcaagtgtccccctaaggaggggggtgtaaattgtccccagttgagaactacagccttaatacatgaagcatatttaagaaaagtgtcactgagaatatcatgcaatgtcttgactcctaagcctggctacacattagaatggttggaagggttttgggaaatgcaaatccccagaccttgattggactcactgaatcagaatctctggaggagaggcctgggaccctgtgttttttaataaacttcccaggtggttctcttttaggcagcccagcctcagaccagggtctattatttgcaagtcatggtatagtcattataagcatggtccctggagccagagtagcccaggcctggaggccagcttgagcatttattaacactatggaaaaaatgtcatgtttcccagctgcatggcacttcttggacaatagctttcctatgtcaggggcatttcccactgatgagtcctgcctccccaaaagggcagccccaaaactcgctcatgtaattctctgagaatcagatgtgcttatgtgaaatatcaattcagaagcccaacatgtgaggaagatggcaccatgtagtgcccatctgtctggcaatggtggcaatggaggcaggtggctctcagggcatcagaactgtgtttagagtcagtaacaagagcttggtgcccctgcccagaggcggcaagagtgggatctgcaaagaccagccctgcagtggggtttctggcaaggccaacctttagccctttgagagagtctgcacgttccctggtagcactgaataaatttctttctgtttaaactagcttgagtgggttctgttgtctgcaaccaagaagagcgaactaacttcatccctgagtcttttttcctcatctggaaaatgcgaagcaatattaggaatataacatagcttggagggtaacattggtctgagtaggttcaaattccacttctggcattacactgttgcttgaggcaagttacatcagctttctaaaactcagtttccacaaagtacaatgaagacaccacaaactttatgaagtgtcttcaggatcaaaatggagagttgaaatggtgctttgcacatttcaagcccttgaatattaggtattgttactgttggagtagcgttgaaggctttttaccatctatacaccactaaaaaccttcgctccaggaaatccaatctccttcttgattttcagaagtcaagccattccctgaccactatgcgctttgcccttgcaggtctcttgcctgaaatgtcctccattttacttccacctatccatatctttcaacacctagctcacctctctccttcgagaaatccatgctatcacttcccctctttgaacctgcgcagcatctggcaatcccatagctcaccatagatttagtacttaattatgtattgcagtatttcacccgtatttcatcctgggtacgtcttgtctccatggctagactgcagacttctcaaaggcagattccttgcttcttatcctttgggcacccacactgtgttgggcacttaggaagaaagaaaagaaaagcatgtcatattgaactgaacagctgaacagatgccaaatcaatatctcaggtcacaggagcaggggcgggtcagcgatgaagctaggagtgggtctccctggacccctggttttcatgcagcggaatgactactcggctatttggaaatttgcatacagatgacattctagaaaatgcaggtgcctgccttttcaccacaaaggccaattaagtgctcttacattttaaaaggcagactgtttgagaaatgcctctgagaacaattaagagtacaaaacgtggtaaatgaaactggaagttatcaaaagctattgaaggcagctgagagaaatggcaacttacctccacatgggaggctatacagcccagtggatcagaaaccaacggccaccagcgcccagtccctacccagcctctctccatcgtgcatgcggcacgacttctccaaacaaaagcattctcaactgtgaagtagcgataataatagtacttgcctcatagggtagttgttaagattgaatgtattaatacatggaaagtaattaaaacagtgcctagcacttaagtgctgaatgactgttggttgctatgataatgattattaatagagtattacatatgttccaaaatagcggggacctttgctgccttgttttctcagcacccggcatctccagcacacaggaaggactcaatcaatgtttgttgaatgattgcattaaatggcaagcttagctggtgacaaattatgatccagatcagcttgcagacccactgcccaagtgccctaggctgctctttccttcccacaggcagaggctcaggagcccttttataagtttctttcaatcctcagccagcccctcccagctcatcctctcagtccctcctggccaagggtccatcccccaacatcagctctagttccagcatcttgtccagctccctttgaacttgatgctttgagccattcctacaatgcctgcttctaccttctgaaactgaatttttctttctttggcatttgatagctgctagtcatcccaccctactgactgggcctgcctagaaccccaatcctgatgctccccagtctcccatggtctggggttcaaacacctctgcatcccaagccctcccaggctccacactgggactctggaattttaaaaacttgggtttaaatcctgatattcagggtatttacttaatctcgctgacctcagttttttcacctgaaaagtgggataacaatacccactcattggcataagaattaaatgcctatagcatgcctaccacagagtcttccatcaaaggggatgatccaatgctaattccttctccagctgctacttctacaatatggcagactctctagagccccataaaaacacgggatgagccatttggccagcaaggacctggtgattgaaagtgtgagcatcaagtctatttctccaaaagagagcagaactttgtaataaaactgagttgtggtagaaagcaaggaaaagccgcttgctgcagccttaatgagcaagataaagggcacatctttggaggccaggggacaggtttattaataggattaaagccaggggtagctgctggagagtcagagtggcttatcagtgtgaaatagtgtatactcacagataagatcacccccagagcagccaagaggccacttcagaaacaaacaaacaaacaaaatgcagtgggatcctgcgatagggtaggaaaatcagtggtcctcaagttctgtaccataatcttctgtaagggtggttacatcagaatcactggccgggggtgaaggattgggggttaaaatagagaatctagaacccatccctagagtttatagtccagtaagtctaaggtgttgcctgggaatccattagcaagtttttttttaagacagtgtctcgctctgtcatccaggctgtagtgcaatggcacaatcatagctcactgcagccttgacctcccgggctcaagccatcctcctgctttagtctcccaagtatctgggactacaggcatgccaccacgactagctaattttttttaagtagagatagggtcttgctatgtggtccaggcaggtctcaaactcctgggctcaagcaatcctctcaccttggcctcccaaaatgctgggatcactggcatgaaccaccacacctggcccattagctttttttctcttttcttttctaaatcttagatgatgttgctgaagaagcagccaggttttggactgtttgaagattataattagttttgtagcaattcagatatctggatgcatacattcatttgtttaacaagtatctgttatgtatttatgacatttttggtgagcaagaaataagaagaaaagatggtcatgttcctcgtcaagtttccagttggctactggagagatcagtcaaagggtacaacaatcaatcattcgttcattcaaaacttaagagcctcctatatgccaggttctgtgctatggaagcaggattttgattaggcctttaaaaatgggaagcaacaagaaaagggagaaagtcttatctttgatttcagcctaaccaagggaggcatcactgtttccttcttcttttttctttttcagaacgacatcctatattactccctgacaggggtgaggagtgtttcctacagttcacaggaaacattatgcatccatgattccagtccctaggcttggaagagaggtctgcataattgagatatagcttggtatgttctccagtgatactgagaaaagagtgaggagagtcaaaaggaaaaaataataatagcagcagttgtaaaacctaacacattaaacacttactatgtgccgagcactgatctcagtgctgaataagaataaataaacaagtaactgagttctcttactagaaaataattgtaaagtaacgtacaagtttgatattttctacacatggagttttaaatatgaagcagatatgaaggtattagtaaatagatcaaattatttaaagcaacatgtttaaactttcaaataaaacttaaacagaatcagtagtattcaatcagttctaagttattaatactaagttactcagtcactccattaagattcaacaaaatggttttgttaatcagtggtaccaaaaattaaattttggttttaaccttagtccttgttgttagctctcctggaatttttctgaaatttcatgaaaagaataaaagaatgatttcagaaaaaataaaaaataaaaataaacaaacagagccctttcattttctcctggaggaagtagcaaaaacagcagccctaaggagagataatttcagaacggtatcaatggcctccaaaatatccctgccatttgactatctttgttttcagagaatcctttggaactagcaccaaagcttcatgcaaaaagctgtgcagcactggttacaatgacctaaaacctggaagcaaactgtgttccaatagtaggggctggcttaaataatctctcgtacatacatataaaagaagaatgaggacactctctactgacatagaaccatttccaagattaaccgttaagtgaataatgcaaggtacaattttgaaatacacattattattaactatagtcaccatagtgtgcaatagatcactaaaacttattccttctgtaccctttggccaacatctttctttccccatctaccacatcctcaccctctgatcaccaccactgctaaaagtagattttaaatgttctcaccacaaagaaatgttaagtatgtgaggggaggagtatgttaattgacctgatttaattattccacaatgtatgcacatatcataacatcccattgtaccccataaatatatgtacttatttgctgattgaaaatgtttttaaatgtaagatgcagaagaatgtgtgctatcttttaaattttatggcatatggatgtattaactttttaaaaatttaaaagcaatatgtcaaactatttatagagtagaatccaatgatctatgtgggaataagaaagtttgggaaagaatttttgggaaatgttcactagttttgtttgggtagaagatcactgggtaattctttcctcccatttttctctatttctaaatttagatgtgtggtacaatgaaatacttttatcatgaaaaaaagacattttaaaatgaaagaaatcctggatccaggctaggggtttgcttagatatttaaaatcctagaacgcatataaaaagggactcgtgatcacaaaaggacatcagagaatgacaaaaatgtcaaagatgtggtcaggaaggcataaaccctacactaatttgccaaaacccaaaaagccaatgggctctcaaaatcaagccttaaagcaactttcagaggtttgctgttttaagtgtttggttaggactttgctgcaattaacaagaacctcaaatcaaactgggttaagcaaaagaaggaatttattggcttaaataatcaaaaagttcaggggaaagaaaagactgactttagaatagcttggtcctgttcactcatatttgttcttttctttttttttttcttagagatggggtcttgctctgtcacccagactggggtccagaggcatgatcatagctcactgcagccttgaaccctgggctgcagcaatctttttaccccagccttccaagtagctgggactacagacatgtgctaccatgcccagctaatttttttttttttttttttttttttttttttttttttttttttttggtctacagacagggtctcaccatatcgcccaggctggtcttgaactcctagcctcaagcaatactcccatgtcagcctcccaaagtgttgtgattagaggcatgagccaatgggcctagcctcacttacatcttgacttttttcctcttgactcagctctctacctggggcaccatattggggcattctaaatatcaggccctaggtagtggctcctagaaggccatgttcactgtagcttttttttttttaagcagttctagaagaaaagagccaaaggtgcctcttccccagcagaggcaacagtatgcattgcataccaactgagtcacctgctcatttctgcaacaatccctagagacctgagaatgcaatgccctgagtggcggggtggaaccaacaccatcagaagcgcactattctagaggaaaagcaggtaccaggaaaacagactgagcattcagcagcaaaacagcaggcagcagagaaaattgcaaattcatgtgtgcccatctcttcaagtaaaatgaataaataagcaaaatgaaaaaatatatatgtatatcattaagaagaacatgaaatctgaaatagatggacagcaagtaagagaacattgctttaaatgaattcaaatttctaggccacgtgcacaagtctcagaacccatgttcatatccatggagctacctccaaagacctgaactgtgatccctttcagagaaaccaaaccggagagaggccgctggggtctctcttttcacaaaggggatgggttggaagttgacatccgagaaccagatacaggcattgacttctgaggaaatttttttattaatcagttttataattgacaaataaaaattgtgtatattgtatttattgcgtgcaacatattttgaaatatatatacattttaaaatgccaaatcaagctaattaacatgcatgacctcacacattactctcttagcaaatttcaagaatacattgttgttaactatagtcaccatgttgaaccacagatctcttgaactgattatctgaggaaattactgaacaaattctaaaatagcagatttatgaaggcttagagaagactgatcaataaaacctactgtaaacttaccaagatcgtgtggtaccaaaacacactccacaggattacgagattgggagctctagggaagcccgataaaacccaattttaaaatagcacaaaaaataactaactattgggtactaagcttagtatatggatgatgggatcagcagagccccaaacctcaacatcagagaatacacctaggtaacaaatctgcacatataccccccgaatctaaaaatatttttaaggaaaaaaatatttaaacaatctgttggccaggtgagatggctcatgcctataatctcagcacttcagaaggctgaggtgggaagatcgctggagaccaggaattcaataccagcctgggcaacatagtgagactttgtctctatgaaaaatacaaaaattagccagatacagtggtgtacacctgtagtcccagctactcaggaggctgaagcaggaggatcgtttcagcccaggaggtcacggctacagtgagccatgatcccaccactgcactccagcctgagtgagaccttgtcacttaaagaagaagaaaaaaaagcatatgctattttcagaaacgcatttgaaaatttgaaaacatccatgtttgtgttctgaggataaagacaggtagaagaaacatgggtgtgaattagtagctcattgtctatccataccaactaaatgccatcatcatcatcatcaccataggtatttgaaggtttttactaccttacttagtcctctaaggctgaagtgctagcaggtagatatttattagtccccttttagagattaaagcactgatctcaagaggtgaaataacttgtccagctagcaaataatggagctggcatcctgacccagatctgtccagctgcaaaaatctttcctctcatgagttgttagcattattccaaacaaaacactgccctaaaagtgtgaaaatgtcctcagttcaccccttctctgcagtgggaccctgacatttaaaggcacaccaagaggagacagtgctccctgcagggctggagggtaatatctgaggtctgggagggacaaaattcacaaccaagggttactccctcccacctgtgcctgacatttttctttctaaaaaatctgctcatttctgttcttctttcctcttcatcttccccctctcccttttcaatattttatttctttatcttatttggtgttttcattgccaaagtaattcatgcttactataaaagcatcaagcaatagacaagtgtataataaaaagcaagaggtccaacccccaggaaactgctggggacagtttggtacctatccttccacagtgtttactgtgcgcacatcagtaaatcagacttaatacaatgttacaagttatatagaagtgctgaaatatacacctaagaagccagcagccttggctatagtctctggtgcatgcatgtggcatgattgtgcatggttctcagaaaccttgttgctgctcctatcattccttcctctaccagtccacaaatgtctaactgcctaccatgtgcgaggtgccaagctccgtgctcagaacacagctgtgaaccaggtggacatggtgcccttcctagaaacaaaatctaggctgcaagaatggtggctttaactcacttcaagaaacgcattcaccaagcaccttctctgtgccagcttttgcaggggatgaggtgatgtcacagatatatcagacacagcactgctctgaaatgctcatggaataatagaggagacaggctagaaaatgaggtccattatttgtgttttaaaattaggccaggcgcactgttcacaatagcaaagacttggaaccaacccaatacccatcaatgacagactggataaagaaaatgtggcacatatacaccacggaatactatgtagccataaaaaaggattagttcatgtcctttgcagggacatggatgaagctggaaactatcattctcagcaaactatcacaaggacagaaaactagacattgcatattttcactcataattgggaattgaacaataagaacacatggacacagggaggggaacatcacatactggggcctgtcagggggtggggggctaggggagggatagcattatgagaaatacctaatgtagatgatgggttgatgggtgcagcaaaccaccatggcacgtgtacacctatgttacaaacctgcacattctgcacatgtaccccagaacttaaagtataattttaaaaataaataaataaggccgggcgtggtggctcaagcctttaatcccagcactttgggaggctgaggtgggcggatcaagaccagcctgaccaacatggagaaatcccatctctactaaaaatacaaaaaattagccggatgtggtggcacatgcctgtaatcccagctactcgggaggctgaggcaggagaatttcttgaacccaggaggcggaggttgtgatgagttgagatgacaccattgcactccagcctgggcaacaaaagcaaaactctgcctcaaaaaaaaaattaaattaaaaaaactaataaaataaaataaaataaaataaaataaataaataataaaataaaatcaggccagctgcagtggcacactcacgtctttaatccctttgcactgtaacccctaagtactttggtaagccaaggcaggaggaccacatgaggtcagaagttcaagaccagcctcggcaacatagaagtttaatttaaaaaaaaattaaatttaaaaatagccaggtacagtggtgcacacctgtagccccagctactcagggctgacgcaggaggatcacttgagcccaggagtttgaggctgcagtgactgattgtcatgccagtgcactccaacctgggtgacacagcgagatcctgtctctaagtaataatgatgatgataaattaaaaaataataatttttattatgttgttgttactaacaaaatttattgaccccttcctagatgtcatacactatactaagtactttacaagcattaagtaatttcatccttttaaggaccgtttgaggtaactgtgatgattattcccacctcatagatgcagacactaaagctcaaagaagatgagtgccttgcctgaggtctcacggctggtgaatgactgggctgtgactcaagccaagagctgtttgtctccaagactcttaaagactcttttttaaaaccagcaagctattccatttcatggtattctctttttctccctcattagcagattcctacagaacccacatgactctactgttcctgccccaatttatttttgcctgagtctccccactttgggcaaaagcctcgcttgaactatatcgatagctacaatgactgaaaattgtgtcacgtatcacatagaatctctgttcccaaggtacccagagagactgaaataggtccgttaacagtcgtgtgttttacattccacttggagggttaacattcagggtcacccttcttctgagccttaaaaaccaggggtatcaaagtaatgagggagtgcgagcattccatggagtttggattaatgatctgtgagcctctgttcagccctgaatgcgtgtcatttttagagttcagcctggcaagaaaacttaacaagaatcctggtcaaaagaagtctcagtcatttaatgacaaagggtaactggacaacctaccaccagcaatttatttttagaccaagttaagtcatacttctatgcatgacctcactcccatgactctcctgccctgcccccagttactgtcctcagctctatgatgcaaatattctgcagatgtgtctctgccctgcaagattccctagacagctttaccttgactacagatatgtcaatgtccgccaccatagaaaggtctttatgacctttctgaactgaactgaactgatgctagcttgttccatcaagaccccttctttcactgtgcaaactgtcccccaagctcctgtgctccaatcagacaatcagaactttccattcatttcagcaaagttctattgagcttccactctgggttgggtagcaggctaggctggggacagaaagatgaatgagacccatgccttatgagacacatgatactcacagtgaggaggagagagcagatgacttacactgaaacaaaaacaataatgtttcacatccaataatataataataaacaagacacagaggaaggggttatttcttctcttctgagagaataggaaacaacaaagatacatttctacagagaagggctttaaaggatgaataggagttttccagggagaaaaggagaaaaggtcatttctggcagagccaaccaaagcagaaaattctgaaagtgaatgtttgacaggagctgcggagagggaagaagagggtgacacataattcagtaaagtgattgtgttgaacatggaacagcagaggggtgggagatgagcataagaagttgtgatggttccttgacaccttgcttatttttgtaattttttttttttagattttgaaataatttgatcctaacaggaaagttgtaagcttggtataaagagcgctcatatacaggctgggtgtggtggctcacacctgtagtgccagcattttgggaggctgagctgagagcattgcttgaggccaggaggtcgagaccagcctgggcaacatatcaagaccccatctctacaaaaataataataataatgaaagaattagccaagcatggtggtgctcacctgcagtcccagtaacttgggaggctgaagtgggaggatggcttgagtccaggaggtcgaggctgcagtgagctgtgactgtgccactgcactccagcctgagcaatagagtgagacactgtcttaaaaaaattctcataaacccgttttacctagtcttcctaaaatcgtcaatattttaccacacttgctttatcatcttttcttgatacatacatattgcatttgtatttttttatgaattgtttgagaatgagttggggtcatgatattcctttacccctaatcacttcagtgtgtatttcctaagaccatggtcattttcttaggtaactaccatataaagtcaggaaattgacattgacttaataccattatctaatccacaaaccttattaatatgtcaccaattttcccaataatttcttttatagtaacaaaaagaaaatgttgaccacctgtattagtccattttcacactgctataaagagctgcctcagactgggtgatttattaaaaaaaagagatttaattggcccacagttctgcatggctggggaggtctcagggaatttacaatcatggcagaaggggaaacaggcatgtcttacatggcggcaggcaagagaggagagcaggggaaacagccacttataaaaccatcggctttcttgaaaactcactcactatcacaagaacagcatggaggaaagagcccccatgatccagtcacctcccaccaggtccctcccttgacatgtggagattacagttagagatgagatttgggtggggacacagagtcaaaccttatcaccaccctatttacaattgggactccacccctctcaacatgtcctgggccctggctctgctttttctttgtagcattttctgacctctaacatgtagcattattcctatttctaaaatgtctctcccttcccaccatcccactagaatgtagatctatgaggtcaagaacttttgtccattttgctcactgtcatatcaacacccaggagagtgactgccacatgaaagttattcaataaatagtctgaatgactgaatggccaaacctggaggtatctcttcccaacccctcttcctcttatttttttaagcaaaaaacaataggctattttttcatgccaagaaaactgagcctccgtgttagtgtttttctccctttaagttcttgcttggggttttcttattttgcctcctgataggtacgtagggtatattgcaaaggagaaggttatccccagaacagctagggcttcttctaagaatagcccaagtcaactgaatctcccctgggtctcctatacagatgtgaaagtccttgacatgcaatggtatctatccctctgcaaacagagtgagcatctttagatctaattgaaagattaaaaagaagatccccagctggaaggtcaatttatagattccacagttaaatcaagccacattcctaagcacatgggacacaaaccttgcattaaatcaaagacttaatccaagttaagccaccctggatgaggagctagagctggagacatgtaattaacaccagccagtcagcaccaactgcttcagatgacaggtccacagcctggaaaaccttgttacaatttccaggagggctttggggatgcttgttctcaagttccagagacggtgggctttgcttctttccatctgatctcaactactgaccaccaggctccctgcactccagccccaccaacctccttgccacttctcaaacatgtcaaggacgcttccatttcaaggtcatttgcacctgctctctccctgagctccctctggactttgctcaaatgtcacctctctctcactctatttatttctgtaagcctctctcctccttgtcacctgctattccctcctgctgtatcccttcccgccactcttatcccacctgacacactgcacattgtacttatccatttactctttcttcccctgagaaaccccatgaaggcaggacttgtgctttttcattcaatgttccctcaccaatcatctagaacagtatgtagcatatatcaggcactcagtacctaactgctgagttaatttgttggctagttatctgattgattgattgactgattgattgggtggttaattaaatggttaattaatttacctcctgaggctgggcccccatatggccacctagctaagaaacaccatcaaacctggggctgggtattttggttatgaaggcaaataagagctacctagaaatgccctgacgccagatgtcttcaatattctgagacctgagtctctgttataggttggtgtccttgggataaagttcaagttctctgtccctttggttcttaccttgaggaactccatcttccacccctgaactgctcacctaccctccagtgaactagaacttttgtcagctcctcaaagtcaccaggttcttgccacatatgacgtctcttcctagaacagtcctctccatcatgccatagtcttcaactctggccagcacctgctccccaggtgtcccctgtctgcactcaccacactcttcttgcagtgaatcaccagactgtgggttccacgaagcaagagcccttgccttcttcttccccatggtatcccagtgtctagggcattgccagactcatgcttgaatatttgctaatttggataggagttatcatcttatttcacagatggaagttatgaactttttacacacctaatgtacaggaattttcacactaaacaatcctccaattctctgtggataccaattgggtattctataattaaattaaactttggcactgcctacctggtgttaccgtcagaccctatgagtgaagggttccaacccacaagaaggcccccaacctctgaggccagttgcaaatcccaggttgctacctgtactcctaagcaaccagctataaatcgggggttcctgcaacccactctcaggtttgataatttgttaaaatgactcccagaaatcagaaaagtgttttaattactactactggtttattataaaggatgaaagtcaataacagcccaatggaagggaagcataggggaaggatgggagaagggccccatgcacaccagcctcccagctccatgcgctcaccaactcagaagctctctgaaccccatcctttagtattatggaggttccactacataggtgtgattaaaccattggctatttggtgattaggtcaatggttgttgacttcagcctctctcctctccttgaggtgggaagtaagatttggggtgggcaatgagcctaatagctcctccaaccttttaatcatgaggttggtttctctatagccagccccatcctgaatctatctagagctcaccaagagtcccctcatttgcgaaaactcaggaatcgttgaaagggacttgttatgaacaacaaaagatgctcccctaaacccatcattcaggaaattccaagggttttagaagttctgtgtcaggaaccaggacaaagactaaatatatacttcttccttcatcgcagaggttaaatatagtatagtggtaagaccacagctttgaagaccatgagttcaaatcccaactcttccacttaatggctatgtgaccttaaacaagttatctcagctctctacatctttttctcatttataaaataacgatcatggtaaatttataattcattcaacaccgttctcaaggctaggaatacggcagtaaacaatagattggcccaaagtgatattcgagccaaaacccaaatggtgagaagaatttcgccaccttgagcctaaaaggaagaaccttcaaggcagagggaatatcatgcctgaaggtgttgaggcaggaacaacctcatagtgttcaggaaagataaaagaaggccaggccgccaggcacggtggctcacacctttaatcccagcactttgggaggccgaggcaggtggatcacctgaggtcaggagttcgagaccagcctgaccaatataaagaaaccctgtctctatttaaaaaaatacaaaatcagccaggcatggtggcacaggcctgtaatcccagctactcaggaggctaaggcaggagaatcccttgaacccgggaggcagaggttgcagtgagctgagatcgcgccattgcacttcagcctgggcaacaagagcaaaactctgtctcaaaaaaaaaagaagaaggcggccagtggtgcctctggcatccccaaaagcaagcctccaataccacgaaggtacacagggccactttccctgcacctctcggctcctgatctacccaactccagaccccaaggttcacctctagctctgaaaaggagcacagcttctccagccacatctgcctcattttgcctcaactgcaattggaatcgttctctgattggctcccctgggtacgtcctgaccttctcaatcccccacttctgtgccctaccatccccttaagtgacactgtcagccaggtttgcctggctctcaagctgcaaatctctaagacagaagtcaatgggtaatgagaataagaaaatgtgaaggactagaactccagatcttgatgctactggtattagttaggtcagagaagataataatttgacatcctaggaacccaaatttccatccccgtctaactccactatccagtgctaaattcaatggcttataccaatgctatttgattcttaatcagtgtctgctccatctggtccctttacagtactgattctcaaccggggcaattttgctccctaagggacatttcgcaatatcgggagacacttttggttgtcacaactggggtggatggtgctactgctatttggtgggtagaggccagggatgctgcaaaacatacagcagtgcacaggacagcctgcccctgtccccaacaacaaattttcctgcccaaaatgccaacagtgccaaggttgaaaaatgctgcttttaagtaacacagctcaccctgcataaacattaaacatatatataaagagatgttaaaatgtatttgtatgcagataaatgcaaattaaaacattaatgagatatttcacacctcgcaagcagacaaatttcaaaaaggacaaatattggcagaaaagtggggacataggaaccctcaggcacagctggtggagggtatgctggtgtgacctgttactatttagtcaaaggaagattcacagacgcaaggaccagcagttctataagaaagtcttacaaagctccttagaaagacacatacggaaataatcattgcaaggttatttgtggaaggtggaggtaacgaggttgtctatcattggggaactaggcagataaaagtggatgagcaaataccatggggtattagaagtgaccttttttttttaatttttctttttcttctttttttttttttttgagacggcgtttcactccagcccaggctggagtgcagtggcatgatttcagctcactgcaacctccatctcctgggttcaagtgattctcctgcttcagcctgctgaatagctggaattacagttgcctgccaccacgcccagctaattttttgtattttagtagaggggggtttcaccatgttggccaggctggtcttgaactcctgacctcaggtgacccacctgcctcggcctcccaaagtgctgggattataggcttgagccaccgtgcctggccagaagtaacattttagatgtacaaatagcaatagagatagaccttacagctttaatgagagtgaggagggggagttaaaaaaaaaaaaaaaacagcatgagacgattaatacaattccacatgcatcaatctttttcaaagtgtacacattgggagagtaaattggcacatgtactttggaaatttatttgatagtatttactaaagctcaatataaatactttgaaccagcaaattccactcctggaattatactcaagagatatgagtgtttgtgtccaccaaaagacatgtacacatttaatccataatagccccaaaccagaaacagccagttgttaataaagaaattgaggtatatgcatacaatagaatacaatacaacaatgaaaatacggatgcatctcatagacatcccattaagcaaaataagccaggcacaaagaatagacacagaatgcttcctttcatgaagttcaaaaccaggcaaaactaatcaacagtgttagaggtcattacactagtttcctttggaaaggatagactttttttttttttttttttttttgagacggagtctcgctctgtcgcccaggctggagtgcaatggcgtgatctcggctcactgcaagctccgccttccaggttcacaccattctcctgccacagcctcccgagtagctgggactacaggcgcccgccaccacgcccggctggaaaggatagactttaaggattgacggggagactcctgcagtgtgagaaatattctatatgttcatctaggtggtgattacacaagatctatacgtatctaagaaaatatcatgcagtccacataaggtctgtgctctttatgttaattataccttaactacaaataaaacttaggatggaggactttcaaaagatatggattcaattgacaataccaagcactggcaagcatgcagagtaattaggaattttcatatactgccagtaggaaagcaaaatgacatagcccttctggaaaacagtttggcggttttttataaagttaaatatacacttataatgtgaccctgtaatctcacccccaggtgccctaaagaaataaaaacacgtttgtacaaaaacccatccacagggctgggtacgggtggctcaaacctgtagtcctagaactttgggaggctaaggcaggcagatcacctgaggtcaggagctcgagaccagtctagccaatatggtgaaaccccatctgtactaaaattacaaaaattagccgagcgtggtggcaggtgtctgtaatcccatctactcaggaagctgaggcaggagaattgcttgaactttggaggtggaggttgcagtgagccaagatggtgccactgagccgaatccatcaaaagaaaagaaaaggagaaacaaaagaaaagaaaaggaagggaagggaagggaaagaaaaggaaaaggaaaaggaaagagagggagggaggaaggaaggaaggaaggaaggaaggaaaacctatacacagatacacaaatttatagacgctctattcatagttagcaaaacctggagaaaatctaaatagcctccaaagaggaagtggataaacaaacatccacaccatggaatactattcggcaattaaacaacaaacaaactcctgatacataataaccagaatgaatctcacaggcattatcctgagtgaaataagtcagcctcaaaaggttattatcttagtccattcaggttgctatataacaaaataccgtaaacttggtggcttataagcaaacgaaatttatttcacacagttgcggaggctaaaagttcaagatcagggggccagcatggtgagggccttcctctagattgagggccctcctccaggttgcaaatggccaacttcccattatatcttcaagtggtagaaagagcatgagagacttctctggggtcccttttataagggcactaatcccattcatgagggctccaccctcatgatctaattatcttccaaaagcctcacttctaaatagcatcatattggggattatatttcagcataggaatttgcaggaggacacaaacattcagcccacaacatgactttcttgaaaagacaaaagcataatgatggaaacagatcagtggttgccagggactatgggtgggggaagcatgcaactataaggaataacatgaaggacttctttggaatgatgaaagtgttcggtatcttaattgtgctcaaagtggttacattaatctatatatgtgttaaaattcatagaaccatgcatcaaaaaaagagtcgactttactatatgtacttaaagtataaaataaatgagatattgattcagagtcatattccacaattaataactatattaggaataaacaaatacgcgcacacaatatatattcttcaagaatatacacaaacaaaagatatacattaagcacacacgatggcctattaagggtaggaaatgtaagtaactagagtgaggtggtggggatgaaaggaaatgaacccagagacaaatcagtgagagacacatttgataatgcaactaggaagacttacaggagtgagaagcgattgtactcacagctatggtttattacaggatcggcaaggggcaagggacacacagcaggtagaatctggaagaatccatgcacagactcccagtgttctccccacctctctctagccctagggatcacggtgaatatgttctttcagcaacacctcttcagtgtttctgcctagagaagcccacgtttaggctcaaagtttgggtgttttattgagagctggtcacataagcacaaaaactagtaacaactattgaaattccaggctcctggaaaggaagcaggtattctgggcgcgaagcaggtattctgggcgctaagcgggcaaaacagtgttttacatagttagataacaatgcaaaagccaagttcccagatgccagtgaagagccaagcctgaaagcaagcctttctaaagatggcaacctcatgctgactatgttaattctcccttgccctgggtccttgcagagacccatgtggatgtgccacgagcctgtgatccaaaaaaataaaataaaataatttttttaaaactaggatctgcttctggttttcaattcttctattatttaagtcatgcaacagtgttaaccaggcaggctcactagcatgatggatggataaataagtgggtgggtaggccgacggatgaatggatggatagacgaatggacggatggatgaatggacacatggatggatagaagcaaaataaaatcaatactgtatgagccaaacaaaacaatggcttgagcattctgtttctaatgatgctctcaggaatgcagccacaaggaaactctgccctcacctccaccccatgaggcagaaactggccaccagtgacagggaaacaaagtggattcctcgaatgtcattgttattaaaacaaaactagtcccagaaaactgacctgaatgtattttttctctcacttttggcctgactgtctaataaccaaaagtcaccagaaaaaaaaaattttttctcagcaaatgcttaaaaacagagaagacccccaaagtacacaggggcagagaacaactcacaaatctcaagaataaaataaagatgaaagattctcaccctactgcaatgactctcccagcccactgccaccaaagcttctgagattaaaaagagaaattatttaatatatgcagtttcaatttttaaagtttcaggcatgaaagagcttttgctccctaatgatgtccctcagatgtagcaagacctggtctctctttcactgaagaattgccttcattttcaccacagacttcccttgcctcaaagacagatgctcagtcagagaaaggagcctgaggatccacagaaactctctgatattaattgatctgctcctagttttcagttattctattttttaaaacatgcgacagtgttaaccaggcaggctcactagcatgatggatggatgagtgagtgggtgggtaggttgatggatgaatggatggacagatgaacaaatggacggatggatggatggatggatggatggatggaaaaatagatggatggatgtatagatggagatagatatagacagaactagatacagacaaatagagacatcgttaaagagagagagagaggtaattatttatttttgcaacaagtatttattatctactttaggtcaggcactgctccagcttataactgtttgttataacagtaacaaaaacaaacaaacatccactaccttcccggagcttagagagagactataaaaaataaaaataatatatagaattatagatggtgttaagtgctatggagagagcaacatcaagtaaagcgtcttgggaccggctgggaagagttccagttcttaaagaatagggtcaggaaaggactcaccagaaaagtgacttttgaatgaagacctaaaagagatgagagtgttcgggttcaatattactttttaaatagacagacttaactacctgagaaaaaaacaggcatatcccaaaaatactaggacaagggaaaattataaaagttgatttaacaccaacaggtatgtaaaggagatgatgacataatgcttagttcctggcaagatttagattggagaaaaatagcatgacatgggcacacttggaagaaaccaatgggctatcaccaagaaggacctgctcgagctcaagataaccaggaaacataaccacctcttatgttataataatgtggtaacacaaaaagatgggatggcatgtcacatattgactcggaagtaggcaaaaacgtgagaccaacttgggcttagatacacatacctaggaatatactaggtgaagttaaagacagcaggagattgatattctacataaatatggaaatgcactttatgagttcttgagattctctggggatttttcataggtctcacccatcactggtcatgtaaatatgtcatttttagcaaaatcacattctcttcacttctatctgttctatattgctgcaaggactgctttttgaactagggtatgacaatgatctgtcttgatagtgtttgtgagtcaattcagaattacagtgattactaaagttggtcacatattccccccatctctatatgcattcctctttgtgatgtcactttgctgtcctttccactaaatagtagaacctatttctctaccctcttgagtccttgtcatgtgatttgccttgaccaagaaaatctcaaagaagtgatgttatggtaattcacagactacaccacaacaggccagaaacgtctaccttatccctcttgaaatgctaccctgagattgacatatggggagtctgggctagactcctcgagggtgagaaactatgtgaagcaaggtctggccaatagacagccccaaatgccagaattgggagtgaagtcatcatagacaatctgtctctaatggagtccccagatgtgtgcagaataggaatagccccaggaaagaccaacagaagaaccactcacctgagctcagcccaaattgttgactcacagaattgtaagtaaaccaacaaggtggttgtgttaagccattaagttttggataatttgttatgcgggaataaataactaatacagatggtagctacaagtctcttcctatgcctatggttgtcaagaagacagatgaagcaattagtagtggaaactatccattcattaaacaagtacttatggagctcctactctatgcacacacagcctagtggctcacaataagcaacctttacagccactgcttgacgaaatatctccagacaaaactattcctccaccatagcataaggtgatggtctgcccttgtgtatccatccttgtttaagaaacaaactaatgtcccttaactaaagattctccttccagtgaggacaaatgcaactcctcgtgaccactgtttctcctctggtgcccttccaataactcagaaaatctagactattggttgtttatgacttcactggatagcacctctattgtcatcaggccttcaggaggttgggtcttctgagaaatgcctgcccctcacccagccctagcaggccaatccattcctctttgtgtggtggagtcacgccagtgaagtggatgaggagtaggatgggagtcagaaaacttaggttccatttgtgcattctcagacttgtgggaagatacttcaccagccccagccttagaaatgagagtaacagagctgtacaatctctgaggtgttatttattcttaaggatacacttactggcagggaggaaatgctctaagccatttacatacattaccgacatcttctcttttaaccctccaggcatcaggcatctcgagggggtaggcactcccaccttcctgattttacaaatgggagtctgaggctcagaggaattgggtgacttactcaatgtcacacagctagttgcaggagtcagtcttttaactcaggcccatccagtcttaaaaacatggactgaaccagtgtatatccaactgacagatgagtttagaagctatctagtccagacaagcttgaactcagctagtccagcctttcatgcacctcacctatttagtgacagggaagtcattacttctccaagcaacttacattactttaggctgaaaattgcctgcctgaaattcctgctcactaatccctcttggccctctgttaacatcaataattccaccgataattacaaagcacctactaggcaccagacattatcctaagtgcttgggatacacgtatgaaattgctcattccaacttggtttggcccagttttcaagggtttcctgctcaaactcacacctcagcctgaattcccactcctgaagatttcttacctctctgtagtgagctctgttgatggcctctctccatcctgctgtaactcacatggaacctgtctcttccttcatttctcccaatgatctctaagacagagctgtctcatgccgctgactttactgaagctctcaggatatggagggggattacagcatgcaataagccatgacttccacaaagttacttatctctgtcttgaagttcttcactcacccctgccgtaggaaatttcacttccctagcctttcctcagagcccagctgctgtcatttttggggagtcctctaccaagtctcttgaattccacattccctagcctttcctcagagtccaactgctgtcattttggggggatcctctactaagtctcttgaatcctacattccccaacctttccttaaagcccaactgctgtcattttggtggggggtgggggggtcctctaccaagtctcttctctatttccttctaatttttcgcaatggtcagtacacccaagaccctctttccctgagctgggaaaagacctcaaattactatttttttgtcatgcataccaatgcaactcttcttaatctaagcttttctcatctctaccgtactccagaggaaacctccctgcaaataagaaaaccacaccaattaaagtattttttctgggaaaagaaaatatgcagttgtctcagaaggattcctcatgatactcctaggtcaactaattcaaacagcagccaacttttgaaatagaagttttctattaaataatagtaatgtcaactattaaacctgcaccttggcatatgatatgctacattcatttcttcatcttccaaatgaagaaactgaggctcagagagaaacattatcactagctttaaatcactgagctagaaagtggaaaagtgaagattcaaacagtccccaaaccaacacgcctttccagtgcttgaactatgatcaggcaagaaagtgcaacacttaaggtggcactcactctcaggggctgactgcacaagcatgaccctaagaatgggtacttccttaagagcagggtacctagaatccaagttcaggcaagtgcagggtgaatgcagctttaatttgcatcctaagcaccccgcttgcctcaccacagctggggccctgtaccttctcttccacaaacctgaaatgcatgctggacagtgaccatcctgactgggacactagcctggccctctgggcttgcatagcaattgatgcctggctttccctgtgcaggtggtgctgattaatggtgctgttaagaagagatccagctgctgctttcagtttcctcttcctgcagagatccttaattactgggcttcacctgttgagtttccttaaatgacatgagtgtgtatttttaagtgggaaaacaattcattaggaagtgccaacatctcagaggaggtaaatcctccagttaatttcagaaccacactgcttcagccacataagagagcggtccaagggggtactgcttttttctgaacgtcaccaagccaaacaaccaaccttcagcagatggcagggagcggccttgagaaaccacagggaggggtcatgagatcaaaccacccttagccatcaacctttagcatcctccctggttgcccctttagctcagcaccctgggaatgatgggtccacacagccatttaggtactgcttccacacggctgaaattgcatttgcattttattaaataaaagcaatctgtgcaaaagcctagcctaaagttactaacagatatttgagtctaagataatacatcttacagtattagaattcaggttctaagacaatcaccctcaaccgttgtcaatctttacattagggtagatttttgaaacttcaggtccctacaatctagattctgatttaattagtctagggtgggaccctggcctttagtatttttttaaagctgcagccctcagtggtgactccaacgtgtaggcagaattggaaaccactctaatttgtatttaatttttttttatttttatttttggaaacagggtctcactctgtcacccagggtagaatgcagtggcacgatctcagctcattgcagcctctgcctcccagattcaagtgatgctcttgcctcagcctccccagtagctaggattataggcatgtgccaccatacctggctaatttttttgcatttttagtagagacggggtttagccatgttggccaggctggtctcgaactcctggcctcaagggatccacctgcctcggcctcccaaagtgctgggattacaggcatgagccactgcaccctgctagttgttttatacatagagagagagattacaaaatactttctaaaggatagatcctgggtcttatcactgtattgctcataccaagcaaaatgcctggcacagagtgtgccaccgatacatgttttgtgcataaaaataaataatgtcacttgatgcttactagaggcaggagaagggacatagaaggagcaatggggataggtcggccaaggggtacaaagttaatcaggaagaataagttcctgtgttctattacacagtagggcgactggagctaatgaccatacattgcatatttcaagatagtcagagaagaggagcttgaaaatgatcaccacaaagaaacggtaaaggtttgaagtgatggacacacactggctaccctgtttgatcattatacaatgtatatatgtatcaaaatattacactatacttataaacatgtataattatatgtgtcaattataaatgaaatgttaatatgtcccttgattcttgtttgtacctttttccaattatttagccttacatatatatccatgtatatataaattttacataaatgcataaaaagtgagcattcctttgtgtgtgtgtgtgtgtgtgtgtgtgtgtgtgtgtatgagaaaaagagacagagacaagcagagagagagagagaggcagaaacagagagagaggaggagacagggagagagagacggcaaactttttttgctaccaattttggctcatttgccctgcccctctattctcacccccattgccatctccccacctgctccaacacctgccccaccagaaaacctgtactgacagtccagtcagtggtcttctatatagtgtccatcctcatttaattctagacagacatacagacacacatgagtgtgggcaatcattgttttatagaaatgggatcatattctaccaaccgttcccatgtattcaacaattccttgttgcaagccctccaagttgatttctcaaagaactaaaaatggaactttcactggacccagcaatcccatcgttgatatgtacccaaaggaaaataagtcattctaccgaaaagacacttgtgctcatatctttatagcagtgctagtcacaatagccaagacatggaatcaacccagctgtccatcagtggtggactggataaagaaaatatggtacatatataccacagaatactagacagccacaaaaaaagaataaaatgatgttctctatagcaccatggatgcagctggaggctgttatcctaagcaaattaacgcagaaacagaaaaccaaatactgcacattctcacttacatgcgggaactaaacactgggtacacaaagacagaaagacgggaacaagagacactgaggattccaaaagggggaagtgaaggagggggcaagggctgaaatattacctattgagtaccaagtttgctacttgggcaacgagatcatcagaagcccaaacctcggcatcatgcaagatacccatgtaaaaaacctgcaggtgtaccccattaaactaaaaaaaaagaaaaagaaaagaaagcccccaatacccctgatatcactcaccttcactgtccttattgggcacgtaccagtccataggtggaagccccattgcttagtcagccactcccccatggatgagcactcactttgcttcccatttctgcccgtcagaaataactcagccacaaacaggaggtcatctgatgcctgcaaccaccctatacagcacaaatatccatgtgaatctttcttcccatccgcagacacatagccaaatgcctagcaggccttacctgaccccactaaaacagtctttctggccagggaaaattataaagaattatatgagatcacacatacaaaaaaaaaaaaaccttcacagtgtgcagaaggctttgtgtcaaagtcgagctcgcacgtggccgtggccgggttctctgtggccagccccattcacaacacagctctggcagagcactcttcaatagcatcattaatagcccattgatccaattacatttctttctgttccacttcagaattacaatctcctgttccccctgaaagagcccagatagattcccagatgagtatcggaagaggtagctgccatcaggacttgcttgatggacccaagcactcatctaatagtggcactggaagaattaatctggctgatatatcagacctctctcctccgtgggaacttgccattttctccagcctctgagtttttctagtgagattcagagatacagccaaatgtgagttaacccagggacatcctaacactgccctcattgtgtgttcccagcatggggtaggcactccataaataatcgttgaattgaaaaatgcctaaggaggggtatattggggctcaaagcagaccaggtcggctgaagaaatgggctttatccagattgtgactttgcaggttggaccagaatgagagtttgaatctgattccataggtaatgcataaaatgaaaatatatactataaaaaggcaaagtcaagaccttgaatgatagctgagaaaaaagtagagagagctaaatacatattccaagtctaatgggcaggataatgagggacagaggtaggcagcaataggaccaaaatagcattcattcacttagtaactgtataatgaagacctaccttacgccgggcaccgtgctaagcactggggaggcggtggtgtagaagtcattatcccagccctcaattgctcatggtcttagggaggaggccaagacacaatcacattagagccatgaccaggacaggacagagctaaagcctatgacaaacataagcccagggaaattaaggagtatacagggaggcgcctaagccaacctggggaagtatcaaaggcttcctggaggaggaggatgaggaagaattagtaatgttgaatactggcaggtgaacaattcatactgtgagaggctgtggccccagtacccttgcatctgctttagactttgacttctacagtgagactcctggccaatgaggatctatgtccacagtccctgggggtcatcagccctgcactctcccacctccacatctttgtccatgttttttcctctgtatggatagcactctctggttccctctccccagtctgtaaaaccatcaccttcacctcccatcaaggcacagccccagtgctacttcttgcatgcagcttttccaacttcctctacctggaattaatctctgtctctttctctctctctctgaatttcaataacactttgcttgtttctctcttatagtacacagcactcttgacattgtattataattatttgtgtatttgtcttatctcctctgctaaactatgaactccacaggggcagaaaaaaccttgtcttaaccacctttgtattccctgcagcgccttatacaaggcaggtgcttgatacaggttgaatgaagattatgtttaccaggttccaggtaaatggaaggaaattaaaagacagcccagctggaaacagtgggcaggcattacaggcagggcccgctttctaacagctatcataaaactggctgcttgctggagctgtgaatttcccatcgctggttagagaaattctttaaaagggagattcttttaaaaatggttgtcctagatgatgtctaagctcatctaattttcactaggttactacaatggagaatggttgatgagtaagcaaagacagcagaaacccactacacagtgaaataggaacagatgtgtgttactgtcaatgtgattgctcttggttgaatgatgagatcaggggtatttattagattattaaatttttaatcaattaaactaaaagatccattctcagagaaataatgacagtatgtcatgagcaaggattataactaacctaattctaaacatccgaggattttttttgttttttgtagagataggggcctcatcatgttgcccacactggcctcaaactcctgggctcaggccattctcctgccccagattcccgaagtgctgggattacaggtgtgagccactgtgtctggctgagaatcatttttaaagtttgatttaaacaatcgcccatccccagatctgatttggggcatcaatggggccaaatgacatgggtttcctagagagcaaatctccggatgtcatacagatacttaaaaccttcaatggctccccatttccctacaacacattcctagtcctcagcttgatgtttgaggcttttaataatatagctcttgccagctgtaccttacacaacgccagacacactcagaccagaggtttcaatctcaagggcatatagggactcagtggagtgtgctgggccaggacaaaaccacaagggcatgccccaactcaacaactgagcaacttcacaggtccagcccctttgcccagcagaaatgcagactcagcattgcaagctcttctgagttttcaaaagaatcaggaaattaagatttttttttgtagaacctgccatttttcaatgttagcttaaaaatgcttaaacactttgtgaaaaatgcccatctgtggctcagatctctatgatttacttagactctattttttaattacttagatttactaaaaggtgctatgctcgcaccccttcaaatatccctccccgatgtttcctctctctaggttactcctctctgtctcctttcctggatttattccagcccaacctttaagactagcttctagttgcagtcattcctgcagaattacctatttctttttactcttccatattgtcacaatgttttacaatgaacctgagcagcagatgctgtcagtgccctcccacatcccctcagctcccttgatgattttgtgcacaccagtttcccatgtgctttcactcccaacagcctcagaatattggaatccactttctctgaatgcacggagagctagaagcacctgggaatttatgttgcccaagagcagcccttagccaatgattgacaggtggaggagtttaaatacttcacctcccttgcttcttaacgggaattacttcaaaatatgctgcctccagatctcccctgcagattgagccacagttatcttctgctagactttgtttgctatcacacacctgcttgggtttttcctggaaacacttcctattaaactggttttaaatgagccctcatttcaggatctgcttctaggacctttgatagacagcttttgacatgttctccaatgatctccagcaccttctgttaatgcccttatacaatcccctcaccatgagtgtgccatgtttctaaatccaaaagtgatgagtgtcacttccatgattgggatagaagagattgacttccatcttgccaccagactctctagcttgtcttctctccttgtgtgctttgataatgcaagctgccacattgaagagacccacatggcaaagaaatgaaggtcatctctagtcaacagccaacaaagagctcaatgctgccaataactactgagtgagcttggaaatggatacttccccagtcagaccttcacgtgagaccacaaccttgcaccaacatttgattatagccttgtgcaaaaccatgaagcagaggacctagctaactcgcatccatattcctggcccacaactataagataataaatgtgggtcagtcaagctgcttaagtcatggggtcacctggtatgtagcaatagataactaataccagaccccaacataagacgatgtgtaatatttctataattagaaaatattccatcctagatatctcctcctgaaagccattcctgagctcccagaccagggcatttttgtcacctctgtcatggtcttcatcatcctgaatttaataattaatataccctgcctccccatgtttttctcccctactgatcaccttgaaggcagagctttcagagagaaaaggtctgatatatttctttattcatcatctaagcatagtatcatataggagatgcttaacaaatgtatattaaagtaattgatttgttaattgttttccatatgagattttggccaagtgcctccctatataccattattctccagatgccaaatcaagggtaagggaggccttcaatattcagcaaaatctctactccatgcatcccccacatcattttctaagcagtttcttcctttccatcaccagggtgcttatcaattgtacattgacacttcctcccatctgttcaattcatctgttggatggtcactctctgccacttcagagcaatggggagttcactctgcctttcatacccctctgggaagcccaggaaaattatctctgattaatatcatttcttcttttgggtctaatgacaaaattacagcaaaatccagccctactttgcaccacacttggaaaaaaatctgctcagcttttgtctgccaaccacagcaaaaacttgattaaccaggactcagtgcacatgggcagagggctttttccccccagttagcagagggatgaaactgaaaatcccatttatttcctcccttattaacagaaaaaaagaatcaataggttagcccacattgctacccactgtcaataaattcccccaaagaaattgagtctctcttggaaagatgagcattcttgcaggcctaagaattgtgtattctgggactaaagatagtgttagaaattagactgaatcagcagagatctttggcatgtggaatttttatttaaaacactatttgctatcacttatattcccgtctttgcccttctcccagaagcaaagtataaaaaatgtgtgttctcatttttcaagtgttccagattcctaaagtccagttcatataaattgtagcatattcttatttatatgacagagactgtcacaggcatctaagctcaagcttattaaactgaagtttcctattctatctactcaatgggttctcatagtctcctaagcatctcatcatcttcctcctccctctgagacatgaaactcctacttggaaccttttcaaggtctacggcattgtgcaaaaagaaaaacctttcttgttatgcaactaacagatcctttcagttccaggggaagaaggagccaccagaatggtcactcaataacttagccaagtttcaactctgttttaagggaaaggaattgcaaagaaaggaaacattcgattattgagcactgactatgccaggcactgaattgagaatgcattttttactcctaatcatagcctgaggccctgcacgatctggtccctgcctgcctttttgactacacctctgaccatgcccccacatcacttaatatgctatacccacactggccctttttattttctagagcatgccaagctcttcctaccccagggcctttgcacttgctggtctctctgctgagaatgcttttgcccagatatgtgcgtggctcactccttgtcattcctcatttcttaattctaggccacctccaaaaagtaatcccgaactaagctgtccacctcccatgctaagtcattctttatcttgttcctttattgtattttttccataacacatcaccattttaaattaacttagttattgcctgcctccccatgaatatataagcttcatgaaagcaaagggtgttcctgacttactcactattgtgaaaccaacatgctagtacatgcctgccatataatagaatctaaaaacatttctggagtggatgaataaataagtttctctctgaatcctgccaagataaatattgttattatccccgttagcagataaggaagttgaggttccaagcagattaggaaatctcacaagtttgcacagctagaaggtgctagagcaaatcttacaaccacggaactgtctaactccagtgcgtgcattctccatcattcctagacactgtgtgggaagacaggagattataccttaatcaattgttttctaacttctgttcatgaaaaatgtctgggcagctgtgacaaggaaaaaagtcttttatcagctcacagttgtgagtgtgacagagcagggatatatcttctgcatcaaacattgccagtttgtcaaatatcagaatagaattgaattttaggaagacactatttctgatgcagctgtttcttttggatcctctcaatgggcagagaagatcccagcaatagaatgggtgaggcacgcatctgtctattaggatggttggaatgcatgaatttgataagccctatatttggtgagggatgtctgtcctcaccccaaaccttctcaccaacgtgacctcccgccagcatggaagccagtgttacaacattgtgagaactgggccctgcaactgtgctggtggccatttttctgggaccctcttcttttactgatacctttgggagtactcccatattcatttccgttgggcatctcattcgttgctgtaattcttgtcttcagttcaaagctcaaaagcctcaccataaagaactgggttttactttttggatcttgatccttggggaaaccccctaaaaaagtctatatctactatatccactccccatcttccagtcatctctgagcatggctgatgtagggaattgctcaacacagtttcaaagccccaaacaacaagctagctctggacatgcctacctgctatggtttgagttcagtttgtgtccctccccaaaattcatctgttaaaatcctaatccccaaggtgatggtattaggaggtgaggcctttaggagatgactgggtcataagacaggagccctcatgaatgggatcagtgactttataagagatcccagagagatctttgtccctcctatcaggtcagattatagtgaaaagtcagccatgtaagaaccaggaagcaggtcctcagcagacactgaatctgtagacaccttcatcttgaacttcccagacctcaaaacagtgagaaataaattcctgttgtttataagctaccaagtttatggtattttgttacagcagtccaaatggactaagacactacccccattctatttaaaagaaaataatctattagctcaccacatttactgtgctgaaaatttccaaccagaagaaaaagctttatggaggtgacccaacgatatggaggtgcttacaaccccatgggtggctacaagaatcaaagagagaaattatagttcaaaggcaaaacgtatactatctcctcatccctattttttcttggtttaagtcatttttattaagagtcataatgttctctatctacatgacactttccatcttcaaacattaactaattaattgactgaaatggtatctcgggagcatttatcatctatcacattagccagagagccagggaactgtctataaaagctgttgaacactcagtggaggcttcatctttccgcttcctttcccagaaatgtttttttgtgtgtctgcatatgaatgtgcaatggggaaaaaaataaaaagagaggatttgacttccaccaactgctataaaaatttacctctgggagacatggaatttcaattgtgaaataatcagtcttggaaattgtcctgtcctccaggaaaagaaaaaatatgtagtttaacagcaattgcccttcaaaacaattactaattataacgtctataaagaaaaataccctcgataccattactcctaataaagccaggcgaatctatagaaaggaattagctggcatgtctaaaatctgacaggagagctgttggggatgggtcagaagaggagtgagctccaaccagcttaaaaacctggatccaaagctttaggaggcttaccacctggagcaagcctctcttagcaaattggcaagattagcacaagaaatcaggccaggacaattacaaattgagaacccaagtcatttttcctgaccttccttccactctatcccatcccagctttctccatgaacctcttaacctcctcttcaagcagatgtcacggtacctggaactcatgccttacagctcaccatcttcccttcaccacagtcctcttaaagacatatgcccaggtagggttacaccaagcccctgagcccttggattgaatttgactgtcagatcctaactgtttgaaacaacatatgtcatggaggaaggatcttggaggaaagaaagagagaaaggggccacagaaaagagaagttggtggcagtgctgaagatagacaaatggaaaaagtccgttctgatttcaaattctccatcacttccctgctgtgaagcctgtgtcaagttgatttgaactctctgatcctctcacctcagtttctcaaagtgaggggaaaatatacctgaaagcctactttttaaatgagtgttcagttgcagacaatggaaaccactccagctaccttacgcagaagggaagtgattaccagatgtaagctgacttaggaaaccattggaaggacccaaagagttggagcttccaagaacaattccctggtcccccaaatcactctgcctctgctatgatggtgaaaactgctacctgcactacgagaagtcaccacatcaggaagctaatggctgcagaactacccagactctgcagagatccacaggagcaaagtgaatggcattatgccattttcccctcttaactcagttataaattcaagacgcaaagagtatctgatttgcagaacctgagtcatagtcagaatcctagctgcaagggagtccagtatattgaccttttagcaacccagcctctgcagtatagaatgacacagttgacagaggctggaatggaaactgaaggagcccatgcacaaagggcaccacccacatgattcagggctgtcaagagaatcaaatgagatggtgtttacaaagcacctaatatgctgcctgatcattagtagcttctcaataagcactacttttccttcactttcccaaaattttgctgcagcttggccctctgaatcatcctaaaagaacagaagaaaaaacctggaagcagccaaatgaccttcctaacttaaatgtgagggttttttgggcatctttcatttagcaaccttatcaaacatcagttatctctatttaaggcattcccccacctccacagaaagaatgaatcattttaagcagtagtttaagcttttactctatccaaacaaaattggcaaaagatcctctccctggataattacattaacattatttatctaaccactatttttctttttctgagatggggtctcgttctgttgcccggaactggagtgcagtagtgtgatatcagctcactgcagcctccacctccctggctccaataatcctcctgcctcagcctcctgagtagctggggccacaggcatgcaacaccacatttggttaactttttgtatttttggtagagacagggtttgtccatttgcccaggctggtctcgaactcctgacctcaaacaatccatgcacctcggcctcctgaaattacaggtgtgagccactgcacctggccaatctaatcattatttactgggcacctactagttgcctggcagatgtgattcctctccttcaaggagttaacagtctaggcagggtaattgtgcaaaacttgtaagattaaaattctgataaaacattaagagaagagatcagagtgccataagccagaataaagagggtgaaactgattctactcagggagtcaggaaaaatctccctgaggaagtaatgtctacactaaaacctgaaggataaggaaaagttaacctagtaaagagtgggagggaagagaatttctggcagagaaaacagcacatgcaaaggctgagtatttaggaaaccagaagaatacctgtgtggctggagtatgttaagtgagaaggagagagaagcgataattactttggctatggaactccaggctattatctggggtgacattttccctcaggttggaatccagatatgtgagacaattaacatttcataaaaataacttttgaagcaatgtttttccacctttctgtatctcagttgtctcttctgtagaatagtgttaacccttcactggatgatcatgagtgttaaataggataacaagtatacgattatgacaagaaggctgggcccttttgagcacagcagcgacatcctcatcatcttcttcagtgtttagccataccactccagagagctccaccaagaaccagagaggtgcttccctacctgcatgacttctctgagatgctctctagcccacacacagcagaggcacccacctgacaccttcacctggccacatctgattggaccagagtgtacacctcctactacccggacctatcatattcctacacctgggaaactcttacattcagatagaggcgcaattgatcagagtgcattagaagctggagctgtaaggtcatgaagaagaagtcccagggccctgggcaagtagaaactgggaaacagcaaaccctgagattccaacggcaggcgccagtctgcagagaagagaatggagcagatgtgcagaggtaagctccagagagtgaaatggagaaagcggctgattaacaacattccaagtcccatgaggtccagctgcatacgtcggatttccagagagccttgtgtgtccagacagtaaaatttcatatccactttaatctctttgaatgggtttctattccttgcaattgaattatcactgtctcagaggcccatcaaagtggagagctgaggccacccttccttaaatcagacctaaaatgtaaccctatcttgctaacaggacataataccggaactgaggaccccaccaccatctcaaggccttcacacaggctattccctttgcatagaaagctcttccacccgctccttttgcaaaactaaatctcactttcttccaggctgccccctttgagcatcgcttgtaaagactcccactccaaagtggacccttgctgtggtttccatagctctcaggacttccctttgcattgtgtaactcactttggatcactcgtaagatggctgccaccccaccatatgtgacattccacacttgcatcctgtttcttgcttattccccagggtttgagtgggggacacatagtagctgcacaataaacatctgattaatgcatgatggatagtctaaaaggatcaaattgacattctactgaaaaagaagagtttcactttagcctactaggtgctctactctatgcaaggtgttggaaacacaaagatgaattagacatcatccctgtgtttaggtcttgaaaagcctaagggaacaggtggataggtagataaatacgtttatgacaatgtaacaacgtgagtgttaggagagagagagactacaataggtgtatttctgaaggttttttggatgacaggggaagagagagagatgttgtagagggtcctagtggcccccacaccatcactcctcagaatttttgcagaaaacaaatgtagtgagcatctgattgttggctgctcagcatctactctctaattctgaatatagcacttcatttttccttttggaaaagcaccttcctgccctctcagcccaccagcacactggtgtaactggtatcaattcaacacctctgtccccagagtcaaggatggatgtgtgtcccaagcctagtcaatcagaatactccatcctcacaaggagtggttcagggatgatcatgtgacagtttagttaaatgagagtcaatctgggagtgtaaattagttcaactattgtggaagacagtgtagtgattcctctaagacctagaggcagaaatgccattagacccagcaatcccattactgggtatatatcccaaaggaatataaatcattctattataaagatacaggcacttgtatgttcactgcagcactattcacaatagcaaagacacggaatccatctaaatgcccatcaatgatagactggataaagaaaatgtggtacatatacaccatggaatactatgcagccataaaaatggatgagatcatgttctttgcagggacatgaatggagttgaaagtcactatcctcagcaaactaatgtaagaacagaatatcaaacactgcattttctcacttataagcaagagctgaaaaatgagaacacaaggttacctggggggaaaaatgcacactggggcctgtcagtcagagtggtgggggacagagagcatcaagaagaatagctaagggatgttgggcttaatacttaggtgatgggataacctgtgcagcaaaccaccatggcacatgtttacctatgtaacaaacctacacaacctgcacgtgtacccctgaacttaaaaggtgaaaaaaaaaagataagagtatatctcagaattcctagggagaagcaaggagaaagataagctcttctgtcactagaacccctaacctggcagcagccttcagctgagctgctgaagcctgtcttgggactacaaggggaaaaaaactccccaaaaataaatcttacaaggaaagtagcaggcctgagagaaaaagccacttctgatgtcagtttgaacatctggatccaaatagattcatcctggatttttcagttgtgaatcaacaaattctactttttctgtttaagcttgagttcctgaacctcaacactattgatagtgtttggctggatgggggctggcttgtacattgcaggatgtttagcaatgttcctggcttctagagccattctcacccacgagtcatggccaccaaaaacagctgcaatcattgccaactgtcccaaggggcaaaatcacctcctattgagaaccactggtttaaaccagttttcaggttcctattgcttgcaaccaaaagtcacgagcatacagtaacctatcaaataattccctacccaatttccaggaataattctcactcctacatgcttttactttccgtggtacctggaacatctttctatgggctttgctttccaaagccagtctgttgattttacattttttaaatattggtgtcaatgaaagtaagtcaatcagatcaagaacagcttagctctcagtcccagcagtacttgtacaagtgacatatttgggtacattgattatactttttcttcctcttaaaaatttaaacatcttccctcatttactttctttattttagaattctcagcagtcaattttcttttatctacaggccttcccttcgatgggaaactaatcaataagaaattagatttttgccaaggtattttaaagtaatgtaaccagcatatttttctctcattcatgactttattattgtgaaatgaaaacagaaataccacatccttgaaaccctcattttattaagctccatcacagctaccttcattcatcggagccatctcttccaatgtcattgttttgggtgaagcttgtgtttgatcaccaacctcatattttaaattgaaactcagctggagtagagttcttccctctgaatgagggatagcagtctggtaattagcagcaaagctcaagcagacaggctgcatccacttattctatctgaaattcttttccttttcttttttttttttggccagtaattactcttatcttggtgaagctgacccacctcttggcccctcaattggagtctccctttcaagaaaatatcacattgtgttgaataagaaaatcaaaatggaaatgaagcttcaagaggagtctagctaccatcttttcaattgccttttgaaacatcagctgggtggactttcaagacgcaggcacagttagatatgtggatctgtttcttagattgcacttgtgtatctgaagacatccattatgcctaagagggaaggaaatgagcaaggacttcccaatgcatacaggtgcttcgtaacacctggtgatcttgttactgaaacaccagaggttcagtctaggttctaatgcttgctgcacagaaagccaatcactgagacaatgagtattgccagggaagaaggcttcaattggatcctgcagccaagaagatgggagatcagcatcaaatccattcccctagctgactaaaattaggtatttttatagcagggaagaaatgtaaccatttgtgagaaaacaggaattagggagaggaaaggaagaggagtttgtcaacaagaagcaagtggttgcttaggcagtcatgacggatgaagggtcgggtgctttcactgtccagattcagagatctggtgagtttcagctccttgattctatctgggaagcctgatggttggaggcctgagaaaggaactcagataagacaaatgtaacttttgcaagtttcaagactgggatggccaatttctatgtgtatttaaaagaaaccataaacatcagttctatgggacaattgggccagtttcagttcggctcagttttttggcatggaaaggaggaagagactatcaataatattaacagtatagctatattgatcctttattagagggggagaaatctatttatttgggagagtagcttcaaagtgtgccaagtcagggaatcaaaggcacattgggaacaagctgaccaaacatcaaccagcatgaatggtcttgagccctcaagaccaagatgagccaagaacccacttcaagtttgaccaaagcagacagtaaataagacctccctgtaggaactccgctcttgttgcctaagctacattccaccttccacactgataattttatcacaaaaacaagcaaatgcaaaggaagaaagtagtgatatgataggatgacacatgatctagccaattccatctagaaggcaaataaaggatggaggcttggtgggattaatgcatttattctttccagaaattatagagcccttactctttgtctggtactgttctaggcttggaatacaagcaaagatccctgcagttgtggggtataccctgtaacaggtgaagagtgacatatcagaggaaggtcagtgactacagatgaaagggattgcattgagcctggacatttcccatgtcctacaagcctcctcctgcctttggtagaggtgagtgtaaataaacaaaatgtttcctgcactcaaatgccctcctctattttatttgttatgggagcaaacttccatctccaggacagcagagcgtagagcatcttctggtgtggtagctgtggtgagttagcttgagctgaagccaatgtgggcaactgtctacttaaataactcacctattcacctattcctggctgccatcaacaaagttggagcctccaagaagcagttaggattaacatattaacacagaggacggtctttttttttttttttttttttttttgagacggagtctcgctctgtccctcaggctggagtgcagtggcgcaaactcggctcactgcaagctccgcctcctgggttcacgccattctcctgtctcagcctcccgagtagctgggactacaggcgcacaccaccacgcccggctaatttttgttgtcttttttagtagagacagggtttcaccatgttagccaggatggtctcaatctcctgacctcatgatcagagggcggtgtcttagtccatcttgcgttgctataaacaaatacctgaggttgggtaatttataaacaaacaaaggtttatttagctactggttctgcaggctgtccatgaagcacggtgccagtatctgcatctggtgagggcctcaggctgcttccactcatggtggaaggtgaagaggagctcgcatatgcagagatcacatggcgagaggggaagcaagagaaagagggggaggtatcaagcctttttaacaatcagctctcacaggaactaatacagcagtaactcacttataaacatgaggatggcaccaagccattcatgagggatctgcctccatgaccccaacccctcccatgagtctgccacatccaacattgggatcaaacttcaacatgagctttagggggacaaatactgagacgatagcaggcagtcagcaaaaacaagaactagcatgtgttgagtctgcttgattcatcctttcacatatatcatgtctcatttcacttccacaacaattctatgaggtatgtatgtattagccccatctcacagatgaagaaactgaggctgagagagactaagtggcttgcataagatctgtctgactccaagttctacagcctttctgcattgttgtgctgcctatttcacccaataaagtccaacccatccgcatgagagtgttaataaatcaataacctgagtacttcctggggctggctctgtgtctatccctagattgggcactgtgaggggtatgaaattaaggtacagtctttgttctcctgagactaagttagctaaggaaacaaagggaaaagcattcattcaatatttaacgaaccataccaacactccacccacattcaccctatcttacgcaaatacttgtggatcccaaaacgtgccatgcctttgcacaagtctgcaatgccctttcgtctctcctctctgcttcaacctacatcatcttcatctcgcaagagttagatcatccagaaagcccctctaaacccacaggctagttggtggactttcttctatgaattccatggaccctggtgctcctctccgccataaaactctctggaaaaaaaatcagtgagagcttcagaagttagggaaccctgtaagtgagatgactggggagaaaacaaaagcctgagatggggaaatggctaaagacaaaagaagaaggagtatgtatgtggcccaaggtggtatcatctacaacagaaaactgacagccaggtaagggactgtatagagctagggatgttgtcacagtaagaaatagaagatatcattactcaaagccaagttaattacgatgttctgctttcacttattttttctaagtgcttccacctctggaagcatttctgatcagcacaactgtgaggttggtagtaggtattatcattcccatttagtggaaggagaaactgagatgctcagagaggttaggtgagctgcccaaggacacacagcatgaagacactaaggcagcagaatggttgagatcagactttctggtgtcaggcctacagctctcaaccacctggccatgtgaccttggacaagagacttaacttctccaagactcagtttccacacctaataaaaggggactaaagaatctctacttcgtagagatgttgtatggtgacataatcatacgagacctttgtcagtcctggacatatctgtaacaataaatctttgttccactcatcgccactgcttttgtttcgctgggatcatctgcaaaaccgcttgtgtgaaactctggtcccagctgctctccagggacaccagggcttccttgcaaaatatagcagccaagatggctttgggcccccaagtttctgagctcttgtttgactgcacatccccttccttagaaagccagcatcttcacgtttcctttctaagctgccaggaataaatgccaggttctggctttatggaacagtttgggaaataattagtttgccttccacagaggccagagttcacttctaagatatttaaaactctactgatggcttaaaataaatatcacaatggagatgtcaaaatatctatgtgttcttacacatgacattggaggggcagggagactaaaaaaatgtaaatggatttaccaaaataatctcgaggtaagacctttgaggcttgataccacagaagtgccatattgtttttaagtttcttttttttttcttttgtaagtttatttttctcctcggagggcactgaaagttttgttgtgagaagcaataaagttctgttttccaaaagagaataaaagcatgattgtatttttaaaaatcaatcttaataatttccagccattactttatgagcttaatgcaattcccaaacactgataactgatttctccaactggaagatgcgaagcgcacccaacggatgccaagttccgggctgagtactttaaatatttattgaattattaatcctcataagtgctcagtgaggcaggaatgatattcctcattctgtaggggaggtaatggagaccctcaggtacttgcctaaaaacatggggataataaagcagaaagtcaggattgaagactaagtgtccttatcctgactccatgctctttccagtgagttcttcaccccatccagatctaggagtgctgaacactcaacaacattatcaggcaagacaacaaacacacccgtgtcaactggagtttgtggctagtataaagcaatatagagtaaatctcaaagagaagtaggtcaaagaaatacctacaacctcaagaatatgtccttttctggctgggagcagtgcctcatgcccgtaatcctagcactttgggaggccaaggcaggaggatcacttgagcccaggagttcgagactggcctgggcagcacagcgaggtctcaactctatcattttttaaaaaatagaatatgtcctttcccccttgcctgcctggataaaaccttcttctttatctcttgctgcttcccacttcgcattttctgctctgttaaacatcaaaccgcttctgttgcccagaactatgtctcaggttccatgcagctgtgcctctgcaatgctgtgcctttttcccaaatgctgttcctctacaatccacttagcaaactcctgttcatccatcaaaaccctgatgaaacataaccttttaaaagaagtcgtcttcatccctctcccacttctagacccaatggaattcacgcgttcctcttagtcttctctccatagcatgtacatgcttacatttttataattattgcaacgtctgggatttgggtctctgggttagttgattggtttggctgatatatcagtctccctcacccgactggctttcctataggcaggggctatgcctgaatccacctttgtatcctctatgcccagccctgtgcccaagtcaaaacaagcatcgaattgaattgaatcaaaattgaaaatgaaaacaaatatcttggagaactagaatatagggaaacaagtgttaatgttgtaagagtctatcgcagagcaatcaaccagaccatgtttccctaataccgattacaaagctggcacagaggcaagacggagcagcagtggggatttatgctctctggacatctgttgggcgtctcttctgataaatcctcgccttgccctgctgacgatctcatctttcagaagacagaggaagcgacagagaaaacggttacttgccactaaatcctggcaacgaggaaacactggttaatgagaaaagtggaatccttaggagaaaaaaaaatgggcacataatcctagagttaatgatggtgcaagaaaggaagaaagaaaataagcacccattaaaaacctacagtgtgccgcctactttacgtgtgttactacatttaattctcacaacaaccctgggaggtgggtttcagtcacttccattcacagaaaagaaagccagaaaatggagagagtaacttgcccaagctcataaaaggcaagtctatctgcctgcaaacccccagttctaacctcacaccaggctgctgagcaaaaaaagcaaggcattgcctgacttcaaacctagagttgatgaataaggcagcgtcaatctgtataggctaggtaatgatacagtaacaaaacacacacacacacacacacacacacacatatacatacacacacactgaaatccaaatcacggtcatgtgacacgatcaagctatttcttccagccttggcagctttctaggacaggcagccaccctcctttgtgtgctggctgagttctccactttgcttccacctcatgaggctccatctcaacagatgcttcagagcttgcctcattcagggggaaaaaaaaaagccccggaggatctcaccccagtaattaaatgctgccacccagaagtcacatatgccacttccactcgtgtggcacaactcaaggccaaggggcagagaagtgcaattctccacccagaaggaaaacaagccagaaatggttgtgcaacgaaaattccaaccacagtagctttctgaaagatgagaaagaaagcttccatatgcagcaatgaacactggccaagcccggcctctgtgtactaccaggggagagaggagaaacatgaaaacaaaaattaatatctagaaggcaatgatcaaaaagagagagacaaagggagtgatgttgatgggagaactgggttatggaaaaggatttcacaagaatcaccaagcacatgtggaaggtcagtgccatgaacaaggtccccggacacaacccaagaaggaaatattgtgcaaaatagattggagtgccttcgtcagttcaggctcctataacaaaataccacagcctggggcttaaacaacagaagtttctttctcggagctttggaagctggaagtccaagatcagggtgccagcatggttggttccagtgagggttcattttacggtgtgtagacagcaactttcttgctgtgtcctcacttggcagagagggagagagcaccagcttctttctcttcttatagggacactaatcccattgatgagggctccacccttgtgatttaattaccacccaaaggccctacctaatatcatcccagtgagatatcatcccgttggaggttagggtttcaacacatgaatttgtgtgggggacacaaacatagctccatagaaaagagtctcagaaattgtgtctacccattcaatttttaccattcaattccattcccgggaattaggaagaagcaattaataggactaataagagctgtctggaggctcttattgacaaggctgtgagcaaaggatacaaggtgggacacaaaactgctttgaaaatggaagcaagatagcctgatagaaaaggcactgggcctttgccactgtcctctgtggctttataaagttacttaacctctctgagccttggtttgcttctatgtgcaacgggaataatatactatctgcctcaaaaggtagttgtgaggattgagaagatcctgcaggtaatatacacatcaaagtgcccagcaagatgttagaacaaggaaaacaatcataagaaggatgagcatgacaataaactctccaattggataaattcaagttggttgtctcaggaaccatctgtcttgtaactctctgacttcatttcccaccaccctattattgcctgaatttgctgcattgatcttttttgttcttttttttttttctttgagacggagtcactctgttacccaggctggagtgcagtggcacaatctcggctcactgcaagttccgcctcccgggttcacgccattctcctgcctcagcctcccgagtagctgggactacaggtgtccgccaccacgcccggctaattttttgtatttttttagtagagacagggtttcaccgtgttagccaggatggtcgcgatctcctgacctcgtgatccgcccgccttggcctcccaaagtgctggaattacaggcgtgagccaccatgcccggccgaccctttttgttcttatttgatcattccaggaatgctcataccttagtgcctaggtactttggggttctctcttcctagaacacttctcagaaaatgagagaatgtcttgttcaagtgctattatatttactcattgaaaccttccataattacctacttgaaattatggcatccactccactcctcacactctctattctctttccttcctgtattttcacattggcaattatcatttcctaatatacaaaatcatatacacttttttattgtctatccccccttcattagaatatattctgaaacttagatgaattctccagccaagaaaaacatctgacacatagtacgcatttatcactacgcatcgtttttgttgttgttgttagagcaaccctgcatttctctactctgatccattacattttaattttatattttagcaacagggaatgccttatttctttgtggaggtttttttattttgttgtttgttcttctgttgtttgtttttttgtttgtttgtttgtttttgagacggactcttcctctgtcgcccaggctggagtgcagtggtacaatctcggctcattgcaagctccgcctcccaggttcagccattctcctgcctcagcctcctgagtagctgcgattacaggtgcccgccaccactcctggctaattttttgtatttttagtagagatggggtttcactgtgttagccaggatggtctcgatctcctgacatcatgatctgcctgcctcggtctcccaaagtgctgggattacaggtttgagccaccgtgccgggcctagggcatgtcttatttctatatactccttctacaccttttattctggcattgcaaattcctagcaaaacatcctgaagggttcatgctgaaagggcaacctactcttcccatactatcttactgcaacttgttcttacttcagtcttggagctgcccattacatgagccttgcagtggcttggacatcaacctgtgagaagtcgccagcatccaaaatatctgagactcacagaagactcagcataagctcctgtaacgactgtatttcctcaactgcaggatcaaggtgtggctgtgaatgtcactctcatcagtactcattttgtactgcttatggtttgtttgtttgtttgtttgttttcagggaaatgaggttgagatcaaaaccaggacccagcgcatgtgattctgtatcataaagaatatggaagtacatgtatggagctctagtgaaatttgcttggactcagttaagatgcaatggtttgcaagtagttataacacctgaattcctgggacaacttccgattacttttagaacacagagacacaatatgggcatcatttcaatatcagatcttatttgtctgaaaataccagatcactagggcaatgaaataaacaaccagctacaaaccagctacaaattatctagagggtacagcctccattctctacaggaaaagagattcacattcttagtaccaggcccagcaataaacaccttaaatattaatgttattccatttcatatccacaataagcactacggcaaggtaaattctatcggctccattttatttttaattgcccaggctggaatgtagtagtgcaatcacaactcactgcagcctcaacctcccaggctcaagccgtcctcccacctctcagcctcccgagtagctgggatgacaggtccatgccaccacacccggctaatctttgtattttttgtagggacagggtttcaccatgttgcccagtctgctctcgaactcctgggctcaagcggtcctcccgcctcggcctcccaaagtgctaagattacaggcgtgagtcactgtgcccggaggccccatttttcaggcaaggaaattaaggctcagaaacactaatatcattgcccaacttcatgcatatagcaaaagacagggttagaagtcatagctatgtcttcctgactctagactgtgctttttccactacaagggatgaaactggggaaaataaactgctcaaatgaataaaatgctcaaataaaaaaatacaaataaataaataattttatattttagcaacagggaatgccttctttgtgggtttttttttattttgttgttgttttttttttttgagacggagtctttctccatctcaaaaataaataaataaataaataaaaataaaatgctcaaataaataaaaacaaaccaatgaacaggagtgctggtagacctgcttctttgcgactgcttaatggcttaaagggccattcatttggttttgaagccaccaaagccagggcaaggtgaaacgtttagtccaaatgggtccctcaccccatttgggaaccaatcactgtcccctatagacctagttcattgaaggcatttaactgaatccaatcatccacattactaattgacctccacaagccaacaaaagaaaagatcggttcatccaattaaccttgggactagctcacccttgatctcaatgctcatccagatggagagaagtcctctgggccaagattgggaaactgagcccccctttctcaaagctggcagctttttaaaggccaccaactccatttcacaagagatgaggagagacagatggtgaatagagtacctgcaaaaactcaaagatacacagggccagtgtagcaacttgcacacttgcaacttgtatttccccctttttcctcccaagtagtctcagtctcccaacctgattgtcttataagccaaaacagcttttgcgcagcttgatagcctcagccttgatttttaaatgactagaaattcaggaggcaaaagagcgatagtcttagctcaaaagtcaaccggacctgggtttgaatcccagatccacagcacaacagctgcaaaaccttgagcaattagtgatatctctaagcctcggtttcttcatctctagaagggaaatacaaacatagtgtcttcctttcattaggttgtggctgtgaagtgaagaaattacaggtaaagccttcgacatggggctcagcacacagcaagtactcaataaatgttggttatttattctaaaaaggaaaaaagttagctagtctataaattttataggtcaacatcagtactgaaaatgactattcaccatactctgaatcttctcttgatccgtgcgcttgtaatttctgaattttaagcttctcttaagtccttattggggagtcccttgggatagttaatgttctcccaagactatctgcactgcaccccgcttatgttccttctagaaatataatcaggatgagcctggaaaatctcatccacatcatggttttagccatcgaatcattccctcaataaatacgtattaatcatctattgatcaccaattactgtgctctgtacacagagctgggcactgcatatccagctcatctccactttggtggccaagatactggaaactcaaactgtccaaagcttgatgccatgggctaaactgtatctctaaaaattcatatgttgaagcactaacacattggagaatgtgatggtatttggagacggggcttttgggaggtacacaggtttaagattaggccatcaggatgatccttatgacgggattagtacccttgtaagaaggcactagacagcttgctcactctctcttgaccaagtgaggacacaggagaaaactatcatctgcaatccaggaagagcccctccccaagaaccgaatcagcaggcaccatgatctcagacttcccagtctctagaactgtgagaaataaatgcttgctgtttaagccatttgatccatggtattttgttaaagcagccagaactaaaacacttggtttccaacttcatcttaaaacatgcttctcccctgtctcctttcttggttacaggctccactgaccaacccaaactgaaatcatttgagactttccctccctcactctcatatccagtcagtccccaactcttatttgtgggttctagatttgaaaaaaaaataaaaataagaagctcttccatctttataaacagagctttttctccattcatgactgatttctactcatcctcagggctcatggtgtctcctctaaatcctccagcagtcttcaaggcggtcttattactttcactcttccctagtagagtccctgccgaaaagccattttctgaaacacaatcctgaatctgccccttttctgcttaaaaaccttcaagaattcacaaaacctccaggatatagtctctgctcctcagctgggaaatcctaccataactgagccctggcccccgcccagccatttctcaacaagcccccttcactttagattcctcagcctaattgcaacatccccaaatggtccaggtgctttcaaacctccacgcctttgcaggtgctgttccttctgctccaaccccctctccattccttgactgctgatcctatactttatcctcatctttcataggttcaaatccccccatgggccattactgagcccccttcccaggctgtataaggctactactttcctctctgttccaatatattcccactataataaatatgacacagtctattgtaacttgttctttccctctttctctgtccctcctccgcataaccagatggtcactcctttgagaatagagagatcctgtcttatttattttcaatgccatgcaggttttaaggataaaaatcaagaaaaaataaagttttggcaactgtgctaaagccagaaatttctgaaaatgactgtttaatgcataccatggggataattataacgataataacaatatcaactattttaagtgctaaatatgactaaacattttataggcatagctcatttaatccttttaaccaccccaggaagaagtattatttttgctctcttgttttttggatggggtaaatgaagcacagatctctctttctctctctctctcacaaacaaacacacacacacacacacacacacacacacacacacacacacacacaatgggtttgggattcagaaaggcacagttcctaaactggctctgtcatttatcatctatgtgacctgaaggcaattcacttaatctctatttgtttcctcatctctggaataagaaaagacttgttgtggtaatttaaaaagactatttacaaaagtattgaaccaggagcagtggcatgcacttgtagtcccagctactctggaggctaaggcaggaggattgcctgagcccaggagtttgaatcctgcctgagcaacatcatgaaactgtctcataaaaaaaataaagtttaaaaaaacaaaattaaattgacacatagtaggtactcagtgatattgtctctttctccaaacacttacccagacctgtatgcttcaggaatagtattaatgtcttaaaccgggtaactagtctgctgactggctgagattcaggcatgtcagtatcgcttggctccagcttacctaatagactagctctgagtctgtctccatccatgtctcccacccacacaactctagcctcatggataaggtgaggctcagggagtgtgacctgggacgaggttagaatgagcatgactgccatgcagtttgcttgataacttcgaaaaagctgaaagcttagcagtttggttttgaggttgtgatgcaaacgtgtaagtgttcgatgtgtatttctgtcaaccacacctgaaaggccgtgtgcaacaccatgtgcccaggtgcggaagctcagagacttgacgtaggcgggaatttgccgtgatagcatttaagcagccatctgttttccaggagattctggagccaccttccccatcaagcccccctttcccgtcctcacgcacccccagctcctcactcaggaatacattgacatttccagatgtattgattacaggggcagactagctttgggcgggagaagggagagaaatggattgactttattatttgtgggtggaaaaaaagaataaacaagggtgcttttgtttgaaggacaaaaccaaaattatcggttgaatggggctgaattaagcacttaaagttcaatccttccagagtgctgacagtgcacaggcggagatcaatacagaaactatttgggccgtggggaacctgggccctgcttattaaccgctaattataccaagttttctgccgaaatgggttagttcccttcaagattacgatacaacagaactggttggcactgtcggacccgggtctgggatccaacccctggagcaggaagtccaaggttcaggataaactcccaaaggccttctatttatggagcccacttcccaatttgccacttgcaaatcagggtgtagacagcccaccactttcttattagaattttaaaataagactgccaacggcaagacggatatttcactagggctttcagtacggccacaccagttgttcaaaacagggacactctcccacgccagtcgctcagcaacctcccctgctacctcacatgcccctcactctcattatccaggcttaacacctggccgagcaagggcctgcggggcccgctccagcatccactctggtgaatctgtgctcatgccctcccggtgctcaaacattttgagcacgaccctgaccacaggcaacaactttccataatccgttagtcaccagccagtctacaaacccagatgccttcccgtggggagggggatattgattgtacatacacaatgtcacacacacacacacacacacacacacacacacactatataaatacacaactgcatgtatatgtatgtagttatgtatatatacagttatatataaccatataaaatatggaaaatttatatttcatattatattccattaactatatattaaatatgtatatatactatatatagttttatacacttaatatttaacgtactaaacatttaggactaaaactaaatatgtactatatgtatgtaactatagttacatatagtacatatttagtactaaatatactatatatactaagtatttacatatctagtatacataaatactatatataccatatatatttatatataataatatataaatattgatataattacatataatatatatttggcactaaatatactatatatgtatagatagtatgtgtatatataatatatactatatatgtgtgtatatacgatatactatatataatactatatatactatagatactgtatttagtatatactaaatttactaaatatatattcagtatatactaaatttactaaatacatatttagtatatttagtatacataaatatttatagttacatatagtacatatttagtactaaatatatactatatttatatatttagtaaatatataaatgaacatgtactatatgtaaacacatgtaaatatataaatgtatatattaaatatataaatatatagttacatatagtacatagtatatatgtagttatatagagtatatatagactataaactataactatatatatatatatatgaactatacacagccatccctcggtatacacaggggactggttccaggacccccaggtgtaccaaaatctgtgcctacccgagacctgcagtcaaccttgcagaactcaaggacaggaaaagtaacccttcatctacacaggggttttgaagcagttcacatctgtattgttcaagagtcaaatatagatagatagataggtagatagacagacagatagatagatagatacacacacgtatatagatgcacacacatagtttatgtaaagttggtgtgtttgggagatatttccatgttgccacttatcaatttatcttatctttttaacagctacatggcgcccagtagtacggatataccataatttagccactccctagttgatgaatatttaggttatcccacattttctctatcacaaaacatactgcaatgaacaccttgaacatatattattctgcacatatatgaatatttccataggatggattccaagaagtggaattgttgcgtgtttttaattttggcagatcttgacaaaccattcctactttctctcatacaaaaatgatggtgacatgtgcccccatttatctggatggtttgcaggaatgagccccctcaaagtggtctctggtcaacacaacgggtctctgtgatgtacccacctgcatttagcaatcagagttcacagagcactttccagtctgcttggcacacattcgttcacaaagaagctgagggaagcttcattgctgcttctaaaaagcagattattccagatccccgcaaagcttccagtctgttgagctacctgaaaatgacaagcagcaacttccctgcagagacctggagtcagagtttggccatcaattgccacccagaccttgaagccactctgcttgtctctagggcaatgtgaactcctggccatcatgccttgcttaggatgtcaccaagtgtcccctgaaaaacagctgtcagtctgtccctctaatcataggacctcaaacccagcacagagagccaaatagaaagcggatcctattccattccctttatctccctgtttccattaaaaataaaagcctcagagcatgcaagcaggcagaggagagggaagtattgtccacagtcaaagcatctcgacctccagatcagtcagccagaatgtcctgctacacaagcatttttattcgttccaggatgttcttgaggcagcttccaaaaatgcacataacataacaaaattggaaagtgcaattaacagacaaagtgagaaaaatgaaaaatatatatgagacaagatataaagacccaacctaaatgcctaccaatgatagactggattaaaaaaaaaaagtgttatatatacaccatggaatactgtgcagccattaagaaagaacgagctcacatcctttgtggggacatagatggagctggagaccactgtccttagcaaactaacacaggaacagaaaaccaaatactgcatgttctcacttagaagcgggagctaaacgatgagaatacatagaggggaacaacacacactggggcctatcaaagggtggagggtgggaggaggaagactcaggaaaaataactaatgggtactaggtttaacacctggatgatgaaataatctgaacgacaaacccccatgacacaagtttacctatggaacaaaccttcacatgtactcctgaactaaaaataaaagttaaaaacaaaaaaagaagaagaagaaagaaagaaagaccgaggagaaagaaacctatatgaggcattaagctctgcacaatttttaggcatttggactccaacaacagcaacaaaaaaaggcggatagagggttcgggagatggaattacatttagtgtctatatctacaatgtgcatgaaaataattcccacattttgactttaatcacagaggctgggcatggtggcttacgcctgtaatcccaacactttgggaggctgaggtgggtgaatcacctgaggtcaggagtttgagaccagcctgaccaacatgatgaaaccctgtctctactaaatttaaaaaaattagccaggcatggtggtgcatgcctgtaatcccagctacttgggagactgtggcaggagaatcgcttgaacctgggaagcagaggttgcagtgagctgagatcgcaccactgcactccagcctgggcaacaagagtgagactctgtcttaaaaaaaaaaaaaaaaaaaaaaatcacagagtggaaaataggaaataaagatggcacaactttcaatttctcagaatgggtctgtttctcatttgaacagcataaaatccagccaggcctcctctccaaccagcaggccaagactcttccaaactgacctgacaccccgccatacccaatcttggcaccccacccacttccccctcctcagggtgctgcccaaaccagacaaaaagcaggcgccaagatgctcccacaggactaaggctcatagtgaccttcttaaaaaaaacaaaaacaaaaaaacttagttggcaactgttaaacattgggaaattgtacataaaaaatcctgatctctcactttttaaaaaaacaagtggaaaagaaaaataggcaacataacatctccccatagctggagctggggccgccttggaggagaaaaggtacctcccattttgtgcactcagcccactttcctgactcatgcccatgcaaaccccagctaggcaacaaatacttatattttttgattattatttttttttagtagaaacggggtttcgccatattagccaggctgatctcgaactcctcgcctcaaaccatcctcccacgtaggcttccaaaagtgctgggatgacaggcgtgagccaccacccctggcctaacttttcaatttttttaacagagagaaaacttaacggggtgagtaaaatggcaccaaaagacctgaacttggacccatgacttggccgtccattttctgaatccaccaaatgaggggtccgacactgaatgacgattctttgcacctctgacaatgttctttcttttgactgacggaggtcccactttccagggtaggggattttgctggtatctacgaaccatgccaacttggcttaaacggtcaagaaagaggggggtctccataatggggccatttcactctaatttcttcttgaaatgcttacccgactggtcccctccctcgccccttacctatccctttcctctctagggttttgctaggatgttagccggatgtaaggtacacggacgaactgcaagcttagaggtagtgattggctttgcaagcagaaacaaaaacaaaacaatgaccaaaaaaaaaaccccgcaaaaccaacaaaataaaacaaagcacctcttcctttgtttaaaatacattttgcgttaaaccagtagcctaccaaaggcagcctggagccttaagtgtgttctggaagctgagccttgagcgccatctgggagcagagggcggcactgcagcctcccgccctggagcttcgcctccaggtccttgcagactttccccttcatgatccatctcttctcctgttgccccaaggtctcagaagaggggatgtgctacaatggggagttatgggttttgcaatcagaccctgacacttcactggctgtggggtcttgggcaattcattgcctttctgcaacatgaggacaatcacacccaccttactgggagactggaagattaaaaaagaaaaatgacataaacgggcttatagcatgcagtcagcaaacttatccccttccgtcacagtgccataactcagtctacagacgagtaactcggggagggggtttgtttggctcatctgtaaaacagggctgctggaagccgacattgcataacccatatgtacaacaactggcacacagtgagtgctcagctgttaataaagggaaggaaaagaaactgtaaatctggctctgttataggtcctgaggttaagcaaatagagagacagttataaagataagtaagacaagagagccaaatgtaaataataatatcaggtaattaattagatgtatgaacaaagttcaaatcagtgtagcttccaggctatatcaattacctcgcttaagccctctacgccctttacaacacaggactgtcacccctgcccagtttacgggccagccaaggagggttcagaaacagcagggaatgtcctttgggcttacgctgtttgtgaccctgcttcttctcggatcctagtccatcttcatcttttttttcccaaaatggttttctcatttctgccactgaagttgaacaaattcaacatctgatttttcctttccctgtctcccctctgcccacaccctcccccagtacttcatcctcctgaggtcggctcgatcccaacttcatgtctgtcccatccagccctcttcaattccactctcctctctccagttatgacccctggatgcctgaagaagccttctaactgtgctctccactgtccagctctgctccctccaatctgccctgcatgagcccctgagggatctcaccctttcagcaggtccacctacaagtataacccctctaggtgacataccttccttcgggaagcttctcccaacaaccactgacccacaagaatctctgctttcctcaaacacaagtagacttcgcaactctgcctacctgttagaataacctgaagaagcttcataccacactgttcaccaacaagcacacaaaaagatgctcgatgtcattagccatcagggaaatgcaaattcaatcaacaatgagagaccactccacacccacaaggatagctataattaaaaagatgaacaacgacaagtattgatgaaaatatggagaaattggaaccttataataccgctggtagaaatgtaaaatggtacagtcacttgggaaacaaggctggcagttagttcctcaaagggttaaacagagttatcatatgacccagcaactccactcctaggtatatatatgtaagagaattgatagtttctgtatccacacaaaaaacttatatacaaatgttcataatagcagtattcatggatatccaaaaagtggaaaccaccgaagtgtccatcaactgatgaatggatgaacaaaatgtggtctaggaatgacgtgctgatccacactgcaacacagatgggtctttaaaagctatgtaagtgaaagaagccagtcacaaagaaccatatgttatttcaatccatttatatgaaatgtccagactaggcaaatccatagacacgtaaagtagattaatggttgccaggggttgggggaggggaaatgggaggaaatggggagtttctggtagtgactacagggtttcttttcgaggaaatgaaaatgttcggactgtaggctgagtgtggtggctcatgcctgtaatctcagcactttgggaggcttaggtgggagggtcacttgagctcaggagttcaagaccagcctgggcaatgtagctagatcccatttctacaaacaaaattttttttaattagctgggtgtgatggtgcatgcctgtggtcccaactactcaggaggctgaggcaggaggatcctttgagcctaggaatttgaagcggcagtgagccatgatctcatcactgcactccagcctgggtgacaatgtgagaccctgtctctaaaaaataaaaaaagtcgattgtggtgatggttgcacaattctgtgaatatacgacaaactattaaattgtgtactttaaatgggtgaattgtatggaatgtgaattatgtatctgaataaaacttatatttttaaaaaaataaacctcccattccaatcacttcctcattgttcaatatggcttcatatatttcttcataaataaatatactgatttaatacgtgtttattcgcttattgtctaccacaacagtaaaggtaatttcaatgagagcagagcctatggcgcattcacttctatattcccagtgctttgagcatggcacaaaaggctactaaataagtaagtgccagtgtgtgaatatatgagtacctgtaagaatcagcaaaaataaaatactgtttccagggccccagccccagagattcagacgcaattgatctgagggagagcctgacaaaggtctggctcaagacttcttgagtgataccattgtacaaaccaagacgaagagccctgatccacagcagttgtcatctataaccctaaccctgtgtcacccctgcagatgaggcttcagtagctcaccattacctctacagacattctaaattcaagttaaataacgcagatgaaggactcaggtgagtctgggactttctgtatcagaatcgtcacagatgcctcaaaaaatcagattcccggaccccgttggagacattcagatccttgcagacccctgccagggaattaatgagttcaggttcattccacatgcagattctcgggactccctccaggaaattaaattgagattcccggatttaaccccctggaaggggtcccaagaattcacgtgttgaacaagtgtcttttctcagacatgctgaaggtagggatctacagagtcacattcatgcaaggtctgtggcacaagacctggctctgcctgcatctctggcttcatctctcaacattcatgcccccaccctgtgcaggtccaccaaccccggctactccacgtaacagaaatggcctttccctactccttctcttggcttctgcaaccagcctcccaaccttcactcaggtatcaaagtggcaagcttttctgggttccgtgtctattctgagctcccaagcctcctacagttgcacttaaccagggatgattgtgcttttcaagggacatgtggcaattctggggattttaattgtcatattgggggggtcactactgccacctactgggtagaggctaggaatgcttaaacatcctacaatgcgcaagacagcccccaccgcccccaacaagaactatctggcccaaaatatcagtgtaactgaacttgaaaaactctgctatagtctattgtcatgtgagttcctcgaaggcagggaatgtgtaacactcacctgcataacctcagataccacatacagagcctgacacacagtatttggtaaatactagtggaatgaattatccgtaccttgcatctggcattcaggtgtgttcatttctgccctattttattccagaaaagacgtgtagatacttaaaaaaacttactcaatgcaacaggataaaatcagtgaaggtatcgtagaagcagcagctatgatgaagctataggtgggttgagagcagttattaggattatttttatagccacaaggtagagataagctgaaatttgactctgggcttctggttggcatccatgcaataaaaatgtcccagttgctcaagggaagcacagctctctctaaagttgagaggtgtggggcactgggccatagtgagagtgaagtggacaaccctttctttctttttttttgttttttttttctttttgagatggagtctcactctcttgcccaggctggagtgcagtggcgcaatctcggctcactgcaacctccacctccctggttcaagtgattctcctgcctcagcctcccaagtagctgggaccacaggcgtgtgccaccacgcccagctaatttttatatttttagtagagaaggggtttcaccatgttggtcaggctagtcttgaactcctgagctcaaatgatccacccgcctcagcttcccaaagtgctgggattacaggcatgaaccaccacacccatctggacaaccctttcaacagcaccaatacaccaggagtctttcacaactagttgttataacttcctctgagttcttttcctcttccagaactcattctctttctctttcccatgtaatttgatagtttctttctatctcttaagtttgagcttggccacatgacttgttttggtgaatgaaatgatgatagacatgatacaagtaggagctttagatgtgtttgtgcagctggatgtgaattcctgaatctctcccatcaccatgagaagagcatgccctggctagccctctggttcaaagaaggtaaaaaaatacctggagtcaagctcattcaacttaacccacagacctgtagcctacagcagaaccacacagctgagcccagcctagctcagcacaccccctgctgacctgcagttgcataagcaagcccagctgggttcagccaccccccagtcgcagatgcatgagctaaatatatgttcactgttgcatgccacagagtttggggaagattcactatgccccattattgacaatgggtaaccaaaatatctcccaatagcaagttaaagaattacgccaaagcgtggctaaataaataaatgaaagcaatcttttggggggctaagatagaccaaattattccatgttacttaagattcctcccaaactaagtagtaactccttggtgatagatcatattcttccaccaagtgaccaccactgagctgggcacataagaatgcttgatgccaatgtgtcaatcagtatttgattgggaatatagccaacccatttcaagagaaatgctgtgaactaaagtcaaaatgttggcaacactgaacaatcaatcgactgaattggacagtcaatagattcagatgctctaaatgccttccattatatcagatctgccaaaggtccaaaaaccaatgatgcagtggcaaatttcctggtctcatctcccacgcagcatccactctcccccagatggttgagttctttctggtcatcttagatccctccagaatggattttttttacctctcatgcttgcgcaaggctcaacttcaattcgaagaaagccttcccatacttccttttatgaaattacaagcctgggatccctaccttgtctgctcagaaataaaacagactcagccccatctacacttgagttagagttgagagttgcatactctcaactcctcatgtggctgagttgctaaaggtgttgtattagttcttgcactgctatgaagaaatatctgaagctgggaaatttacaaagaaaagaggtttaataggctcacgattccgcaggctgtacaggaagcatggctggggaggtctcaggaaacttacaatcatggcagaaggcagaggagaagcaggcatgtcttacatcaccagagcagaaggaagagagagaagaggaaggtgctacacacttttaaacaaccagatctcatgagaactcactcactatcacaagaacagcaagggagaaatctgcccccatgatccaatcacctcccacctggcccctttttcaacactgggaattacaattcgacatgagatttaggcagggacacaaatccaaaccatgtcaggagtgaaccatggagtcaagcagtcctggtttctatcacagctctgccacttatatgctgtgtgaccttgggaaagcacttagcctctctgagcctcggttgttctaactatacaatggacataatatttacctactttaagactgttcttaggactgagaaaggtaaggtctataaagtacttagcacagcccctgacacgtagttggtgcttaattaatgctcttatcacttgattttgaattcagagagtagacccatcacagcagagctacagtggggtggaaaggggaggtaacggaggtaacaggacccactatgagcacctactgtgtgctagcagctgtgctaagcactttaaatacactctctcatttaatcctcaccaccacctactttgtcaccattgcttctataacaggacatcaagtaggaattctccagttgttctggatcaatgactacagcagacagttggtacctagctcagggtgagagatccccaagagaaattgctccaaaagagggtgatcacacatccccagtttgccctgcatgatcccaatttatacctgttgtcttaacatatctattaataacttctcattccctttcatactcagaacagtccaaatctgagcaacaaattatatggtcacctgtcatggtcaccagccaattatatggtcacctgccatggagccatgggggctgattgcaagaaggaggggctagcatctctatccctgagctgcagagccatgagcccctctagtgcgatcatctgagtaagatggagtgaggacactcttggaaaagctgactctaagcaaagcttaatgtaggaaaaggacaggggcaggcatctccctctcattccctgtgccctaagagtgcgtcacagatgcctgtgatttcatggtagaagacgaagccagagatatagatgagaggctatccaaggagccactaagtgaggggcttggagccacagatgattgaaaggggccaaagggaggcaaggctggccttcccctaagggtctcagtgacagatggggcacatatgacattgaaaccaagcacacgatctacaccagaaccatctcatttgcaaaggttttgagcagcaaaaccagtgttacacagaacaagatcagaaatgccacccataactacgaccttgccaagttaagtagaaataagcctaaactccccgacccactttcctccccatctccacacacaaagagaggaatgggagatgcataaagagctaaacatgcccttcgcacgcgcctcttcaggtccctgccatggggaagagagataacgtttgtttgtttgtttgtttgttttttagatgcagtttcattctttttgcccaggctggagtgcaatggcccgatcttggctcactgcaacctctgcctcctaggttcaagtgattctcctgcctcagcctcccaagtagctgggattacaggtgcccgccaccacgcccagctaattttgtatttttagtagagacggggtttcactatgttggccaggctggtcttgaactcctgacctcagatgatctgcctgcctcagcctcccaaaatgctggaattacaagcatgagccaccgcatctggccagaagagaacttttcattggatctgaaattggagatttaagtcagactgaactaagttttttaatagctgaaagtggccagaaagttaagggacctagcacccactggggtagaaagactgaacatacaactgataataatatttaagaaaaaaaacaaaactagttcatgcttgtaccccatggagttgaaacttctccccaaactaattactgtcgtttaatagacacttggtgctgagtgctttacatattttccttttagggaaaactctgagacacatgggctcaggggaaatatttgttgacttggatggaaaaggcccatcctcagcttttgttttgccctgtcctgctgtctgtctgtgttaagttcaatgcctgaggctttgccaacttgtattccctgtaagggcagaaattcagctcatgtaaacctcacagtaatccttatccccatctaacagagatggaaatggagactcaaagaggtaaagaaactcacccaaagaaccacagctaaaacatttagcagagtagggatttgaacccaggcctgtccacctgcacatcccttgcttgtttgccttattgagctgtctcgtcaatttcatcttcgccagccccaattctcagatgtcccctgggcctcctcaataccatgttgcaggccatagccccaggctgctaaatggcacgcagcctctgtgggagaagactctaattgtgcctgaccacaaggtctgcagggagttaataaattattccaagagaatatttgcactgaaggccttattgactggagtccatttcctgagttggcataattttttttctccagcaattgttataaagcaagtgcaagtcttgaaacctcaactgtagaatctcttgattatcaccaagtatatgggcttccaagcctacctaccttcaaagtcaaggtcatcacaatgggataatccctcaggcaaaaagaaagatgagttttaggggtcttctggtttccatagaaaaggcgctccaggccaggtgccatgactcacgcctatagtcgcagcactttgggaggctgagtcaggaggatggtttgaacctgggagttcgagaccagtgtgggcaatatggtgagatcccatctctgcaaataatacaaaacaaaattcgtaagcatagtggcacacacctgtaatctcagctattcaggagactgaggtgggaggataacttgagccaggaaagttgaggctgcagtgaactgagatcacgccatggcactccagcctgggcagagtgagaccctatctcaaaagaaaaagaaaaaagaaagaaagaaaaagaaaaggcactccagttccattctattctttatggaactattcataatttacagattaatgtcacttttctccctcccaccctcatctttctccctaagaaaaccacgactgatttgttgcagtattataacacccaatgagtagaaacaacccaaatgtccatcaataggggaatggttgaataaagcatgatatagccacccagcagagtactatgaaacatactaaaagaatgagaaggacctctacatccccagtatggaggagtttccagttcattcaaatgaaattagcaaggtttcagaaaagagtatgttgttttgtataaggaagtgaaagggattagaatatatatttgcttatattagcgaaataaaataataaaaggctaaaaccacaaaaaaaaagtttcctttggtggagagagaagaagaagggtaataggaatgaaaatgggacttctctaaggctgagaagaggggagaaccaagaaagaggagtgtgggagtgctttgttctgccaggtgcagtcaataggtgccttgtctgtaaagaatttaaaaaacagtaatacaatcaactattaaatgcaatttggtatctaaatcaaattttggatccaggaaaaaaggacattggtggaaaaactgatgaaatttgagtaaagtctatagttaatagcattatattaatattaatttcttttgacaaatgtaccatggtgatgtaagatgctaacattagggggaactggatgaagggtaactacaagaattatctgtgctatttttgcaacttctgcaaatctaaaattattccaaaacaacgtgatttctaaaaatatatgaatttcatacacgagtattatgacatgaacaaaaagcaattaaaggtcatccatttttattattactggcaattctaaacaatattggtgatagaactctcccactcctccaaccagggcaactaaccactctgtacctactctgaggatggcttttttatttagttattagtttggaacaatgttaatgttctgtaaagacaaatataaaacaaaatttgaaaacaaaaacagaaagagccacaatattgggcatgaataacccaaatctgagcactgtcaccacgtgctcctctcaaattcagggttttaattttttattctttattacagacaggatctccctatgttgcccagcctagccttgaactcctgagttcaaatgatcctcctgtctcggcctcccaaagtgctgagattacaggaatgaaccaccaggcctggcctcaagttcaggtttgagcagctctcaccaaaatcccactgcagtaaaattcacagtgggcttcaaattcaggtccatctgagtccagatcccaaaagctttctgacagatcttcttgagggtgacaaaacagaaataaaagatcagaatgggaacttgcagttcctcttctgtcctttatagaagtgtcaacggggatgcaaagatttcattatcaacgggactggcactgtgcccttctatcaggcgtctgctctcacagggaaatcaacttggcacagcctcaagcattgaacctaacactgagaggcagccgggcagagcagaaagaaagctgaagacaggccctttccatccaagtcaacaaatatttcctttgagtacgtgtacctcagggtttttcccaaaaagaaaaatccctcttcatataaaccccctagaaagaagtcattgctgcctcaaatgcatgtattcagctgcaaggcttctattgctacatgctttctgattatagccaccatttctaagccctgcaggtgtttgcccatcttggatcctttgaaacagctccttcccctgccccatttgcttccagatatctgcacggctcagcccctccatttatttgggcgtttgctcaaagccaccttttcagagaggccttcactcaccaccctatcaaaaccgggtcacacctcccatctctctccattctctatacctactttatctccttaatgctcactatctcttaacatttattcatgtgttgacttgtcttccctctctgaaagctccataaaagcagggtctgttgcatctccagagcctactattttttttcggtgtaaacagtaggtggctcacgcctgtaatcccagcactttgggaggccgaggtgggcagatcacgaggtcaggagattgagactatcttggctaacacggtgaaaccccatctctactaaaaaaatacaaaaaaattagccgggcatgggggcgggcgcctgtagtcccagctactcgggaggctgaggcaggagaatggtgtgaaccctggaggcggagcatgcagtgagccgagatcccgccactgcacaccagtctgggtgacagagcgagacttcgtctcaacaacaaatatatatatatatacatacattaggtgcaaaggccctggggtgcaaacgtccatgcatgctaaaggggagaaggaaggccagtgtggccagtgtggctagagatgagctaagggaggagaggagggcagggcctttgtagactacagcaagtggttttataagggtcttattctgaatgcaacaggtagctgctggatagtcataagccgtggggtccgggtggtggggaggttgacatcctctgattatatttattttaaagatcattctggtttctatatgaagaatagactgaataaggcaagaggtaaagcaggggaccgattataaaggctaccagaatagcccaagggagatgggatggtggcttggattacgggggtagtgctgaagagaggaggcttgtgggtgtttcttggtaatttgtggataaactagatgaggggcatgagagaaagaaaaatgtcaaggatgactccaagtttaaggagctgagcaagggagtggatgatagtggcatttactgagatgggggttctgcagaaaatacaccttgaaaggggaataaaaagttagttatgttttgtcccagaatcacagcaataataaattagtcttaatgcattaagttttggggtggtttaataggcagaaatcgatcactgaaacattctgtctaataagtactgtttccttgatttcaggatgcttttgatggagtaatgagcgtcaattaaatgcacacatcaaatgaaaaacacatcacgattttagaaacctacttaatatcttctttagagaaacatctattaaagtccttagcccactttttaatcagattgttagagttttttttttgctattgagttgtagaaattccttatatattttagaaattaactccttattatatagatggtctacaaataatttttcccattttgtgggttgtcttttaactcgattgtttcatttgctgtgcagacactttttcgttttacatagttctcatcatttatttttgttgttgttgtctgtgcttttggtgtcatattcacgaaatcattggcaagaccaacatcatgaagtgtttcccctatgttttcttctaggagttttacagtttcgggttttacttgtaagtctttagtccttttttagttgattttcatgtatggtgttagataaggatcctatttcattcttttgcatgtggttatccagttttcccagcatcacttattaaagagacaatcattcccctattacatattcttggcaccattgttgaagattatttgatcacatatgtgtagatttacttctggacttgctattgtattcctttggcctatatgtctgtctttatgccagtaccatattttattttataccagttttaattactgtggccttgtaatatattttgaaatcaggaagtgtgatgcttccaacactgttcttctttctcaaggttgatttggctatttgtggccttttgtggttctatacaaattttagactcattttttctatttctgtgaaaaatgcctttgggattttaatagggattgcattgaatctgcatattgctttgcatagtatggacacttgaacaatatgaagtcttccaatccatgaatttggaatgtctttccatttgtttataccttctttcatttcttttttttttttttcttttgagacaaaggctcgctctgtcaccaggctggaatacagtggtgtgatcttggctcactgcaacctccgcctcccagattcaagcgattcctctgcctcagcctcccgagtagctaggactacatgcacgcaccatgatgcctggctaattttttttattttagtacagatgggttttcaccatgttagccagaatggtctcaaactcctgacctcatgatccacccacctcagcctcccaaagtgctgggattacaggcatgagccaccatgccgggccaccttctttcgtttctttcaaggttttataatttttagtatacaagtctttcacctccttagttaagccaacaagtttatgaaaaaatgtccaataccacaaataatcagtatcactaattgcaaatcaaaaccacaatgagaaatcacctcacacctgtcagattggctagtgtcaaaaagacaaaagacaacaaatgttggtgaagatgtagaaaaattgaaacctttgcacactattattggcaatgcaaaatggtacaaccactaagaaaaacagtacggaggtttctcaaaaagttgaaaatagaactagcatatgatccagcaatcctacttctggatttatacccataaaaattaaaatcagaatgtggaagaaatattagcactaacatgttcattgcagcactgttcacaacagccaaaatggggaaaaaacctaaatgacagattaatgggtaaagaaaatgtggtatatacacgcaatggaatattattcagccttcaaaaagaagaaaatttgggatgggcacagtggctcacgcctgtaatcccagcactttgggaggccaaggcgggtggatcacctgaggtcaggagttcaagaccagcctgaccaacatggagaaatcccatctctactaaaaatacaaaattagccaggcatggtggcgcatgcctgtaatcccagctactcgggaggctgaggcaggagaattgcttgaacgcaggaggcggaggttgcggtgagcagagatcgcaccgttgccctacagcctgggcaacaagagtgaaactccatcagaacaagaggaagaaggagaaggaggaggaggaggaggaggagaagtgggggggaagggagggaggggggaggtgggagggggaggaggagcaggaggagaaaattctgcaagatgtgagaacaagaattaaatcttgaggactttatggtaagttaaatatctgtcaaacaaagacaaatatttcttatttccacttacaggggtcatgtgaaatagtcaaatgcgtagaacaaaagagtgtaatggtggttgccagggctgtggggaggagaaaatgaggagctactcatcaatgggcgtgaagtttccgtcaggcaagatgaatgcgttctagagctctgctgcacattatgtacctagagtcaacaaggtattgtgcacttaaaatttgttaagagggtacgtctcatgttaagtgttatcacaataattttttgaaaaaaaatctgtttactatatgccttgacatgaagaatataggtaccagatgacgtatctatgcactccaagctctgtgtctcacatttatttcaatcacatgtagataacagcaagaatctttagacaactcagattgcatctggcttatcacctggtttgtccctaaatttatcgtttctacagagtgagcagacatgtccctctttctctctctctccctctcagggcatatttcaataacgttctctttttgatgaagtcacacaagacgcagaagcagtcctaaaactcaatttatggaagtcagttgagaccagactttggattgaacctcccaaacctgcctaattaatgacacacattatggcccctgctcccctaactgaatgcagcctccaaaccttgacgtgttttcccaacaataaaatgcagtaaatgaatgagtgtcctgagggaccgtggcaggaataaagggaaagccatgaaagatagatgatgtctcaactaattttatgatttatcgatctccactttgctcattttgcaatgcgggagagctcatttttctgccaggcccacagtggtgtcacccttgctaatagatatgattaccatccccaaaactgtgtttgtgaaaataagaagtgtggcttctctgctgctgctgacctcagcagttttcttttattatgtgctggatccgctaagaagcaaaattgatgtacttatccggggactctgttggacgggcacaagcattttcctcatttttcttccaaacaagttcatctttaagcaagtacagattcatggtttaaattacggcattgacacatcatctgttttcagtgtgtgtattcttacaaggaggatcttttatgtgatcagagagaggaagagaggggatagaggtgtcacccacgtgccaagttgagtttaaagatatacatgttaggacacaatacaggctgctttggatggttcaccaactgcattcagcaaatattgattgggcacaggtattgtgctaagcatgccgggggtattcagtcatttaataaatatttattggcaggccaggcacagtggctcacacctgtaatcccagcactttgggaggccaaggctggcagatcacgtggtcaggagatcaagaccaacctggctaacacggggaaaccccatttctactaaaaatacaaaaagtagccaggcatacaaaaataaaaaaaggtgcacgtgcctatagtcccagctacttgggaggctgaagcaggagaatcacttgaactcaggaggcagaggttgcagtgagccgagatcgcgtcactgggcgacagagcaagactccgtctcaaaaatacatacatacatacacacatacatgcatatttattggtgatttcatatatatagctggaattatagagcaaaataggcaatgtctcttttatcatagaaactatgtcctgattagaaaagatggaaagttcaaaataataattatgaagtgcataaaatagggtgtgttagtcaactatgccacagcagtgctgggtagcatacagccagtaactccacaacagcaagcatgtgtacctcatttatgcaactatggtttgtcctgggtttggctgatctaggctgggcttggctccaggccacatgtttagttcatgtctgttccttgcatctctcactcttctgggaccaacaggttacccagggcatgttaccctcatggccatggaagaactaaagtaggtgagcccaaccactctatcacatttcaaatctctgttcacttctacccactaatatcctgttggccaaaacgagtcatatggccaagcccaaaatcatgtggtagggaagtaaataccatccacaattggagcggggaggccatcaacacttgctgggcaataatccaaactgttatgcagaatgatgtgataaaagggatcagagagaagtgctgtgaggaatggggatgagttcactgggatgatgtcagagaggcaggcgagggccagatcttgctgagctacggaaagaaatggcacatttgatttgtgatttcaaataatccctttcactgctatgggaaaactggattgtaagtggcacgagagcagatgcagggagtcccagcaggtcggacactggttcagtgttctaggtgggtggtgatagaaggtgtgcacttgaatagtggcaatggagatgaaggcaagcgctagactgagaaacagaagcaaatggacagggtaccaaagtggataacatgtggtccctgaccttaaagagctaataacctacttgatgagaaaaagatgtacagacacagccatggtttggagagatatgtttttaaaataaggccatacacaaaatactaaaaaaaaaaaaaaaaatccaaaaaagagctgtgaactttgtctgagagtatctggataatttcagggaggaggtgatatttgaggtggacttccaatgtgtcatgtcaaatagcaccaagctgataagcaagaaccatcttaatcagattgactgggtgccacaaagccacacctatgatggacacacaggaaagtctagcagccaagcagagggaggatgactttccacaaagacaagtatttgtgctgtaagactacatgctttgacccatctgcaaaatgggtgcatctgcaagaaggaggccaccaggcaataggctgggggccaggtaggtacttcttgagtagtgtcacacactattcaaggagatctgtgactcagtatacccaagagaacctccaatttgccgccattctgccaaagggatgctagaggtttgaggaaagcagtctggcaaagataaatcctcagaattgaaagacctaaaagcacagaaccatccgtgtccccaactaactcggtgatttctttgctcttcagtttccacaaaaataaaatattatttatataacatatgcagatatatgcaccaagatacaaggcatgccatagactctcaaatatttgttgaacagataaaggaacatttaacacaacatttttataattgtaaaaactttgagactacccaaaggcctttagtaggccaataattaaataaacactggtatattcatatcttggactattacgtagctatgcaaaattttctcattagaaaaattcattattaatatgtgggaaaaacgtggaaaacacggaaagatgcaagaataaaataaaacacatcccctagagataacctctattaatattttgtagtctctgcttccatcctgtgtggtacttttgtagtgcatgggcattgtgtacctatgtgtttttagctaacataaatgaaattatattaaacatatgaattcaaattctgcttttttccctttaatattgttttatggtgttttgtttgttttgagacagagtcttgctctgtcaccaggctggagtgcagtggtgtgatctcagctcactgcagcccctgcctcatgagttcaagcaattcccctgcctcagcctcccaagtagctagaattacaggcaagtgccaccatgcccggctaattttttcttttagtagagacagggtttcaccatgttggccaagatggtctcgatctcctgacctcaggtgatccacccgactcggcctcccaaagtgctaggatcacaggcatgagccaccgtgcctggcctacagtgtttttctatataaatttttacaaagaggtttagcaatgtaaaaaaattgcattgattttataagaatggaaacatggaatacaaaatcatgtatctggcatgagtttaagtacgtaagtatttcgtatagacagacatgtgtgttttgtatacgtctgtatgaatgaccgtaagaaaatatacccaaggttagtaatgattgtcttggggttgtgggattattatgggctgtcatttcatcacttatatttttctgcatcttctttataacataaaataagcatgtattactactgcaataagtaaaaagagaaatgttttttgaacaggagcaatgaatttgaaagaatccaaggacgagtgtattaaccaactgtgatatctacgactgtggtttcacaaattaggggcatacttgcagcgccaggctcacctcgacctcctagagttatgcctcctcctcaggccaggccttagaggtcatgagacaggctgaggaaagagaggtccaggccagcatccatggaatctgtcccattagctcagagacaacaaaaaggggacagatccagagggtggggggactggcaatgcaggacacaggaaaagctagactaaaagatcccgggcaccgggagatcaaagggccaaagcgagcagcagccagccctcagaccaaagactccccaacacgccccacacagcaggaattcaagaaattccaaagcctaactctgaggatgtgctcaaaccctcacattattgaccatgatggcaagaaaagtcttcagtatcattttcgttatagaagttagcggagaagcaggcagtggaaacccaccatggtgatcagacagggccctttgtttgcatgagcttaattattgacttagaaaacttgagcatcctcctttgccagagaaagaagcacctttttttttttttttgaaatggagtctccctctattgcccaggctggagtacagtggcatgatctctgctcacggcaacctctgcctccggggttcaagcaattctcctgcctcagcctcacaagtagctgagaatgcaaccatgcaccaccacgccgggctaatttttttgtaattttagtacagacaggatttcaccatgttggccaggctggtctcaaactcctgacctcaagtgatctgcctgcctcggcctcccaaagtgctgggattacaggcatgagccaccaagcccgggcagaaagaccaattctttcaccatggcattcaaggcttccctgggtctgtctccatcaaccaacctacctacacacacacacacacacacacacacacacacacacacacaactattgtccatacctgccaagactttgttcatcctgtttcctctgcctggaaggcctttctctcatttccacgtatctaaattctttacaactccaaagtcctcttcttaaaaagcctttggaaaaaactattgagtgaataaagcaagggtctgctccagtcctgtctgagtgaatcagacaggtctgctccagtccaggcccctctccttactggctgtgtgacgttggacacgttcaatcgtccttctgataccaattttctaattagtaaaattagcttctaattgaagctgcctccaaggctttctgtaagaattaaaggagaaaattatttcagatatctatttaaaagtagccgaatttatgtcaataaatggcaacaaatataaattttatatcctctttcctagtatcagttccccacttcattttctaggtggcattttgcctacgggttcaccatcttctgtccaagtttacttttatgcctcctggagtcaaaggcaactgccgcctctgagtttagacacaattgggttgcatcttagctctggtaccttctagctgtgtgtttttgaacaaatcatcacacctctcagagcctcagcttccccatgtgaaaaatgggtttaatgtttcacgttggggagttgagtgagtcaatgtacattaagctcttggaacggggcctggcacacagccctagaagggttcgttgttactgcctcacagggttatggtaaagatggggtgggtttctgtttgtctgcaaagcccttatccaaagtcccaacacgtagcaagccctctgtaaatatcagtcgtataatcaggaatttagtaaacaagtccaatgcccctcactccacccccgcagcaatgtaatagatgtcagtcaatcccttttttgggtcttttcagaacaaaaacccctgttctctcctccagtggggtctccctgggctaactgaaccatcctcctggtcttaaacaggaggattcctggagccaagtgggatccttctcctgcaccacgagggcccaggggccaggtaacatactgtctggctaatctggagccaagcagaaactggcacagaggacatccacaggcttactgcatttccttcccctgtaaaagaaccctacggtccagcccagcaagcacctctctttgaccagctaataaggttataaaaaaacttatgtatctgactttaataatggtattaaacccagtaatctgactttaatagtggtatgccaaggcaaacatggtcctagcagggaccaggagcgagggcaggtgagggtacacatctgaggctgagcgacacctcctatatgaagttgattcatgttggagcaaatccgggcagggaccagctgattcaggcagttaagttattgctctgccagtttaatatttcgccatctgctaactgaaggctctactgcctgctgggtcctataaagacttttatttattatactacacatggcaacatctgccaccaggatgaggctctactcggcgccctaattaaacaaacacacacttcagtgacagcagagggccgggtctcgctgtgagccgaactgttgctgggagttaaaaacttggagtgtcccatcctgaagagcctttgctgagaaaaggtagcatgagtcattcacctcctggtggccactaaagatttacaggtgatttaaagcaggctggaaaaaaaaaattaaaaggctgggtgtttatctcccctaacctgcctctcactcccaaacagaacttgagtttcagggcttggtttggccaacggtcagaattcctgcttcacactgtcacatgagcccctgcccttcaatctccgtgcacactctcagaaacaagccctgcagatgaagaaaatgaatgtcaaagtttccattcaatttttcattcatgcatgcattaaaaaaatatggagtcattctactataaagacacacgcccacgtaagtttattgcggcactggtcacaacagtaaagacttggaaccaacccaaatgcccatcagtgatagactggataaagaaatgtgacacatatacactatggaatactatgcagctataaaaatggaggaattcatgtcctttgcagggacatggatgaagctggaaaccatcattctcaacaaactaacacaagaacagaagaccaaataccacatgttctcactcacaagtgggaactgaacaatgagaacacatggacacagggaggggaacatcacacaccagggcctgttggtggggtggggggctggggagggagagcattaggagaaatacttactgtagttgataggtgcagcaaaccaccatggcacgtatatacctacgtaacaaacctgcacgttctgcacacgtaccccagaacttaaagtataattaataaatgaataaagaaggagtatgtgctacataacccgtactctagcaggtgagctggtaaataagatagacatttgtgtcttcataaaagccccatttgactaagtcaagaggacacataaatggataagataattgcagatcgtgctgagtgttaggcagcaaataaagagggcgatatatatattagatactgggctggcatacaggtatattagtttcttattgttgctggaacaagttaccacaaatttagtggcttaaaacaatacaaacgtattatcttacagttctgtacttcagaagtccaacatgggctaaaattactgagctaaaatcaaggcactgggcaaagatcaagatgtcagcagggctgctccttctggaagctctagagaacatccattttcttgctttttccagcttctaaaggctgcctgctttctttggcttgtggccccttcctccatcttcaagggcagtaacatacctgtttccgtcatcacactcctacctttgactcttcgattctgcctctctcttccacttttaaagatctttatgattcctttgggtccaaccagatattccaggaatagctccctaaggtcagctgattagtaaacttaatttcgcctgctgccttaattgccctttgccatgtcacttaacatactcttgggttccagggatgaggatgaatttcaaagttcccattcaatttttcattcatatatgcattcaataaatattgagtatgtgctacataatccatactgtagcaggtgagctggtaaataagacagatgtttctgtcttcataaaaaccacatctttgcggggtgtcattattctgctgaacacagtggacaagaaactactttagatagcgtggtcctcaggagggcttctctgaaatgtgatcatgagaaagggttgcaagcagaaggaaaaggaagtatgaagatccagaggcaggagagaatttagaatggctttggtactgaagggaaactagtcatgggcttaggagtcagagagtcatgggcaagggaaaagtggccccagatgaagctgaaggggtgaaaaagggaggaatcagatcacctagagtcttgtgtgccttgcagaggcagcttggtgcaatgatcaaaagcccagacattggaagggaacttactttcacttaacacctaatttttaccagaccctgtgccaggacctttaaatagattatctcatttagttcctggaacaagtacatgaaatatgcattgcaattcccattttgcagatgagaaagtagtgacttaaacaactaaattataaagacacactgatgtgaattctgaaatatctggctcagagcccttgctttctccaccactcaaggctcctgtccaaatgattttgccttccgtgcatgtgtgattatgcagccaggatcctctatcttcttttttctcatttaacttgatagacagactgcagaacctcaaaatcacctgcagtggagtgtcccactgaatttgtgttttgcttaccgctttatcaagaggtacatgaaattcctcttgcctgctctaaagaggttggatcatcagtgagactgaacctataagctctccagtcccactagggaggatgcatgttatttaggacaccagctgagttgctggtacaagagatccaaaaacacagtgactcaggccaagtaggaatctacttctctttcacagattggtccagaggtacatagtctagggctgccatagtttctttgccccttgcaatcagtcatctagggatctggttccttgcattttaatgttcttctttcctctgaagtattgtcctcatccacatggttgaagtagacttgccagaactccgtcaaattccaacgtgtagaaagaggaaatagagaatgaaaggcaagtattttcctttccagtgctgtgacttgaagctgcacgcatccgttctgctcacaccctggaggcagtaatttagttgcgtgtccacacacagttgcaagagaagctaagaaaggtagtctctacctagatggtcacatacagagtgaaagcttgagaagttctactgctaacaaaatgaaagagaaaataaatactggagaaaaattagcactctgccacaaaggatgactgcccttttggtttatctaaagtccaggcattctttgcctgctggatatggtttgtagaatttttagaacgaataaatctctattgttcagaaaagagaaccaaattaatttcttttctctctcaggggctgaaagtaaaaatggcctgatcctgggtaggtctcattcacctgctgtcattggaaaaggcattggagttgtggggaccacggtgagtggataaacaaacctcatccagaacaggacctctaagaggggttaccgtgagagttaccagcctgcactacattgtagcccagcagcactggctccgtgttcaacagtgccatcttctctcagtaggaaacccaaacaggctgacaaataccagcgcttttccctaattgggagtacaagttgtgaggactcctaattatacaagaaccctggaactggagcagaaagtctcaataaggtaattcaggacttctggccaacctggaagctggtaactcaagtactcttgattaaatttggggaaaaataatttaaattcatgatagtacttgctcttgaggtattagtagaaatgctatttctgtcaataaacaaaagagtttttttaaaaataaaaaaaatcccctgaatatatcctcaaacgtgatgccaaagcaaagattgataaaatgccaaagatctggctaaaaaagatgcaaagaattcatggaagagccaatgtgacccactaaaaccactctaagtgcaatttttgaataaaatcccacttaaatgattgtttacctgaggtcaacggaggaccagggcagtcccaatgagtaagggacttaacatgggccacgggggtacatattgatgacaggaatcgcctgacaatcactaagctgatggcctgttctccatatgttcctcatctctccacctaaatttaatgtatccaactttttggaatccttcctcttagtcttgcattctgtacgtatatgaggaaggtaaggaactaggggttgcctaggagggatggagaaggataaatgcaaaaataacactgaagcgatggccttgcagccagatgacattttaggtagatccgcacaaatgcctacaaatgaaactccagggcctcaaatgcttcatctgtgaaatgggatgattacttgaatcaccgatataaattatgtgttctaggaacaaacggtggctcacgcctgtaatcccagcactttgggaggccaaggcagacggatcacctgaggtcaggggtttgagaccagcctggccaacatagtgaaaccccatctctactgaaaatacaaaaaaagttagccaggtgtggtggcaggcacctgtaatcccagctacttgggagggaggttgaggcaggagaatcacttgaacctgggaggcggaggttgcagtgacgtgagatcacaccactgcactccagcctgggtgacagagtgagactctgtctcaaaaaacaaacaaataaacaggagcaaaagcctaagctcagctttgtggctcaagaatagtgtccctgaggaggcagcatttgaggagggtgtagaaggaggggagggattttgatgggcagagacggtgtagaagtgtaggagaattgtgggaagtagattgtgtggaaggcctcccccagcttttatctcctcaacagtgaagtgggttacaagattattttgcaagttagaaataatgtttgtggaacacacaggacagtgtgtgacattaaaaaaataaatcaagtgattatgattaaattaacaactagtcactgactgtgacaaggttggggaatctgagactcctatgtaaggctagttattttgaaggaagacaatgctggtggtgtcttaggctcctaatggaggcaaatgaaaattctctctgtgtgaaagcattttctacttgggtcataagaatttccatagattaagatcaagcctctgtaagcttataatcaaaggccaccaaactcattaggaaataagccaccatgagggagaatcagcagaattaataaacaacaaatttttactcccacaaacttcagatactggaaccattgaaataatcagatacataatataaaatcattctgattaaaatatttaaatgaataaaagatggaattagaaaaatgggaaaataatcaacgtttataaaaaaattatgaggtatagttgaaaaatgatcaaataaaaattttggaaatcaaatatataactgttgaagtaaaaaactcaattcaactagccgggcctggggacgcaggcctataatcccagctactgaggaggctgaggcacaagaatcgcttgaacccaggaggtggaggttgcagtgagccaggatcatgccactgcactctagcttgggtgacagagtgagaatctgtctcaaaaatatatatataacaaaaaaatgaaaaatataataaaaactcaattcagattaaaaatagcaggaaagagaattagaacttgaagatatgtctaaagaaattatctagggtgcaacaacacaaatagattaggtgattaaaactattaaagagaagttaggagatacagaggacagaaagaaacagactaatgtatgtctaatatattagacatactattgggagagaatagagagactggataagaggcaatattaaaagtgataatagatagaaattttgcaaaggctgggcagggtggctcatgcctgtaatcccagcactttgggaggcagaagtgggtggatcacctgaggtcagaagtttgagaccagcctggccaacatggtgaaaccctgtctctaccaaaaatacaaaaattagcccgccacggtggcacatgcctgtagacccagctactcaggaggctgaggcaggagaatcgcttgaacccaggaggaggaggttgcagtgagccaagactgtgccattgcactccagcctggacgacagagtaagactctgtccgagagagaaaggagaggaggggaggggatggaaggggaggggaaaagaaatgttgtaaaaatggtaaaatacagtcacgtaccacataacattttggtcaacagactgcatacatcagtggctccacaaaattgtaatactgtatttttattggaccttttctatgtttagatatgtttaggcagacaaaggtttaccattgtgttccaactgcctatagtattcagtagagtaacatgctgtacagtcatgtagcctaggagccataggctataccatatagcctaggtgtgtaggaggctacactatctaggtttgtataaggacactatgatatgcacacaatgatgaaatcacctaatgactcatttctcagaacatatcccgattgttaagtgaggcatgatgagatagacagatagatagatcatcatatacactaacacacacataaaatcttcaggtccaagcacagcatatataagcaagatgaatgcaaagaaattcatagctagacatattgcagtgaaaccacagaacatcaaagacagagaagacttaaaagctcacaggggaaaggggcagataaccttcaaaaacactacatttagatcaccacctgagttttcaggcaaagcaatagaagccaaaagactctggaataacatctccaaaattctaaaagaaaacaaccatcattctagaattgcgcttcaggcaaatgtgtcttttaagaatgagtgtgaaatgatgacacttccatataaacaaaaactgagagatttttaccactgataaattcccactaaaagaatactaaaaaaaaaaaaaaaatagcccagaaaaaaaaatttcgagtgtaagaatagttagcaagtaagcttacaaactgagagataaatctaaaacattatctgtgtaaaatattaatagtaacaatctgatttgtgagaatttaagatgagattgaaactactgacaacattgacatttaagtaatggggaagtcattgacattaaagtatcataaagtccttatagtatttggaaggggaagttaagatatttatgggctttcaattttccttgatacacacaataaaatttcaagggagagatgatagaaaagaggttttaaatttttggaattttagaatttttagaatcttaatatttgaatttggaattttagaattccaacaagtaaagggaaaagcagagtttgaaaacaaaacaaaaacaaacaaaaaacctcaatttaaagaaaagaaagaaaagaagcatgaagaaaaatggaataaatcttagaaaccatatagtgtgaacaaagcaagtcttaaaatattatttaaggccaggcacagtgactcgcacctataatcccagcactttgggtggccaaggcaggcagatcacaaggtcaggagttcgagaccagcctgaccaacatggtgaaacctcgtctctactaaaaatacaaaaatcagccaggcatggtggcacatgcctataatcccagctactcaggaggctgaggcaggagaatcacttggacctgggaggtggaggttgcagtgagccaagatcgtgccactgcactccagcctgggcaacagaacaagactctgtctcaaaaaaaaaaaaattatttaaggtatgagaccatctttataaagctcaaaagcaagcaaaactgataaagctttgtggtaaagctaacaaagcaaagaaaggggatgataaacacaaaacaggattgtagatttccacatggggataggatgggggatgcaagaggcacttttcatccagatggatccagtagaactgttcattttagtcaatcagttaggcacttaatgtagtttggatatttgatcctcccaacatcgtgttgaaatctctccccatgttggaggtgggacctattgggaggtgtttggggcaggggagttgattgctcatgaatgacttgctgccattctcaaagaagtgagttctcattttgggctgggtgcagtggatcatgcctgtaatcccagcactttggcaggcagaggcgggaggatcacatgagaccaggagttccagaccagcctggccaacatgaagaacctctgcctccactaaaaatacaaaaattagcagggcgtggtggtaggcgcctatagtcccagctactcaggagactgaggcacaagaatcacttgaacctgcgaggtggagactgcagtgagccaagatcatgccactgccctccagcctgggcaacaaagggatatcctgtctcaaaaaaaaaaaagttctcattcttagtcccaggagaactagttgctgaaaagagcctggcatctcctcctctctctctcgcttcctctctcaccacgtcatctgtgcacacagtccctccacttccccttctgccctaagtggaaacagcttgaggccccaccagaagcagatgcagtgtcaggcttcttgtacagactgcagaaccatacaccaaataaaccgctttttaaaataaagtgcccagtctcaagtattcctttatagcacacaaatggactaagacagcaatgattttatgggtcttcattttgttgatatgtttgataacttacatgttatatatatattatttgtgtgtttcaaatattgcattaaaaatatttaaaaataggccaggcatggtggctcacgcctgtaatcacagtactttgggaggccgaggcaggtagatggcatgaggtcaggagttcaagaccaggctggccaacatggcgaaactccgtctttactaaaaatacaaaaaaaaaaaaaaaaaaaaattagccaggtgtgatggccagtgcccgtaatcccagctcctcaggaggctgaggcaggagaatggcctgaacccaggcagcagaggttgcagtgagccgagatcacgccagggcactccagcctgggcaacagagtgagactctgcctcagaaaaaaattaaaaataaaattaaatgcagaaaacaataggagggtaagtttcccgaggacaagagcaaaaccagagcttttctgtatcccatctactgtacacacagtgggccctcaacaaatatctgcttacattacagccagggaatttgtttactttagtgcattacaaaagaatgagaaaagccgagtcttctcaaaagcaaacgtcaacgcggcagacagaggactaaattacatgataacacagcatataatatagtataatgggcatgatacaggtaataataacagaaaaacaaatctgtttttcagccatgaattacactgtgtctgtggctttgggcaagaagcatgcctgtagttaccctgggctgcaagttgttaaatcatgatggatgatcccataaggaaccaaacaagatcagtggaattcattgatttgccgggtgccctgggaattctttcatttccccccagacctgactgcctcctcctattactggggcagcagttgggctataccacacagactagccatgaagcgggagagaggcccagaaatacaaagccagcattccaggtctagccacaaagattataaaataagcagctctctacatccaatccaaagcaacgagaaggtggttgggtggaggctggaaggacacactcaagaattaaaacttagatctgcaactgctggttttgtgtccgagagtggattattttgcctgcatacagctcagtttttgcattaggaaaataggaatcataatgtctaattcaaggattatttggaagacatctgcttgcaccagatctagcacatagtgggtgctctgcaaatgtctcctttcctcagtaagtttccacacatcttcacctctgaccttcaacttgtaaataaagcagagattgcaatgctgcgtgacagaggagaaaaatgctatctaaaactactactgactgcagctgcttctgtccctaagggagacacattatttctctccagactaaatatattttcttttgcaaaatactttgataggcagctttggttatgaaatgtgaggccccccagggcacagtttagaagaagacagtgaaacaaagaagtagtgaaatagctctgcgttgtaaaaatgaacagagatgccagggtttggcggtatgctaggaagcgcagtgataagagaaagcacattgcaacagcaatccctgttgctgttcttcacctgacagcccgtcctctcctcttccactactttatagctgtcattagaaattaatctggccgagcactgtggctctcacctgtagtcccagcactttgggaggccaaggcgggcagatgacaaggtcaagagatcaagaccatcctggccaacatgatgaaaccttgtctctactaaaaatagaaaaattagctgggtgtagtggtgtgtgcacctgtagtcccagctactcaggaggctgaggcaggagaatcgcttgaacccaagaggcagaggtcgcagtgagccgagattgcgctactgcactccagtctagcgacagagcgagactccgtctcaaaaaaaaaaaaaaagaaataaattatcttcaatctgaggaaaccaatttagaaaaagaaaaataaacaaaataaagaaattatcagcatcttacttactatatagtctacttattcactgtatgtctcttccctcaagaaaggaagtttcctaagggcagcatttatgtgtattttattcattgtcgtttctccagagcccagaagagtgcttggaaaataagaggtattcattatgtttttcttcaataaatgactaagaggggagttttaaagcaaaacttctactgccaaactgcagctcaatgagaatacaaaactattgttttaagtgtgagtttaggggttgtttgttatatggcattattgtagcaacagctgactaatacagatagcaatattggttgcattcagatatgatttaaatcacatcaaagttgcaagactgaggtttggggctcagattctcctgaatttaatcctgtcccattatatcagagcctctcttttctcctctgtagggaataaaccctccttctggagtgatgaaatgataaccttcttcacaggtcactgtgagaattaaaacaccacttttttcataaaaagcactcaataaatatcagtcattaccatctatctactcaaacaattctgatgtttaatgggttcacttattctccaggtaaagtcagtcctgctaaaaaatgaacataagattttgatcctgtacagtgcttgaagttaaaggtatgtaatatgaaataatattttttgaataaattagcaaagtcaaattaattataacacttaaagcttatgaagcaaaatggttatttgcactcattaaaaataggtataacttccttgtttttttgagatgtaatatgaccatattttattaagaaccataaaaaatctttagatattttgatcaatgtctaccttctagaatttatgttaaggaaattattgtaaatttttaaaaaaatattttgtgaatgcacatctttattgaagcatatttggttgcatactactttgaattcagaaatagaaagtcaacagaaaatgccattctcatgcaaataatcaaaacaaattagatgagctacaaagctatttggaaaaaaaaaaaccttcagtgaactaaggacagagaaaaatccaaatgaactaaattccacaaagtgaagatcattttagaggagaggagagatttactacaggtcttatcaaaagcatgctcttttggatgtaaatattttttactttagtctctactgttcttttatacagaattttcagtatacaatcaaacattagaagacatattaatatttttttaaagaacaacaaaaaagtggcctatagttaagagtagaaacaatcaagaaaaacagatccacagatgactcagatgttggaattattagacagggaatttaaaataactataataaaaatgccaaaagcctaacgaaaaatatagataacatgcatgaagaaatggaaaatttcctaaagacacgttcaccaggaaacattagaagaaaatcaaatgggataagtagcaatgaaaaatacagtattagaaatcaataacatcagatgtacttaacagcacactggaaaaaaaacagatgaaagcatcagggactaaaggcagatcaatagaaagtatccaaactgaaacacaaaaggcaaaaatagtggaaaaaatacaacagaatattcaagatctgttggacagtataaatgaatctaacatgatatcaagtgatgtaacagaagttccagaaagagaagagaaaaactggatcgataatatatttgatataataaccatctgagaacattccaaaatggatgaaagacataaacctgtagagccaagaagctcagtgaaccctaagcaagataaatataaagaaaaccttacctagctatgtaacaaccaaaaatcacataaaacaataaacagcaaatctaaaaagcaataggaataaaatgacacattaaatacattagaaaaaaatttatgatggctaacttttcatcagaatctagaataaaagccagaaaacaattaaatgacatcattgagtacgacaagaaaaaagaaatggaagcagagaattctatgtctagcaaaaaatatccttcaaaatgaagatgaaataaagatatccttagagagacaaaatctgagatacttgctgatacttcaggctgagggaaattatatcagatggaaccccagatgtgcagaaaggaattaaaaacaccagaaaaggtaaatatttgtataaatggaaaagaccttttttgacttttatttttacatttataatttctcaaatatttaagtgactatttacagtgtagactggaaataataacgtatgataggattaataccatatgtgtcactgtaacacagaatataacaagagcacaaaaggcaggattggacataagtggaattatactgcagcatgatttttatactgtgaattaggttaaacattgtttgaaggtatactgtgaacatttacatgtagtttctatagtaaccactaaattttttaaaaaggaaatataatctaactatccacagaggatataaaagtaatattaagaatacttaattttcccctgaaaagacaaaaatgaacaaaggaataaagaataaataccataaatataaaacaaataccaagatgggagacataagttgaatcatatcaataattaccttaaatgtaaatggactaactcctctaataaaaagtcagagcttagtaaattggatatgaaaggcaacacccaactataggttgtttttgagaaacacaattttattataaagatacaggccaatagaaagtaaaaggatagaaaaagatatagtatgaaaacaccaaaaataagaaatctggtatgactatgttaatatcagacaatgtagcatttaaacaaagagtatgactggatattaagaagaatacctcaaaataataaaaaaaggataattgagaagaaaacaatcatgaatatagacgtacctaacaacacatttccaaaactcacaaaggaaaaactgacagaactgaaaggagaaataaaaaaaaattcacaatcatagttggagaatgtaaaccctcttggtgcaggttgaacatcccttatccagaatgcttgagaccagaaggattttggatttttccggactttggaatatttgcattatacttactggttgagcattcctaatatgaaactccaaatccaatgagcatttactctgagcactcaaaaagttttagattttggagcattccagatttcagattttcaaattagggatgctcaacttataactgatagaacaagcagatcaaagattcagtaaacactatttgaacaactctgtaaaccaaactgacataatattttaaactactacatccaacagctgcagaaaactcattcttttaaagttgtcatggaacattcagcaaaatagaccatattctggatcatataaaagtattaatgaatatcaaagaatgaaatcatacagagtaacacgatagaataaaatcattcacagtaagatatctagcaaatcccctaagtattgggcaataaaacaaccctctcctaaataacccatagatcaaaaaagaaatcataaaggaaactgtaaaatattttgaactgaataatatgaaaatatatcaaaatttgtgaaataaagctaacgcagtgcttagaagaaaatttatgactttaaatacttacactggagaagaaaggtatatacaaccttccatcttaagaagctagaaaaagaagaagagggtaaacctaaagcaagtaaaagaaaggaaatactaatagtaaagtggcaatacaaagtcttaacaacaatggacaaaaaaaagagggaaagcacaaattgcccacataaataaaaatgaaacatcactacatattctaaaaaatgttaaaagggataaatattaaaacattctaacaattcaacaacttatattaattaatccaaatcacaaattactaacaactgaagacacagaaaataaataaccccatagctattaaagaaattaaatttgtaaaacctttctaaaaagaaaattttccacatatatggttcattagtaaattctacaaaacatgtaagggagaaatatcaatattgcacaaattcggaacatagaggaagaggtatcacttcccaatttaatatagaaggccagcatcaccctgaccccaaaatataacaaagctattacaagtaaaaaaataacagcctaatccctcatgaacataggcaaaaatttcttttttttttttttttttttttttgagacagaatttcactcttgttgcccaggtgggagcacagtggcacaatctcggctcactgtaacctctgccttccggtttcaagcgactctcctcactcagcctcccaagtagctgggattacaggcgcccaccaacacgcccagctaaattttgtatttttagtataaacggggtttcaccatgttggtcaggttggtctcaaactcctgacctcatgatctgccctctttggcctcccaaagtgctgggattacaggtgtgagccaccgcgcccagcccataggcacaaaaattctaaaccaaatatttgcaaacagaatccagctctctctctatatatatgtatacatatctatatatatatctatagatacatgtatatctatagatgtatatatatagatatatatagatacatatatctatagatacatttatatgtatctatagatatatatgcatacatacatataaagaataatacatcatgaccaagcaaggtttattccaagaaagcaaggttggtttaatgaaaatcaatcaatataattcatcatactataacagagtaagagggaaaaccatttgatcatttcaaaatacacagaaaaaaaatttgacagaaatcattatttctttatgataaaaacactcagtgaaactaggaatagatgggaacatctccaatatgataaggttcatctttaaaaacctacagttaatatcataattaataaaatattaaatctttttctcctaaaatctggaacaacaaaaggatgcccactctcatatgctgtgttcagtatttactgaagtttttagccagaacataaggcaaataaaagaaagaaaaggcacaaagttagaaaagaagtaaactgtcattatttacaaaaacataatttgtctaaaacctggaagcaaaactaatatccaaaaatagatcctttgactacatttcagggaatccatttaacagactattctgtagtcatttagaatgagattctattaacagtgctaataaaatggaaagtgtttgctaaaaccagctgtaaaaaacattttaggggaatggtggggaaacatggactggttattagacaattttaaagagttatttttctctttgttagaagtgatggtgctatgtggttatgtgaaattttgcattttaagaaacacattcttaatcatttagaccaaaggttttcaacctcagcactaccggcatttagaaccagataattctttgttttggagggggcagtcctgtgcattgtagtatgtttagtaacatccctgatctctaccagggatgcaggcatgctttcttttgtgacaaccaacattgtctccagacagtgccaaaagtcctcttgcggaggacaagggtcaaaatcaccctcagttgagagccactgatttagggtttaatatcatgatgtctgtactttcttttgaaccacttaagaaaaaaaatgcacaaagaaaatataatattagtgttaattctaagcgataaatacatgggtgtgtattatgctatctttttttattctaccttttacttaggtattttgtttacatacttgttatatatataattttttttagatggagtcttgctctgttgcccaggctggagtgcagtggcatgatcttggctcactgcaacctctacctcccaggttcaagtgattcccctgcctcagcctcttgagtagatgggattacaggcacccaccaccaaacccagctaattttttttatttttagtagagatagcgtttcaccatgttgaccaggctggtctcgaacccctgacttcaagtgatctgcctgcctcagcctcccaaagtgctgggattaaaggcatgaggcaccacacccagccgacatacttgttatatatatactttttattttattttattatactatctacttttctgtttgaaagtttcataataaaagtcaaaataattataatatgctataaatggaaaatgcaatacaattgtatggcactacgattaaaagtatacctaatgctaaatgacgagttaatgggtgcagcacaccaacatggcacatgtatacatacgtaactaacctgcacgttgtgcacgtgtaccctaaaacttaaagtataataataaaaaaaatgaaaaaaatatgcaaaattacatatacaaaaactactcaaaggagtatgttcaagaggagtaagtcttttcagcagtgtgccccagccactccagcgacagtggggatcaatgtaggttggctgtgccacagccacctgaattcactatgatcattaatcctctcctcccatcttttgtgctttaccagctgtataatgaatcctaggataaagtagaaacaaggaggaatcaaagagaatgtaaagaacagtttctccccaagaagaactctgaagatgattcatccttccaagccagatctcttgtcggaaaaaaaaaaaaaaaaagtgactggcccaaagcatatccaagaggaagcattggaatgaccagttgacagccaggacttcccactctagagttgtcattgtcccagaatagagtgacaattaaaatcttggaggagtcacccaagaagcatttgatcttaggattaaatgaaatttatcccctcaatattggagagaagtagcagaacaaaggaacaccctctatgaaacacttaaggaaaatgagaagcttcacagagaaattgaagaaagaacaatgaaattgaccacttggaaaaggagagtaaacaactggcaaaagcggcagagtacagtatatgacagaggcaacccagagactgaatgatgaacctctggataactctgaagcaccagatagtcaggaatttgattctgaagagaaaactggtgaagattctcaagtggaaaacccaaaaattggcacatgcactgagaatcctgtcttcctctacagatgcaaaaccttgcatgtaaaatttaggattcacaattgtcgagatatgaaaccaacctaagtgcccatcgaccaatgagtggataaagaaaatgtgtggtacatatacaccatggaatactactcagccatgaaaaaataatgatataataatgtcattgcagcaacttggatggagctggaggccattattctaagtgaaataactcaggaatggaaaaccaaataccatatatgctcacttataagtgggaactaagccataggtacataaaggcatacagagtgatataatggacactggagactcagaagaggagaggatgaaaagggaatgaaggatacaaaaactacatattgggtacagtgtacactactcaggtgacaggtactaaaatcttagactttaccactatataatttataattcatccatgtaaccaaaaaccacttgaaccccaaaagctattgaaatatatgtatatgtaaacacacacacacacatatgtaagtcttacatgttaaacctattaatatttgactcttgagaaatataccatccagtgggttcacctggccccctgcctagacagagccaatttagcaagatgggggaactgcagtggaaaaacagtaattcacacggagccacgtgtgcgggagacctgagttttattattattcaaatcagccttcctggagcatttggggatcagagtttttagagataatttggtgggtagcggctcaggaagtggtgctgattggtcaggttggagatggtatcatagggggtcgaagtgaggttttcttgtggtcttctgttcctgggtgggatggcagaactgggagccaagttaccagtctgggtggtgtcagctgatccactgagtgcagggtttgcaaaatatctcaagcactgatcttaagttttacaataatgacgctatccctaggagcaatctggggaggttcagactcttggagtcaggggctgcatgacccctaaaccataatttccaatcttgtagccaatttgttagtcctacaaaggcagactggtcaccaggcaagaaggaggtcttttcaggaaagggctattaacaattttgtttcagagtcaaactgtaaactaaattccttcccaaggttattttggcctatgcccaggaatgaatagggatagctttaagattagatgcaaggtgtagttggttaggtctgatctctttcactgtcataatttcctcagttataatttctgcaaaggcagtttcaagtttacctccagtatagttctttaaagcagaacacataactacataatgcaacctctgagatcaaaattctttgtttgaatcctgggaccctattgtattaaaatacaaacactgtatatttttaatttatgatgttttatgtgaacagcattttctcaattgtcagacatgacttgtgtaaatgactaaagaaacttcaatctcctattgaaaaaaaaaagaaatatattcaaggggttgtggatgagtctgagtgtaattcatggttgatttcacttcctggatgttaaagtaatctgtaattatctgcttttatattgaaaaaaattgacaaaatctaacagtgtcaaaatgcaatattattaatcattcatggcctaatattagaagagaattagcagaaaacacagcagagaagagagacttgcagactggaggtcttccatccactacgaagaaagcatctagaggcggaatagctttgaatgggcatacatctgcataatgacttttcctttgttcttttctcactggctaattgagtaactcctacaacaaatatgccttcagacttcacaccagattagagccctttgtaaataaaattaaagttgggaatatgctttccctagctggtaaataaattcaggaagtctgaggtttagcactgcatgccaagatgtctaagtaaatctcaaattcttccatattttgaaataaacaccaaggattatcaaatgccaagaactcccaagaagaaaatagctcacctcactctctgaatcagagaccctctccaatcaaaatgtcccacctgaaaagtagtcttctctcctaccccatcacagacatatggatgttactgatgtcatgtgtgtctggaatattgcctggttcctatgacaagaacaataaaatctcttagtattctgcggcaaacagtctctttctcatttatccacctctgcattgaacatgagtccctcctatgggcccaggcattcttctaatcattggcatcacaatagtgaaccaaacaaaaatgctggtcctcagagagcttagtttttagagggttcttccaaaatcctagcagtggtgaccacaagcagaggatagatcctgggtaaccagagtcaggttatgcaatgcttgtgttcatcatgtcaggataaaaatcttcatctgatttcagactcaccacacggcatcgtcataaggtcataagtcatggactatttgagaaagcactaagctaagaggagaaaaagtgcccttgaacctttctgaacccaatggtatctgcctaagagatggggaagctgaactaggtcacactgagatgagaagggggctccacccatgatgtccttgtctcagaataagtcagcctcttatgctataatatgtggatcaaaagaacaggatgggctgggcgcagtggctcacgcctgtaatcccagcactttgggaggctgaggtgggtggatgacctgtggtcaggaatttgagaccaacctggccaacatggtgaaaccccatctctactaaaaatacaaaaaattagccaggcatggtggtgggtgcctgtaatcccggccactccagaggctgaggcaggagaactgcttgaacctgggagagggaggttgcagtgagccgagattgtgccactgtactccagactgggcaacaagagcaaaactccatctccaaaaaaaaaaaaaaaagaaaagaacaggatgtgggatcagaggagccctccaagacaagtggcttcagttcaaatataagctctgtcgtttgttcagtgtttcaccagacaaagtacttgagtgtcctgcttcagtttccccatctgtaagctgaggtgagcaagaatacttcacagagttgttatgagagataagtggaatgtttcatgggaggcagtaagcacagtgcgtgccacatagtaaacactcaataaatgttagctatttccactaatacagtatagtatatataatataataatgttagctagttatgagtcattatgaacttagttactcacccaaaggccccagttatatcctgaatgcacaccatgtgccaggcatcatgctaactgctgtttatattttcttctttacttcctccagcagcctataatggaagttatcatggtctttattttacaggtgaggatactgagctcagagatgtgaagcaacctgcccaaggtcatgcacccaggagtggcagggtcaagatgcaaacccaggcagaaattactcgaaattccatgttctcttcccaacacaatctctgtcttatttctgtctttccaatgacaccagtatttccaaactttcaccttaccacattctttaagcaacacattatgcagatttcttttttaactggcaacctgaggcaggtctctcttaaccgctgtcagcctaagctcactgctaaagcaccatctctatgtgcccccagacctttgagcactgtcaaaatcagaaatgcattcaccctgtaactcagcaattctacttttggaaatttatcctagaatatacgtacacctgtacacaatgacatacatgcaatgttattcatcgcattgtggtttgtaatagcaaaagatgagaactttcccaattgttcatcaagagagaaataattaaataagacataatatagccattataatagaaaaacatataattataagtaagaatgaaagaactcactataccctgatacagaaagataagcaggatataagttttaaaaggcaggatacagaactgtgtaataaaaaaaaaagaagtgcatatacatttgtatttgcttgtacatacctgaaattctgcaaagataaagaagaaacacataacaatggctgtctgtgaaaaggaaatgttccaggcagaagggacaattttcactgactattctagcatactcttgtttttaaatttttcaatcatatgaatgaccggcctgttcaagaaatgaaacaattttgaaaatacgggttttaagagtataggattaagagtataggattttttttaagagtataggattaagaatcagaaatttgagtccaagttcggggcaaacttggataccttactttatttctatcagccttcatttcttcattagcaaaatctccaagtccctaaatactggggactttggccaacgttatcatagctaccatttattaagtggttacttttgccaagccctatactggagcctcctaagaatttgcctcattgagtcatcgcaagcaaccctatgagataggaactatgattactcccatctcacagatgagcaaactgaagctcagtgcgggggtataacttgcccaaggtcacacagccagtatgtggcagaaccagaattcaaacccaggtctctcaagcctgtatttggactcaatggtttgctgcctccatccacattgacagttttcctagttgtgttccctgcctcttgcataaatcccacccaccagttcccttctgaaattgccagcctccaccaggcctggcccttgctcatttccaatcaccctttatccaccatagctttggaaatggactgttactaatggctagtcatatgtcagcctaatgaatgggaggcagacttccattaaaataatgaaattagcgagttttgaatttggttacatcgcatggcacacagcctcaagtaatgaccaccccatgctccttcctacaaattaaagtcagtttatttatttaaggtctttggcttggccatctctattaagctcacatcatctgtttagggatggatttttttttttttttttttggccttgtttgtttaaatgatgttcgggctgttcccctgattaataaagtcgtaaacacagtcaggagcagcttctgaaccatgtgcaaaagcaaagaatgtaagtcaaagaacaattctttgggggtttgggttttgtttgtttggggtgtttttttttcctccaaaggatggaaacaataagaaagaagctctttgagctccagaaactccaattatgctgacatttctgctgcagaaatacaccaagctccattttgcaggaacccagtgaactagctaatcagatttccttggataatttgctccaaaggtcagctgccttaaaaagcacccagtgcctcattatttggtaaagcaggctgcatgcgggctgcgatttggaactcagcctcccatggcaaggtagtttttctggaattttttagcccagaccctgcagccttagctttggccaaagtctcatccacctttgtgatcagcccgcagacaaaatcattaccagaaaaagcacctgaatctctgagtctgtgaggtctctgtctccaagacaggtctctctcgtgtcccaggagcaccaaagatggcagactcatctgaaatgttcatgccattggtcaatttcaagggaggcttttactgatactgtgatgggtaggcggccagacctaggttctaatcaccaagtccaattctacaaaatccctaaccagtacccctcaaaactatcaagatcatgaaaaataaggaaagatggagaaattgttccataccagaagagactacagagacgtgagaataaatgcaacatgaaactctggattgaatcctggacaggaaaaagacattagtagaaaaactggtgaaattcaaataaaatttggaatgcaattaatagtttccaaagttgtgacaaagacattaacatttttttaacattaaagaagctgggcacaatggctgacacctgtaatcccagcactttgggaggccgaggtgggcagatcacgaggtcagaagttcaagaccagcctggtggtcttgaccaccaacatggtgaaacctcgtctctactaaaaataaaaaaattagctgtgaggtgacgtgtgcctgtagtgccagctacttagggggctgaggcaggagaattactagaaccaaggaggtggaggttgcagtgagccgagatcgtgccaccacactccagcctggtgatcgaacgagattccgtctcaacaacaacaacaaaatttaagaaaaactgaaactgagaagggatttcttggaacttgctatagtatcgttgtaacttttctataaatctaaaattatttcaaattttaaatatctgtatataccattaaaaaatccattgtgtattagttatagtttgatgaaaataagtttaaataatacataattattgttctattataaacttgatatcctagtcctgatatgatatcatagtcttgacatgtgatatcatagtctaaaaacaaaacaacaagaccagagaggaaggtaaagccattcctacaactgaatttttattcaatctcttttaagatcccagcaaagaaaaaaagaaacaacaaaaagtaggactttggttaagctaaaataaaatatgatggatagtctctctctataaactgacacaggaaaatccaagacaaagaaactaggttttgtttgtttgtttgtttgtttttaccactcccaccaacctcaccactctgaaggattgtaatatcacaagaatagcttacaaagcaaacatcactggcttagcttccactctcacagatttttaagacacccagctccaatcctcaccctctgatccttctcatcttgtagaaagagatgcatgaagagtccattgtgaaccaggcattgtgcttgatgacggagacaccaagtcaacttggaccaggtccttccccttaaggagtcttggaaaatttgctcaagagagtctcagctgaatctcgaaggaagaagaggaggtagttggatgaagaaagaaaggaggcttccagaaaaagagcacagtgcatgccaggacatctaaatcatgacacttagatacctgcataaagaggacaaaattgaggtgggaggagttagaaagggcccccaggtaatggccttgtgtggtaaaggatttaactttctcctgaaggagataaggagttttaagcaagcattttagaaagattcagcagaggacagtggatagagggtgaggccaaaagcaggaagactatcatccaggccacacatttctgaatacaatgcccagagacagtgggagagatttctccaaggattctttgcaggaaacaagggtccctgcaatgatgagacctgagtttcctatttctctagtagctttgtagctcagcacccatcccaactgcagctggaagatgtcctctgctatttctccattccatactccaagtccctgccctgcagtatgtatgtaccttttgccacccaccctctgactctgttacattgtatattgaatcttcaacctaaagatctcaactgcttacaaaaaagaagagaattatgtgggcttaataatgttaagggcagttaccacatgagcactgactatatccaagcattgtgttagcctttaacctgcaaagaaaaatacaattatccccatctcagaacataagaggaaaattgagactcccaagaagttaaataacctcctatatagcttttaacatgggtggggataggatatggatttgagaatgtctgattccaaccacccttttatggcacctcactggctcacttttaatttcacttgctgatttattacaaatctccctctccttcagaatcaaacacaaactcattatgctgggccaaaataaaatctgaatggccatacccaattgtttttaaaatgttcagccttccctgacagatgtatgacattgcaacactacagctttggagtggctggcttaacgccaaggagtggttccaaatctcttttccagtggaacagtagcacaaatttggtctaccatctaaaaccaaataatggctgcccttttcctcttcctggaaaaaaatgacatagatgggtaaatggattaatgaatggattagacggataaatggatggatgagtgaatagatggatggatggataaatggatgtgtgtgtggatggatagatggatggataaatgggtaagtaaatgaatagatggataaatggatgaatggatggatgaatgaatggatagatgaatgcaaagtggatggatagatggatggataagtggatgaaagaatggatagattaatggaaagtaaatagatagatggatggataaatggatgaatggatggatgggtaaatagatgaataaattgatggatgcataaatggatccatctatggataggtggctagataataaatggatgggtagatgaataaatggatagatgggtgaataaatgaatacatgaatatacatttacaatatagaatatttctcaaggggaacatagaaaactatcaatagtggttgccatttctgtgaagaaacaaactggttaggacaaggatgggagtggaaactaccttttactatacactcttttgtatctttccaattttgagccatacgtgtataatacctatttttaaaataaatagcaatataaaactaatttcaaatacttttgttaaatgtatatatgaatgggtggacagaagaataaataagtcctaagtttttaaacaaataagattcaactgttattttccccactgatttttctttaaatctcggcactaacttctacttccctacataagaacataatgtaatgcgtatccaccttagtgcacaatcaactacaaaatttggttattcaaatggaatatgtcaataacattgtgttgctttgcaaagagcaccttgacttcaaggtgtgtccgcttacgtctgttcaaggacctctctgcaggagttagagtaagggacaacagtgctgaggcctggacacatgatcccacccaagtttctttttctgttgttggtttttattttgttttgtttttttgagacagggtctcaccctatcacctagactggagtacagtggcacaatctcggctcactttagtatccacctttcggactcaggcaattttcccatttcagcctcccgagtagctgggactacaggcatgcaccaccatccctggctaattttttgtagagatggggtctcatcaggttgcccaggctggtctcagactcctggactcaagcgatctggcctgccttgacctacccaaagtgctgggattacaggtgtgagccaccacacttagccaagtttctttaagccataattctcctctgtgcaagacctgcatactgggcttctgaacactgccccctgcaccatttggggaacataaggaagggctatgagtaaggagaccttgccaagggaaagattaaaaaacaaacaacttccccagccaccatcaatagcatttccaggaagaaataaacagaacggactcttggccataaaggatttatcactttcctttccattggtgtggaaatgaagcagggttgcttcaaaactgcattttccagctttccaaggagctgtgtggattccatatcctagagaagtcgacaccgttctagtaagttggcatggaccccaggtcctacccttaagggcttaatactctgatgcaatatataaaatataatttaataaaagactgaggcagtatttgtgtaccaagtgtctatagcaagtaccaaggtatttgcatggattgggggtggtagcaagtgtgtgatattctccttctaaatcccctgcgtgtggggatggaatttttaacagtgggcgatgtgataggacgatcagagatatgcaaaaccacctttttagtggtgggacacagtcacagttgtattccttctgggactatttggaaatcacacatttctcatcaagtaagaaaatgaaaacagagaaaaaccagttgacagtgatggctcaatagcgccatctcgtggtgatctctgtccccactccaagagcagtccatgggccccaccccttccgggatgttttgccccctctgtatctgagtcccagaaggcagtgcaaaagggatctgggcaaaacagagtatcctacagattggaacagtgaccaacggcatctttaaggaggagaaatttgaaatgggttctaaaggaatagatacccaggcatcaaagagaagcaaagacatttttgatgaagggcatagtgcaaaccaaggttggtggctggaaaatgtcagatcctttgaggatatgaggctggaaagtcagtctgggttggtgaggactcactgctgggctgctgtgggcatgagatgtccttggggaggtacagactttctgcgagacagaaagtcaaaaatcatctccattcacctgtggaccagcaccgtgctaaattacatcacatacatcagtttatgtatgcataaacatacatcagtttatctgccctcaaggggtgatactattatgaacctccacttgacagatcaagaaagcaaggcccaaagaagttaaatcgcttacctgaagtgacttagctaacaagcggcagagccaggatttgaaccaagatctctgcccaacttcaaagcatggtcttgctcttcataaaggtgttctcatctgcaggtctctgctgttgcttgtggcaaagacagttgtcacatatgaaattgctcaatccaaagtgcttctgctttaaatctaaatagttaccaaacattctgccccctgtaaagctgaagtttctcccgaaggcttcaggcttgtgccctaggacttcttgccacctggccagctggtcacagtgtctttgaatgactgggggacagatgtggcaaaatggtaaagtgtgacggttaatttcatgtgtcaacttgactgagctaaaggatgcccagatagctggtaaaacattacatccgggtgtgtgtgtctatgagggcatttctggaagagattagcattagaatctgtagactgagtaaagaagactaccctcagccaggtgcggtggctcacgcctgtaatcccagcactttgggaggccaaggtgggccgatcacgaggtcaggagatcgagaccatcctggctaacatggcgaaaccccatctctactaaaaatacaaaaaattagctgggcgtggtggcaggcacctgtagtcccagctactcgggaggctgaggcaggagaatggcgtgaacctgggaggcggagcttgcagtgagccgagatcatgccaccgcactcgggcctgggcaacactgcaagactccgtctcaaaaaaagaaaaaaagaagaccaccctcacccatgtgggcagacatcatcccatctgttgagagcccaaacagaacgaaaagcaaaggaagtgtacattttctatttgagctgggacattcaccttctcctgaccttggagatcagagctcctggttcttgggccttcagacttaccctgggacttaatgtcattggctttcctcataccccaccttgcagatggcagagcatggaacctagcctccataactgcatacaccaatccatataataaacagacatatatatcctactggttctatttctctagagaaccctaatacaggaaggttgtgaggtctgggatctaaatcccagctctgcccctgagttgttcaagcatagcctgtccaaagctgagttcccttgatctttttccccaaactcctcctcctctactaacccagccaccatcaacgctcctcctccaaccacacattccaccttgcccctcctggaacagagattcccacctcaggacctttgcactggctgttgcctccacctagaactgctttgccctccaatatcaacactgctccctcatgtccttcaagtctttgcataactgtcgccatctcaatgaggccaagcctggccaccaccaccaccccgaactgcacgccctacaccccgttaccttctctgtatttctcatagcagttgccaccttctacaatgccatgtaatttacttgttttgtttccggtttactgtgtgccttcccccactggtatcaatgtgccccagtgactggtagaacctaggtagtaactgaacacgtgttccctatgaaattggtttaactctgctgtatgtgtgaaattttttgtaataaaatattagggataatggtctcaaaggcagtcgttttatctgctttgttcactgatgtatcccaagtgtctgaaacaagacctggctcatagaaggtgcactataaacattactgaatggaggaattaaggagtacatgtgttacttagggcaagttatcttatctccctaaagctctaggtgtcaactacaaaggggcaaaatagtagctatttttcatttattaagtatttattgagcatctactatatatctagaactactatatatgtaggtactagagatacaactgtgtgaaagacagaccaagtcctccttctcatggagctttcaatccagatagggaaacatgaccacaatttcatgtaactccttcatttattacttattgagcatctactatatatctggaactatgtaggtagtagagatacaactgtgtgaaaggtagaccaagtcctcctcatggagctttcaatccagatagggaaacaagaccacaatttcatgtaactccaatgccatctatgagattgcctaatacctgtgtgtcccaactctgtcacagggattcagggaggaccactcagctgagtggcatcaaaactgagcactgaatcttaattgttaggattctgctaataagaaaaatgcatctttattttgctgagggcaacaatgtatccagctaaaaatcatctttcactagcatctcttgcagctagggctggccatctgacgtagttgtgaccagtgaaaagaagggagagcgcacctttagttttctgccttgctgccctcccttggcttctatgcctgctgacgtgatgcctggagatgaagcagctattttgtaaccatgaggatagaaattgcacagcagagcaagaaaatgaaaaaagtgggggtttctgatggtctctttgattcactctaccaacatggcttgcctactgtttagcttattgtgtaagccaaataaacccttgcaccttcaagccatgataatagagttttctgatacttacagccgtatctgttgtcccaagcaagatatgaacgaggttaagaggatgaaagtgaaatgtactaagcccagggcacagcatgtgcaaaggaccagaggtgtgagtgagcaaagtcaattccagcaacacaaagttcagggcagctgaagtggagtgggcaaaaagcaggtggtgagtgaagagtttgcaagagcaaacagggatcccactgaaatcaaggttttgtaaatcgaattggagaaacagtgaagagccatagcaagctgctaagaaaaatttgagttaatttatggaaagtgtccaatgcacagtgggtgcccaagatataagcaccgtgagtatcatcttaccttggaatacacacaaaattaactcctccgacaaaatgaagatgcatcacttttatctgcaagcccgccggaggtcacagacacgtgcagagggaaaacagtatggtgagacggagaaaaacaatccagccaggacagttacaccgacgctttattcatatctgccaccatcgggattgattcccacacagtgactcactcacagcaccaacctctttaatcaactgtgctgagcagtgacatccaagctcacctcggaaaacgacggaaactccaaggcaaggtggcctcccgaagtggccttttcccttccctcctcatccctgggctgtttccagcagacggcagtgaacgcctaaatgagggtttgatcaatggaggccaagctgatattgacaaagcagctgcagtttccgcaaatcacccagcactcatagatactgaagattaatctttacaaatacggggcaaagggggagagaaaaaaccaagtcgatttagtttccgattattactttctccagaaggcactgaagagtcaaaagtttaactgatgtacattagacagggagacaaatccagaaatatcacccaattacccggtagcttctagaaggtatttttcatgacagcaggtgggtttgccttttctaaatcaggaaggagacaagacaccgctaagaggatgttgacttggcccagcgcacaagcactaacctcaccggacaaatagaagcctgaaaatttgtcctcagtctacacggtccccatgaaaacacatttccaccgatttcctagttatttctgttttatgcctcatgtttagaaagtaaattgttccttcctggaacaagatggacttttttttaactacaaagaaataataaataagtgcttagcctccctaggcctccattttcacatccaaagagtgggtacagcccaggacgtaatgtttagagggcactgacaccatctagagtggatcattctctaccgtgcagggctattccgcccactgcaggatgtttactggcatccctgaagtctacgcaccagatgccagtagcaccatttcctcatccccagttgtgacaactgaaaatgtctccagacatgaccaaatgtccctgagagacaaaaccacttgcatagtcacgaacagataacacgactaagaatggggaaaacgtgaatcaaaagatgttccatgctgtgttcacataagcaataaaaccaaatgcttgaatttgatgctagttataacctttttattcatgtccatgtcacagccaaagaactgtttttgttttttaggttttttttttttgcagagacagcatttcatttatttcaggacactttcacagaagtattcatatattctggcaaaatgaaatcatatattacacaaacatttcatttccatagttagtacagaagaggaaaaattatttgtggtcaaaattactcctgagattcctttaaatcaaccataatttatagagtgcgcatgtacttgtgtatgtaatcattttaagtcataactatgcccctcgaacagttggaagtcactgagctggaccgaagaattcacaaaagagaaagctcttcacagatacttgggttttgaaaccattctgccattagatagctacctagtcctcaaggtgaactaagcacgatggaggaattccaagtgtggcttcccacctgcagggtcgactccactgagactctgctgctaacctcagcatacaaccctagatgatcttgtcgtgaagatgaaggagatcacagacaacatcttgccagggactgagttttaatgctggcgttttagttatcctgttgggctacaaaaacatgtcaggcaagatgttaagttttgtttaaagcatcaagaattccaggcccggcgcggtggctcacgactgtaatcccagcactttgcgaggcctaggcgggcggatcacgaggtcaagaggtcgagaccatcctggttaacacggtgaaaccccgtctctactaaatatacaaaaaatttgccgggcgtggtagcgggcgcctgtagtcccagctacttgggaggctgaggcaggaggatggcgtgaacccgggaggcggagcttgcagtgagcagagatcacgccactgcactccagcctgggtgacagagccagacttcgtttcaaaaaataataataataataaagaattccaaaatcaagtacaaaatcaaaaggcagattttcaaacaaaatctttgaaaagtggttctggccgggcacagtggctcacgactataatcccagcactttcggaggccaaagcgggcggatcacgaggtcaggagacggagaccaccctggctaacacggtgaaaccccgtctctagtaaaaatacaaaaaaaaaaaaaaaaaatcagcggggcgtggtggtgggcgcctgtagtcccaggtactcgggggaggctgaggcaggagaatggcgtgaccccgggaggcggagcttgcagtgagccgagatggcgccactgcactccagcctgggcgacagagcgagactccatctcaaaaaatatatataaataaaaataaaagtggttctgtcctgcttacaccctcttctcacgcttttcaggcacaaagaagggccaagagcaagagaggatttctttggagagagtctgttgaagacacgccttcatgttacaagatcttgaaactcatgggcaccatggtctgggatctgaatcctgcagcaaagctcttccaggcttcctgctatgctgcctggggtaactgcacaaggccccataattagacgaccccactgtgatgctggcattttgaaattcctataatttttttttttttttttttttgagacaaggtctttctctgtcacccaggctacaatgcagtggcatgaacatggctcactgcagcctcaacctcctaggctcaagcggtcctcctgccttagcctcccgagtaactaggaccacagatgtataccaccattcccggctgatttatttatttattttttttttaatttattcatttttttttttgtagagatgcagttttgccatgttgcccaggctggtctcaaactcctggactcaaagcaactccccagcctcagcctccaaaagtattgggattacaggtgtgagcccctgcacccagccagaattcctataattttcataacaagaatccccacattttcgttttgtgctgggccctgaaaactatgcagccagtcctgcccaggatgcttattttatttcattttcccagctttagaggggtaaaattgacaaataaaaatggaatacatttacagtgtacaatgtgatctttggagatatatgtatacacaaattgtgaaatgatcaccatgaaccagctaattaccctattcattacctcccatagttgtctttggatgtttatgtgatgagaacacctaagatctggtctcttagtgaaaggatggtgattaccagagcctgggaagggtagtgggctggggaatgtagggatggttaatgggtacaagaaaaatagttacaaagaatgagtaacacttactacttggtcaggtgtggtggctcacacctgtaagcccagctctttaggaggccaaggcggacagatcgcttaaggccaggatttcaagactagccgggcaacatggcaataccccatctctactaaaaatacaaaaaatagccaggcattgtggggcacacctgtagtcccagctactcaggaggctgaagtgggaggatcacttgagcccaggaagtcgaggctgcagtgagctgtcatcatgccactgcactctagcctgggtaacagaaatgagatcttcactccaaaaaaaaaaaaaagacctactacttgatagcacaacagagtgactatagtcaataatttaattgcactttttttttttttttttttttttgagacagagccttggtctgtcaccaggctggagtacagtggcgcgatctgggctcactgcaacctctgcctcctgggttcaagcaattctcctgcctcagcctcccgagtagctgggactacaggcatatgccaccatgcctggctcattttttgtatttttagtagagacggggtttcatcatgttggccgggatggtctcaaactctagacctcgtgatccacctgcttcggcctcccaaagtgtgaggattacaggcgtgagccaccacgcctggcctaattgtacattttaaaataactgaaagagtgtatttggattgcttgtaacacaaaggataaatatttgagggtatagataccccattcttcatgatgtgattattacacaccacatacctgtatcagaacatctcatgtacccgtaaatatatacatttattatatacccacaaaaagtaaaaaaaaaattttaagagctgctctcttaacaaatttcaagtaagcaatatggtattgttaaccatagttaccgtgccaaatatgagatgcccagaacttattcatcttatcaccgaaagtctgtaccctttgagcaacatttcctcctagcccctggcaaccattctaattcgactctcttttcctctgagttcaacattttcagattccacagataagtgagatcacacagcatttgtctttctctgtctgaattagttcacttagctaattctactctttttgtatgagttcaacgtttttaaattccacaaataagtgagatcacacagcatttgtctttctctaagtccacttagacaatcagaggtgcttgttttaaactcaggttcctggaccccactgtttttaacagttcagcttgatatccaagcctgtaagagacactttgattctctggattaaaatgagagacagtgagaggagaggaagaagaataaaggaggagagctttctctctaaaaatctaagggattccaattaaaaatcacctctcattgtacatgcagaaaatgtacagtgagacacaaagatgggttggaagacaaaactctgaaactagtctgggagggttaagtgacttcatggaaataaatactaaaatatcaaaatgctctaaactttccatttttacttctaaatgtgctgagaaaaaaatctgattatttgacaggaattttaaaaagaacaatttttataaaactaaaatcacattcctgaacactcaaatgcttagcataggggatgaaattgacctggaattttctttgtgagaggaaggaccaagttcccaatgtggatacgttaccagttagattttccaagcacagttcatactgcagaattcacctaacttgatttaggtttctcctttataatcagtttccacttgaacttcaactaccacgaaaaagtaagtaagtaaagcaaagatgtaaattcttgggaactttgttatgagaggaactttctagactgcacttagttgtcttatttaattagctaccagggaaacaaaacatatagtatgtccaaggagttgactcaatggaatgctgtcatgctaaacagatctaacgtcatgctgggtgagacacacagtctattttagaaagccaaacagggccggatgcgatagctcatgcctgtaatccccagcactttgggaggcctaggcgagtagattacctgaagtcaggagtttgagaccagcctgaccaacatggagaaaccccatctctactaaaaatacagaattagatgggcgtggcgacgcatgcctgtaatcccagcttcccagctactctggaggctgaagcaggagaatcacttgaacctgggagatggaggttgtggtgagccgagatcacgccattgcactccagcctgggcaacaagaacaaaactccatctcagaaaaaaagaaagaaagaaagcaaaacagaagcaaagcatgcaagaggtttattccaagcctctgacagtaggagtcctgaaatccacctggtggatgaaggaggagacaaaatttagaggacttggcagaatcacagaatgtggggagatgtttccaaagggggcctcatctcatgctgcaaacgttttgtctggagaataccaaaaaaaaaaaaaaaaaaaaaaagttttgtctgtgtcttgtgtcttgggttgttttgttgttgttgttttttaacgtcatcaatgaggcgttccttgttctgctgaggccctagaagcattcaggaaaggaaattcagaggtgggaactggagagaaataatgtgctcaataaaaggagtaaggttttggagccagacaagaaaaaaaatgagaagcagagctggggaaagaatagagggttctagaagcctgaatgtgccagaaaatcatcccctccagaatcccccagtcttcagtgaagccctatgaactcaatagctgagtaggtttcctgcaggcaatgggagacgcaaagttctgcacttaagctcctgtaggggaaaaagcagagccagcgtgggttgggggcaccagggccagaggcagatacgaccttgagaaggtcgccctccccagattagcaggaagtagcctgcatagaagatcttacctagatctttgaggattcaggggaccccagctgacatgtcggttattctacttaattataaaatgtttgagcagggcacagtgactcacacctgtaatcccaagcactttgagaggcggggacaggaggaatgcttcagcccaagagtttgagaccagcctgggcaacacagtgagactctgtctctacacactttatttttttttgttttttttttgtttgtttttttaaattagctaagtaggatgctacaggcctgtggttccagctacatgggaggctgaagtgggaggatcacttgagcccaggattttgaggctgcagtgagctatgactgtgccactgtactccagcctgggcaacagagtgagaccctgtctcacaaaataaaaataaaggccaggtgcgattgctcacacctgtaatcccagcactttgggaggctgaagtgggtggatcacttgagatcaggagttcaaaaccagcctggccaacatggtgaaaccccatctctataaaaatgcaaaaaattagccggcatgatggcaggtccctgtaatcccagctacttgggaggctgaggagggaaaatcacttgaacctgggaggcggaggttgcagggagccgagatcattccattgcactccagcctgggtgacagagtgagattccatctcaaaaaaaataaaaataaaaatgtttggccatttccaaccttgccttcagactatgggttcctggaggacaggtgcacttctcagccatctctggatgcactgatgtggccatctttgttagtgtactggtatggaccagtagggtccatacttgcacaaatcccaacaatcggtatttacatctctttgcttggccagggcccacaatgcctgtgcacaggacaggtcagaagtcctggagaattaacatacctcctgcattaggtcttcaccagtgactaactggagggatgtataaatatcccagctccttcactcctccagggggtgattctgagctacatgctcaacactagggttggcaaacttcttgaaaaagggtcatatagtaaatattttatgttttgccggtcatattgtctctcacagatgctcaactctgctgctgttgtataaaagctgccatgggctatacataaatgaaagggtgtgactgtattccaggaacattttattgaaataacaggtggcagaacaggtttgccatgggccaatagtttgcaaatccctgctctgtgtcattttccagagttcgccagagagattaaactgtgattccccacactggtaactgacatgataatgcatctttcttgccacttccctcccttgcctgtcccctttcccccacctcctcaagcttaataaactattggcactcaaatccttgcctcagagtctacttcagtgagcatccaaactaaaacagttgattaggactttttttgtttttttgcaagagatggagtctcgccctgtcacccaggctagagtgcagtggcgggatcttagttcactgcaacctccgcttcccaggttcaagcgattctcctgcctcagcctcctgagtagctgggattacaggtacgtgtcaccacgcctagctaattttttatttttagtagagacagggtttcactatatgttggccaagctagtctcaaactcctgacctcaggtgatccgcctgtatcagcctcccaaaatgctgggattacaggcgtgagccactgtgcccagcctgataaggatactcttgactgcaagcaacacagagttgaactacaggtgatttaaatattaattttgcaccaacctataatccagatttattgtatctcccacacaaaatccaggcgtaggtggtccagacaggttaattcaataatgtcatggctttgcggtttttctgatccttactagctcactactgagaaccaggtcatgtgcccaaggctaaaccagtcagcagtgagagaaacaagatgagcatgcctggcttgggccaactgagttccatgcctaagagcatgaggaaggaaggggctccatttctctgggcatattgccaactgatgcatgaatgaaaatgggatggtctcagcaaagaagaagagaaaagggttgctgggcaggtaaccaatacatacccagcagctggtgcttagaaaatgctgctgcagtctatgaatgcatgagccactggatgtaaacaatggatagcaactttctagaagaaagataaagttgaaggagtcatcctggacacacaagagtggtgcaaaataagcactgagtggccaggatgctcaggggaaatctcagaggctttagggagcatggttacctaactcagaaccatcagtgccaactaaggaagacacaaggtacattggttaaagtcaaggacaatcatgttcttcccctagttaataacagacatggcattttacagttcataaagctcttgtccattcattagtctcaccattcagtcaatgaaataaacccaggtaataatcaggtcaggtattattcttttaaaataattttatccccatttactgtgaaaaaaacttcttgagacagcttgcaataaaaggtacacccaaagggaaaccaaaagaaaaattatttgtttatcaaatacataagaaaactcatttaatatggttattttgattgcgtgtgctcttgggttttagctccctaatagccagagcaaaagaaaaagaaaacataaaggacacatgaatatcatcatttaacaaagggaagtatagctgttcacaggaaaggaaatgatttttcttagaatagaattaaaaaaaattccacttggatccttacataaggcaaatgtaactaaatgatggataatgtctcccatgatggttttgcagaagatatgagaatgtcctcattcatcatgacatttgaagtagtccattctcacactgctaataaagacatacctgaaactgggtaatttataaagaaaaagaggtggactcacaaatggactcacaattccacatgtctagggaggcctcacaatcacggcagaaggcaaaggagtagcaaagtcacatcttacatggcagcaggcaagagagggcttattatttttagtagagacacggtttcacaatatgttgggcaggctgacaactggccaagaatagcatggaaaagaccccccatcttgattcaattacctcccactgggtccctcccatgacacatgggaattatgggagctacaattcaagttgagatttgggtggggacacagacaaaccatatcaatatccctaaccatcagcttttcatacaaagccaaaggtttctccctgtggatggtatcatagcactgatacccataagcctcacttccattccacattgtcctggatatcctagctagtgcagttagacaggggggaaatgtccagaaaggaagaaatgaaacagtcatcattcctaggtgacttgatcgtatacataaaaatccaaggaaaattgttatggactgaatgtctttgtctttctccaccaaatccacacgttgaagccctagcccccagtgcaatggcatttggaggaggtaatttggtttagacgaggtcacgagggtattacccccatgatgggcctagtgtctttccccagaaaaacaatatcctttaccatatcccgaaaattataacaataccagttttaagtacttactatgcatgcaccaagtgtttacaggttttgatttactcattgaaacctcacagcagcctataaacccagctagtatgtggcagagttgagacgcaaacagaaaagcagtactccagatccccttggatccttacataagggaaatgtaaccaaatgatggataatgtcttccatgatggttttgtggaagatatgagaatgtcctcattcatcataatatttatattagtccattctcacactgctaataaagacatgcctgagactgggtaatttgtaaagaaaaaaaggtttaatggattcaagttccacatgttgtcatatgccacacttcttagggatgaatgaacatcaccatgatgccacacttcctagggatgaatcaacgtcagaattttttttttttaagttctgggatacaagtgcagaatgtgtaggtttcttacgtaggtatacatgtgccatggtggtttgctgcacctatcaacccatcatctgggttttaagcaccacaagcattagctatttgtcctaatgctctcccacccctcaccccccactctccaactgtccccagtgtgtgtcgtttccctccgtgtgtccatgtgttctcatttgaacatcagagcttaaagaagcattcctgctctcttctctccccgctgggctgggcttcaggtgcctcctatatgcttcctccatatcacctccacccttgcttgtcattgtctgggtttgaattcatttcctgagacttttgtaacaatgatctcaaactaaatggcttcaaacaacaggaatttcttctctcccaggtctggaggtcagaagactgaaatcggttgcaataaactgaaatcaaggtgtcagtagggctcgttccctatagaagtgctaggggacagtctgttccttgcctcttccagcttctggtggctgccagcattaacttgcttggagtggcatcaccccaatctctgcctccgtctggatatcaccttcttgtcttctgggtgtaatatctctccgcctttctcttataagacacttgcaatcaaatttagggcccacctagataatccagaataatctccccatctcaacatccttaatttaatcatacctgcaaagactccttttccttataatttaacatatacaggttccgcggactagaacctgatatctttgagtggccatgattcagcctactataggtttcatcactatctctttatcaactctgaagtccttaacagcagagaccacctgtggccattttcaaatggctgtacattttttacatcaaagcaatctcttagggccaggcacggtgcctcacatcggtaatctcagcaatttggaaggccaaggcgggcagatcacctgaggtcaggagttccagacccacctggccaacacagtgaaaccccgtctccactaaaaatacaaaaattagctgatgtggtggtgggcacctgtagtcccagctgctctggaggctgaggcatgagaatcacttgaacccaggaggcggaggttgcagccagccgagatcacaccactgcactccagcctgggtgacagagggagactccgtctcaaaaaaaatacaaaaaacaaacaaacaaaaacacacaataatctcttgggatctacaccctctcccttgactttaatgacctccatgattgctttgatgtattgaatatggtggaaatcatactgtgcccttttccagtccatgttttaaaagactatcaagcgctacttcctatatcttgaaatactcacttttggaactcagacaccactatgctacgagaagcccaaaccacatagaaaggccacgtgaaagtgctccaggcgacagcaccaactgagctcctaaccagtagccaatatcatgccagccatgtgtctcagccatcttggatggccagcctagtcaagccttcagatgactccagccccagtcattatctgactacaactgcataggacttgaaatgagaaccacgtaggtgagcccaatcaacacagagtcatgagcaataataccaaatatttgtttccagccactgtgggatcaggctcttttttatgcagcaagagattatctgaacatcatatttgttgctgcataccaggtgcctggaactatgcctggaggtcttgatattcaatgaaagtggaataaatcaaataaataaaaatggaataaataaacgaaactctagaagctatggattctagggagttgagctggagatcaggaggaatggatattaggtctcaaagaaatgacaaggtaataaggtagaagaagaaggctgtggataaacaaattttctggggccttaatggtggtgagaagtgggcaagttcaatgttgagcaggaccaaattcaacagaccctcagcaaatgtttgctcacttagcagtacacagattctgcatacatcttccttccttttaaccattcctttaattgtataagcaatatattgagtatctactgagagccaggctttgagttgggtgaagactattcagcagttaagtccctttaatgcttatacactgttgatgggaatgtatattagtccagtcactgtggaaagcagtttggaaatttctcaaataacttaaaatagaactaaggttgaatccagcaatcccatcatgggtataaatcccaaaagaataatcattctaccttaaagatgcatgcacacatatgttcattgcagcactatttacaatagcaaagacagggaatcaacctagatgcccatcaattgcagactagataaagaaaatatggtacatatacaccatggaatatactatgcagccataaaaaagaatgaaatcatgacctttgcagcaacatggatggagctggaggccattatcttaagcaaattaacacaggaacagaaaaccaaatattgcatgctctcacttaggaggtaaacactgacttcacatgaacacaaagaagggaacaatagacactgggtcctacttgaaggtagaggatgggaggagggtgaggattgaaaaactacttaccaggtactacattcattacctgggtgatgaaataatctggacaccaagccccataacatgcaatttacccatgaaacaaatctgcgcacgtaccccccaaacctaaaataaaagttggaaagaaaataaaaatgaaaaacaagtccctttcttatggaacttaacaaccatagagtatttggggaaacctcaaaaccacaggcaggtggttcaagcccccatctctgaccttcattaccctgctgtatagccatgattacaaaaaaaaaaaaaaagccagaccattcaatgctattgcttctctcttccaaatgggatgaagtgcaggcagtaaaccagggaagatgaacttggccaagtccttctattcattttgtggcagtgatgacaatttcccattgtggggagctggaggggcagtctccttctgttcaaacgactcagcacacttttgagggggcataagaaccagaaagtgcaggtgctagtaaagcaggcctgtatttacagggagaatcagtccacagacttcagcttctcaaaaccattgttaatgtgcttttacaaaatgcaaaatgctgctagacagttcactgggtggccttgggcctacccagttcttccctctttccccaactcatggttcttaagaataactgaagaatgtgctagaaatgcaacatcttgagatagagagggactggccagaacgacccaacctctgttccagtccacccctagaaacaaaatgtcttaaacactttagcccagcaaatcacacatcctggggtataaaacacagaaccagctgctttctggggtatctgagcttctgtgtaagtgaggcatgcacagatatgactctacttaccctcagcaggtttccggggacttggaggaatagctcacaatgaatcctaggcttctaccatctcttgctgcctatctgtaagtaataaacctacctcatgtaacttgttgtgtgggagtgttctgtctcactggacaagttggtagccagtgaacagtgaacctgcctcacaaattcctctgctgtaaagtgcaccagaagctctcagtcatggaagttctgtgctcaaatcttccttcaaggtgaactgctctggaagcagagctaactgacaacctctagctgctgtaccttttgacccaccgaggtgttcatgctaggctgcacttccctggggatcttcccagccagtgactgggcacagcggaagtaatggaattaggtgattctaacccaactgggagttgtccaacagagagagttgccttaggaactattacggctggctgatacattctcagagttgtgctgaagcctttctctttctaactatctctcttccttcccactctgctttcagaggtgtcagacctgcattacggtctgaaatctctccctgctccctccccatttcccttcacaggcattttcttcaatgaatttcctgcacaattaatacttggttttctttcatgttgtaaaccactgtaggatgactacagttaacaatatgtagttttggccaggcgcagtggctcgttcctgtgatcccagcactttgggactctgaagcgagcagaccacttgaggtcaggagttcaaaaccagcctggcaaacatggtgaaaccccatctctactaaaaaaatattagtcgggcgtggtggagcgtgcctgtaatcccagctacttggcaggctgaggcaggagaatcgcttgaacctgggaggcagaggttgcattgagcagagatcatgctactacaaatcagtctgggtgacagagcaagattctgtctaaataaaataaaatgataatagtaataataatgcagtttcaaatagctagaaggaagatactgaaagttaccatcacaaagaaatgagaaacgtttgagatgatggatatgctaattaccctgatcaaatcactatacattatatatatcaaaacatcactacgtactccatcaataggtaccattatttttcaattaaaaaataatttttttaaaaaaagaaatatagaatgttatacttgtaaaaagaagaaaatggaaactgaggaatcaaattatgtaagagtgatcttccttctcatcagctatcattttagaaatttgtaggaaaagaggagataaaggaagagagcaagaggaagcaaataagcagagggaggaaaagaggagaaagtaaagaaagaattagaaagtaaggagacacaacagatcagatcagctaccataattcaaatgctcgccaaaatcacttcctatatttgcaatacagaagctgcaggagacatgttatttaaaattagtaagagggccgggcacagtggctcatgcctgtaatcccagcactttgggaggccgaggtgggtggatcacaagatcaagagatcgagaccatcctggctaacatggtgaaaccccgtctctactaaaaatacaaaaattagctggacatggtggcatgcgcctgtaatcccagctacctgggaggctgaggcaggaaatcacttgaacccgggaggcggaggttacggtgagccgagatcgcgccactacactcgagcctggcaacagagtgagactccgcctcaaaaaaaaaaaattagtaagagaatgagaacttcatacagaagttgagaagtggatttgaaatcagtggagactgggaccttgtacaattaattctgttttgccttctgctactcagaggacctgaactgactcacctaccgtctagagacagctactattttgtatttcttttttagtttcatgcatttaatttgcatgattatcattttgctttatttccccattttacattataatatgtgccacctcatgttactgtgcttcatgtctattattgatgccccataacattccattgtatggaagtatcataaatatcaactatttccctttagttggacattcagggtctttccagatttttttcctaattaaatgatgctgcaataaatgccttgtttcgctccttcagaacaggtcattgcagtaagggcctctccattggagtggtggattttagttgtctgggacttagggttttggttctgattctgctacatcctaacagcatgaccctgagcaagttacttggtttctcaggactcctgtttcctcacccatcaaatggaggtaacaccagacaaggatcctttgtgactatcagatttaatccatggcatcattttgaaaatattttcttttttcttttttttttttttttttttttttgacacagagtctcactccatcacccaggctggagtgcagtggcatgatctcagttcactgcaaccttcgcttcatgggttcaagcaattctcatgcctcagcctcccaaaagatttccatgtaaggtgcttgcaaagggaaaaataacaacttgtgtggtcaaaaagtttagaaacccctggtctaaatggcgttagcaggacttatcagagcctttattataacagcacacagtcccaaaggtagatccttatggtattatcttagtctattcagactgctataagagaatgccataggttgtgtggcttacaaacagcagacatttatttctcacggttctctccagaagatctgggaagtcccagatcaaggcacaggcagattcagtgtctggggaaggccttcttcctagttcatagacagccctcttttcactgtgtcttcccatcatggaagggcaaaggggctctctgggaccccttttaaaagggcattggccaggcgcagtggctcacgcctgtaaacctagtactttgggaggccaagatgggcagatcacttggatcaggagtttgagacagcctggccaacgtggtggaacctcatcgccctaaaaatacaaaaaaaaaaaaaaaaaattatccaggtgtggtagataattatccagtagtctcaactactcagaggatgaggcaggagaatcacttaaacccagaggcagaggttgcagtgagcctagatggtactactgcactctagcctgggaacagggtgagactcttgtctcaaataaataaataaataggcatgaatcccacttgtggagtccccaccatcatgtcctaatcacctcccaaaggccccaccccctaataccatccatcacactggggattaggtttcaacacatggtgggaacacatttagtggatagcaagcatgaagcattaatcaagcttatttgcccatcatgcccatgaaattctgaagtctgacaagcagcctgtgagaagaaagacatacaacaaggaggtaggactatggtgctttggggtggaggccactgatgaaaaactcacccctcgaaagcatctcctactttgatacctacggatgcaacatccaggtagaaccagcctcgatgtcttctggagcccaggacctgatctccaagctggcccaagacaaccctcagagtgccactgttcaagctcctcttgctccataatcactttaaagaggctgcccccacccctggggctcagagggcttcctgtgacctgacactatgatcgtgagcgagtgccgcgctctgttcccaactatgcttcctcatctgtcatccatggcttttcttttaaggagttatttacgaagagctgaagcaatttgcttttaaaaatgaaaaacaacagaactagtattttttgtaagtcagcttgataggcagtaaacaatcctgccaaagcaaagcagaaaatgctgaaaaggttcatgtctcttcaacgactctgaccaagacttcagaggatgctccaaggggagaaacatgctcagggctacagaagcgacaatcatggataccctaagctggtctttcccaggagcaattttaccatgcaattttccctggatcctttctctatcgccccataacacctctcccatttggaaacaaaaatataatctttgaaagaaaaatagaaatcactgtctaaataaaaataatacattcctagcattcattcaccctcttcatcctcctccctgcccctgcgggggggaaaaatctcatttatcatgttgaatttctcatctcttgtgaatgccacgcaattgggtaaataagttctgtgttcaatcttttgtttttttgtttgtttattgctttattcattcacaatggaaagaaagactaaacttcaggtagagataaaagaatataagatgtatttttaactgtccaagatcatgggatctccgaattctattcatgatagaatgtttgagcatctgtggaccccagtttgtgaactcttgccctgaaacaaagcctgccagttatctgtgttcaatcttttaacaggggttattcaatttactcaagccaacatgagaggtttccatgacaacctctcagcacattcagtcttcatataaatgagttattgcttttatgttctcatactctaagacaatggggaaattaacataatgtggtcatacaaaaaaaaaaaaaaaaacaatcaaaacaatcaaaatcctcatatcctccccagaaactcacagatagcattcggtgaaaaagaaccaaagagaaatgaagccttcacatctgacaacactgttaacattagagatttcatttcagatgcatttaaatgaagccagaccataatggggttcaaaaaaaagtgtatagacataactaaactgcagaggaaagagacgtaaagtcagggacccaaattcactttcaggccatatatcctccaaagataaccaccattctctgcctctctttctgcaccccatccacactagcattcctgccccaggaccttcgcacatgctcttccctatgcttggaatgttcttcccctgctgttcttccagtgctgctttgcttagctaactcctactcatcctcaggtctcagctcagcaaagtcacttcctcagggcagtcaagctttgccactcatcaagactaggtaaaattttcttgttaaatctatttatggattttcctggttctttgtatttttcatcatcttagataggttagatttccccagaaacaaatcctaagagaaggtgagatggtttggctgcgtccctacccagatctcaccttgaattgtaacaatctccatgtgtcaagggcgggggcaggtggagataattgaatcatgggggtggtttcccccatactgttctcctgatagtgagtaagtctcatgagatctgatggttttataaatgggagttcccctgcacaagcctcttgcctgctgccgtgtaagatgtggctttgctccttcttgtcttccaccatgattgtgaggcctttccagccatgcagaactgtgagtccattaaacctctttcctttataaatgacccagtctcaggcatgtctttattagcagcatgagaacagactaatacagaaggacttgaagataagtgggttgatttggaaagtgagcccaggaaacactgggatgacaatagggaaatgagacagagaagggaaaggagctaatccaggtcatgtttataagcaggctgctactatgggcaactggggttcaatcccactggggacatctgggagacagcatagcgcctgcctcaccctaaggtatggaaggcagggcaactgccctcagcagctggctgggggagatgtgcctgtgttggtttctctgcacttccagcctgccccacaagagcctaggttatggcagtgagacaaagccccaggcagtattgcagatgcttgcagtaggaatggtgagtacccagaggacataggcaaggcaacaactacatctgccaccttccccaatgcaaacagcataattattgctggagactggagatcagtggaatagaagacagaagatttaattcaaagccattagacaaaaaataatagtcccattgaagacaaaggcatgggaatacggggaaggtataaatccacatgaatagacaattttcaaaagaagataaacaaatggccaacaaacacgtgaaaaaatgctcaacatcactaatgatcagggaaacgcaaatcaaaaccacaatgcgataccaccttactcctgcaagaatgaccagaatcaaaaaatcaaaacataatagatgttggcatggaggtggtgaaaagggaacacttctacactgctggcgggaatgtaaactagtacaaccaccttggaagacagtgtggagattccttaaagaaaagtagcaccaccatttgatctggcaatcccactactgggtatctaccctgaggaaaagaaatcattatatgagaaagatacttgcacatgcatgtttatagcagcacaattcacaactgcaaaaatatgaaaccagctcaaatgcctatcaatcaacgagtggataaagaaactgtggtatatatatgccatataccagcagtatatttatactactcagccataataaggaatgaattaatggcattcacagcaacctggatggaactggagattattattctaggtgaagtaactcaggaatggaaaaccaaacgtcgtatgttctcactcacaagtgggagctaagctatgaggatgcaaaggcataagaatgatacaatggactgtggggactcgggggaaagggtgggagggggtgagggataaaagactacaaattgggttcagtgtgtactgctcagataatggctgcaccaaaatctcacaaatcactattaaagaacttactcacataaccaaataccacctgttccccaaaaccctatggaaataaaaaattttaaaaataaaaaataaatttacatgatataaaagaccttgactctaggcctgggtgactgattatatactggggtacaggttttagtcaaagagctggagactatatggaaaaggggtgtctaaggccctctctgacattctaacaacccccatcatctcttttgctggccaggggcccacctggtaggacagtccaatccagggtaattctggctcacaggtcacacaataccaatctttggtcccaaggttaggagtggctgctcccacaatggactttataataacctctccaacctctgtttgttgagcttagattcttaagcctctaagcttctgatgactcttattagagaaagtaatataattacccatcaataaagaaatggctcattcagcaaggatatatctgttcaatcaaatatatctgttcaatcaaatcactaaaaacaatggccgtttaagagtacatatacaaaaggtacgtgtgcaacagtataataagagcaaacctaaattatgcttgttgttcactgattgtctccccacagtagcatggaagttcagcaagagcagggatctttgtttttgttcaatgctaggtcctcagcacctaggactgtgccaggcacaaaaacatccagcacccaccaaggtaaaatttacaatgtctgacatcccataaaagttactttaaaaatagaggctgggccaggtgccgtggcccacgcctgtaatcccagcactttaggaggccaaggtgggtggatcatgaggtcaggagatcgagaccatcctgccaacatggtgaaacctgtctctactgaaaatacaaaaattagctgggcatggcgacacgtgcctgtaatcccagctactcgggaggctgaggctggagaatctcttgaacttgagaggttgcagtgagccgagatcgcgccactgaaccccagcctgggcaacaagagctagactccgtctcaaaaaataaaaaaatagaagccagtggccaggagctgtgaccgacacctgttatcctagcacttcgggaggccgaggcaggtggatacttgaggtcaggagttcaagaccaacctggccaacatggcgaaaccccatctctactaaaaacacaaaaattagccagtcatgatggcacacacctgtagtcccagctactcggaggctgaggcacaagaattgtttgaacccaggaggcagaggttgcagtgagccaagactgcaccgatgtactccagcctgggcaacagagtgagactctgtctcaaaataataataatagaggccaggcatagtggctcatgcctgtaatctcagcaatttgagaggctgaagcaggaggatctcttgaggtcaagagtttgagactagcctgggaaacaaagcaaaaccccatccctccaaaaaaactttttaaaaactagccatgcatggtggtgcatacctgtagtcccagctactcaggaggctgaggcaggaggatcacatgagcccagtagtttgaggttgcagtgagctatgactgtgccactgtactccagcctgggcaacagagcaagatcctgtctcaaaaaaaattaccttaaaataataagtaaataaatatcaattttacaataaaataaaagtgactcagcctaccctgggtggggttaagggctggcctctatcacacctatcagctcccagaggtcctggatcccccagaagctgctaggaggggctgagggccattactcagaagtgcagagtggagcaagctttgaccaataagagacaggaaacagcaggagctggcagatgactgactccagagttatcccatgcttgtgtttctgggaaactgcaactccactaggcaatatacacttctttggttttgctcttcctctttctctctttcccttatccctgctttcttgagattgcgtgacccaatgaaacatttgcatatttgtatcaggcactgttggtaggctaagataacctccatccccaaaacctatgacacatggggtatctcctgaaggatgccattcaagttaatccccaaacattatggcttaaagccacaactgtttttattatagatcatgattttgagggtcaggaatttaagcaggacccagctgggcagttcttctgctcacacagtatcatctgaggtcactcagtagtattcagagggcttcggggctgctctgaagggtctagtgcagttttagtgatgtgccaggcaccttggtgggtgtattagtccattttcatgctcttaacaaagacatacctgagactgggtcatttttacaggaaagaggtttaatggactcagagttccacatggctggggagcctcgcaatcatggtggaaggcaaggaggagcaagtcacgtcttacatggatggcagcgggcaaaaagagagcttgtgcagggaaactccctgttataaaaccatcagatctcatgagacttactatcatgagaatagcatgagaaagacccacccccatgattcaattacctcccaccaggtccctctcacaacatgtgagaattcaagatgagatttggatggggacacagccaaaccatatcagtgggacaggatggaagctgggctcagagcaacttctctccctttccatgtcatctcagagtctctccaggtttccctccagcaaaagccctcagatttcttacacagtggatcaggggtttaaaaccaagagttccaagaggtgtaaggtggaaactgcatgatcccttaaatgccaggaccagaaccatcatggtgtcacttctatggcaatctattcgtcaaagcagtcacaggccagcccaggctcaggaaaagggaaatagaccccatttctgaatgcatggggtatcaaacagtttgcactcatctttgacctgccacagatacacaagaactgggaggaggggtgggtggaagactgaagcattagagtaagaggggctccttcatcctccggtcatcattttccatgtgcacgtctgacttttttcaaataaaaactggggaaggacaaaaagtggggaggaaccatgtcaataagctgaatcctcatcttctatggcacagagtcaatagaaaatgtcttaaattgataaatcaagaaaaagcctcataagcatcttatttggagttacagagataaataactgaagacctaaaaatggaaacaacatttcaagcacttgcctccgggaaataagacttaaggaggggagagaggagagaaggggccaggaaccgctgctttcattggcagctcctctgtactttaactttgtacgatgtgctcatattactatgattttttttttaaattcaaaagggaaaaaaataagaacaaaatgatgatggttatttttaaaactatgtaattaaacctggaaaaatctcattttgctaaacggaaaaaaagtagcaggatacgaaactatattaatagtatggtcataagtatgtttaataaagaaagagaaaaacatatatgggaggagaaaaatctgaagaaatttacctaccaaatgatagtgggtgggtttctctacttttctaggtttcccacattttcaacaacgtgattctcatactttcctaatgaaaagaaatacattccttacataaaataaattaactgggccgggcgtggtggctcatgcctgtaatcccagcactttgagaggccaaggcgggcagatcacctgaggtcaggagttcaaaactagcctgggcaacatggtgaaaccccgtctctaccaaaaatacaaaaattagccaggtgtggtggtgtgtgggtgtgtgcctgtagttccagctatttgggaggctgaggcaggagaatcgtttgaaccggggaggtgggggctgcagtgagccgagattgcgccactgtactccagcctaggtgacagagtgacattccatctcaaaaaaaaaaatgaaaatggctgggcgccgtggctcacgcctgtaattccagcactttgggaggtcgaggcaggcagatcacgaggtcaggagttcaagaccagcctggccaagatggtgaaaccccgtctctactaaaaatacaaaaattagctgggcatggtggcacttgcctataatcccagctactcgggaggctaaggcagagaattgcttgaacctgggaggcagaggttgcagtgagctgagatcgcgccactgcactccagcctgagtgacagagcaagactccgtctcaaaaaaaaaattaaaaaattaaaaaataaaaataaaataataaaataaatgagccgagcatcaattaaagaaaatgccagaaggttctctgaagaactttccacaatagaagtgtattttaagtccctgagccttcatctcatacctatggacaggggactctttgcactggttctggaacgctccagtccaccatgcccacggatttagttaggaaaccttcccagaaagaacttagtccatgtcatttcaaaatgaattaattcaactcaacaggaacttttgtaagcctccaatgtatgcggttctgaacttttgtaagcctccaatgtttccagttctgaatctggaatgctcattcagccacaaaataaacatttattgagtacctactatgtgccagacaaatgctacttgcaggggtgacaatgatagagacgggcaaaatattcaattctttggagccatagactaatgggagaggcagacaagtgactaggcaagtgtaatacatcctaacagacactttggggaacagacaaggggctgtggaaggaggcaacctggagggcttcctggaaaaggccaaacatgggccaagcgccgtggctcatacctgtaatcccagcactttgggaggttgaggcaggaagatagatcacttgatcctgagagttcgaggccagcctgggtaatatggcgaaacctcatctctacaaaaagtacaaaagttagctgggcatggtggcatgcaactgtagtcccagctactcgggaggctgaggtgggaggatcacttgagcctgggaggttgaggctgcagtgagtcacgattgcaccactgcactccagcctgggtgacagggtgagaccttgtctcaaaaaaaaaaaaaaaaaggccaaatatgagctcagagctcagtctcaagggatgaaccagggcagatcaggttaaaggggaaaagctgttgccagtacagagaatagaatatacaaagacccagaaacaacagagaagatggatacattcaaggaactgagagtgatctcaaaaaaaagatttgtcatgatcagaagagacagtcccaaaccagcactcacttgggggctctgggactggactccctaaattggaatctcagccccatcatgtgagctcaaagtgcttcacctcactgtgcctcagtttccatgtctgtaaaacagggtagaagtagaacttagaagagttataagaattaaactagagaagtgagcattgtttatatgtgcttgttgctatggatccaaaactgccagtaataacaataataataataataatagcttatgctttcgttgagcccttgctttgcacctggccagtgacaggcacattatcagtaacacaaatgcaagtatctcatctaacccttgcatcaacgctcagagatgggttttatcaacatccccattttacagatgaggaaaactgaggcagagcagttgcacaacgtcgcagctgttcctggtgcttcacccagatcctcattgccagtaaaccattcatcattcagcctttgctgatctgtgcctaatggcttataccaatactttctccggagaattccttagctagcaaaagccatttcacccagggagttatgctctcacatgctgaactggccaatgactaagcgatatgaggcgagaggagtcacacaaaagtccagtcctcctgcttcgaggcagaatacactccagagacccacgtgagatcaaggctagccttagcctgagagcccattcttgcttggctctgtcccctcccccatcatcctccttccctcactttccttctcctgagaacccccaccttgaataaaccgcacctacccaaatctcattctcgggcttccaaggaacccaacccgtcacacaacttgcagggattcggaccaggttttctccttccaaagggccaccaagctgcaagctgcaccaggttcatctcaaaatcagagtcatgggatcaaagaacagttgctgatgccaacccctgccggcatgagcccaccgctggggaaacaaggcgaaccagacatctcagactagaggagtgaatccaaggagagaagatgacaggaggtgtatttgttctcacgctgctaataaagacctacccgagactgagtaatttacaaaggaaagagggtgaatggactcacagttccacatggctgaggaggtctcacaatcatggtggaaggccaaagaacagcgaagtcacatgctacacagcggcaggcaagagagcttgcgcagcggaactcccatttataaaaccatcagatctcgtgagacttactcactaccatgagaaccgtatgcggaaactgcccccatgttttaattatctccacctggccctgcccttgacacgtggggattattacaattcaaggtgagtttggatggggatacagccagaccatatcaggagagggcacagcattaggacgcagccggtggtactgtaattcgggtcgggggaggttgctgaaatacactcataagggtagtttaaaaagagcatcatcaaggagacaggctttccagccttggccttcgggagaaagaaagagagagtgaaaaaaacatgggctttaggcctgacgcgtggctcacgcctgtaatcccagcactttgggaggccgaggcgggcggatcacgaggtcaggagttggagaccaacctggccagcatggtgaaacctcgtctatacaaaaaatataaaaaattagctgggcatggtggcacgtgcctgtaatcccaagctgctcgggaggctgaggcaggagaattgcttgaacctggcaggcggaggttgcagtgagccaagatcattgcgctgttgcacaccaacctgggcaacatagcaagactcggtctcaaacaaacaaaaaaaaggggaggggcagggctttagacagatccaagctcaaccctgcaagttgccgggactccgtttctttatctgtaacatggagatcacgatgttcacctcgcagagtagattaagcagctggcatgtgtgaagtgcccagcactgtgtctagcatatgctaggtacttggcatgtgtttctttctttccctcccttgttcaaggccacatagtccatgactggcagagctagaagccttctcatttacccacaatcaaagaacttctacaaaatagaaacagccccctgccccctcctgcccccgcccacctgctaccttaataggttatttcccagttattcaatgcaagagacttagcccagctaaagttattcaaaatcgaccttgagatcaggaacaaattggctacagcagtcagcgattggcaaatgcaatctaaatgccccaggcggcattagagccttccacgttgacaggaagagtcaatgtgcatcttggaaaaatctgagaaaaaaaaattaaaggtcaccgcatttgtaggcagaatgggttttcttgagaccattacaaacagactgcctaaattgcaaagattccaggcttgacagctcccggaggactccagatggaaagaacaccacccccatctcttatacatccaggctgctgtctgtggacgtccgaaggttctcccaccacccatgctattattgaaattccacaatcaacctgcaatgccccagtgaaccattttgctgggatgggaggaccaacttagggccagccctgtgttccaaggggctgaccaggcaggacagccaaggaggcacaagtctgtaagatgggtccaaacatttctgtaggaagggggtcttgagccaaagcaggaaaaatcaaaccccaacacaaagtgtagagagagtcggatcataaatcacacacagacagggtccgagaaacatgggctggggaccagcagatgacaggctaggataattgatcattagaacatctgtgctgtttttgttgtaagaatagtatcaatattaataacaacagctaatatatattgagtggcttctggagccaggcactgtggtaaacttttgcacgtatcctctcacttaatcctcacagtgctctacaaagtgggtactggattcatgcccatttcacagagaacatatctgaggctcagagaggcatctacaaggtcaaccaggtaatcaggaaagccagatttcaagggcttgtccacatcactctatgacatgtggggaactcaagtgtgtgttggcttaactcaaataaatagtacaagttaggctgggcacggtggctcatgcctgtaatcccagcactttgggaggccaaggcaggtggatcacctgaggccaggagtctgagaccagtctggccaaagtggcaaaaccctgtctctactaaaaatacaaaaaattagccaggtatggtggtgggcatctgtaatgcgagctactcaggaggctgagacaggagaattgcttgaaccccgggagacagaaattgcagtaagccaagatcgtgccactgcactccatccagcctgggcaacaagagcgaaactccgtctcaaaaaaaaaaaaaaaaaaaccaaccaacaaacaaacaaaaaaacaaataaatagtaaaagttacttctcaacacgagccagtcattttttaaagtatcttacatttttcttttcctttacttattactttttgaattgacaaacaaaaattgtctataattattgtgtacaacctgatgttttgaaatatgtatacattgcggactggggaaatcaagctaattaacaagtggtggggatgcttcaaatttactctcttggcaatttgcaagaatacaaacacttttattaattatagtcactattttccaaacaaggaaacgaatgcccagtaaaagtacaaagtaacagaactcctcactgaagctggggtcatgggtgaaaaagataaatataggctgggcgccgaggcttatgcctgtaatcccagcactttgggaggcagaggcaggtggatcatctgaggtcaggagttcaagaccagcctggccaacatggtgaaacctcatctctagtaaaaaaaaatacaaaaaaaaaaaaaaaaagctgggtatggtggcaggtgcctgtaatcccagctactcgggaggctgaggcaggagaattgcttgaacccaggaggcagaggttgcagtgagccgtgaacgtgccattgcactccagcctgggtgacaagtgtgaaactccatctcaaaaaaaaagataaaatacaaatacatccatatataattaaaatatgatagtggtgtgttttcctgtttaacaaatatttacttccctctcattcccttcaccatgggaagaacagaatcctctgccccgttagtgatgggtttgttttggccaatggaacatgagcagagctgacggtgcaccagttcccagcttagaccttaaaaggcattgagtatttctgctcactcctctctggaagctgccaaccttcaccaggtaccactgcttctccaatctggacctcagaaataaatgtaagaatcagacttgaactcaacccacagcctaaagcagaatctctccagctaaaccacagacctatgagcaaaaaaaagtgtttatttttataaccatgagggtggtgttacttgttacacagctacaggtaactgatacatttacacgtgaatatgtgcacatactatacatgtgcatattatataggatacatatgtgtggccgtgttacatggaaatagatacatataaatccttaaaatgtatctccatatgtgggatatttatacatatctatttgggagatagtaaatgaggtagaatttggagactgctaaatttgcattcttgcattgacacaagctgtgcattttgggggaaattacttgacatctctgagcacattttctcctttgtaacatggagataaagatgaagcttatctcataggattactgtgagagttgagtaaaataatacacgtaatgggcttagcagggagcctaacacacactcgctcacacccattcattcaataaatgttattgagtaaccacatttgccaggccctcttattggtgtttagaacacagttactagctgtggggaaaaaagcaaaaataaaaaggataaggagagccagcagccccggaggaggagggaggcaggcataggatgtgcctgtgcctggcacgtagtaagtgctcaattattggtagccatttttattctcaaagtgattaacgtgagaacaagggggtcagctggagatttaaaaaacaataatcagtctctctgctccgcagcagacccctgagacccttggcaaaccccagcaatagatcaaggaccttcagtaggtgaatacagtcgcaggaactgctatagctgacacatagtccctgcaactccagccagacgccagcaccagctgccactgggagatgtgagcttggcttctccatgaaagagaaagattcctggggcctcagccatgcctcaaacccactgataacatcaaacacacattgctggggggagccggccaggtgctcagaagctgcagggtgaccctgcatgtaggtgtcgggaagtcagcagcgactcgcgggtggagaaacacccacgcctttgcaaacactcttaatgtaatgcactgcccttgaggccacctcccgtttttttggccctaattggcatgtttttctgtctcctcagaaacagccacgggagacaacattccatagcagttaaaagtgtggtctctgggtttgcaaccagactattccccaccagctgcaaccttgggcgagacacttaaccccaggagcttcccctcccgtggttgtgatgattaaatgagataaccagataaccccttagatggcaaacactcagcacagtgcctgatgctcatcattgtggcttttattacggactcattttataaacgaggacatcaaggcccagacagcttaagccatttgctcaaggtcagaaggtcactctaaccttgccatcaaatcttgggattttctttttcctccatcacaccatccccaactgatctactcctcaagtgaatttcagaaatcctccaaagatgaattttgatctacctagagctgtgctgacttaactggagcatagcacatattttcaaaacaggaggaaacttgaccacagctttgagccatgtggatgataaagtcatcgtaggtgaacttgagactgggattcggcccttgtgtcaattgtgattagcacagagtgaagcagcgtcattctctcgggggtaatacctgagattcgttgcctcataccaaaaacattaaggacacagacacacacaaagagtgagtttaaaagcagaggtttaataggcaaaagaatgagaaaggagaacactgtctctcttccgagaggggggcacccagtgggacttctggcccaagtcagagtgcaccagattttacagggttggggaggcggtgcctgatttactagggcccaaagattggttgcaccaggtgtgacatttacatagcgcatggggaagttggccgccccaccctagtgttactatgcaaatggggtctttgcctggctggctccttgttgcctgctccttactgtacacatggctggcaaagagaagggaagatggaactgccgtgttggacgtgcctagccccagctagccttttcttatgggcggagctgccggcattcacccgtgcaagcttccagcttgcttgcctatgtctgcagcttgattttacaggatgctctccgttagaaaagaaaaatgatttggggactgcttttcattaaaaggaaaaccttactgaggacttccttaccctcactatctgcctaaataatttcttcttaactcttacatcagtaatatgaactcaacagactgaaagtaacaatcagatcacaaacacagatgtctacagagtctggaggttactagggtgactatccatcctggcttgagcactgcaagtcccacactctgggaatccgctcaggcctgggcaaaccaagacagctggtcaccctcgccgtaacataagtgagtaaaggtataaaaagctgtgcctgtctcagcgttttccacttctgagaagcaatcatgtatggtggttaaaagcaaggactctagagccagactcacttggtctataccccacctccgttgcctaccagctgcaggacctcacacaggattacccaacctcaccatgcttccgtttcctcacatataaaatagagatattagagccccctaccctaggtcagcctcaacaccactgacattttggacctgatcgttctttactggggagtctggggacagccctgtgccttgtaggatgtttagcagcatccatggcctctacatactggacgacagtagcacagtataccctagttgtgaccatcaaaaatgtctccagacattgccaaatgtcccttatggggatagaagtgtccccagttgagaaccagtgtcgtaggcagtgttgtgaggataagggaggtggtacatgcaaaatgctgagaaaaagccatgacttggagagtctgtttctacaggaacagccaataaagccttagagatggagcaggaaggtggcaagccaagagctgagcaagcaggaccttggagggaccaagggcagggcagccaagccactgtgaagtggaacaagttctgcaaacggaggccagcccggccaccctccccctcacctctcacacaagattggacttctatttcaccccaggtgcggaaagtggagtgaattactcctcagtttctggcatggcaccacggtgcagtgcaaaaccccctcagctgaggtattcctcttctcttgaatgtgtgcgcattcttgtgaagtgcatttgctcatcaaatattgagtgttcagaatgtggcacgaagacagcggtgaacaaaatagacagaaatccctgccctcttgtagctttaagcatactgtcttgtgtacaaatacatttttaaccaataaaaattgtgtcatactatggtctagatatggtttgttttggcccctgccaagtctcatgttgaaatgtgatccccagtgttggaggtggggcctggtgggaggtgttttggtcatgggggcagatgcctcaggaatggctgggtgccattctctcaagagtgagtgatttcccactcttagttcctgcaagaactgattgtgtgtgcgtgtgtgtgtgtgtttcaagatggaatctcgctctgttgcccagactggagtgcagtggcatgatttcagctcactgcaacctctgcctcccggattccagagattctcctgcctcagcctcccgagtagctgggattacaggcacccgccactacatccagctaatttttgtgtttttatttttttctatttatttatttatttatttatttatttatttatttatttatttattttgggacacagtctcgctctgtcagccaggctggagtgcaatggcaagatctcggctcattgcaacctccacctcctgggttcaagtaattctcccacctcagcctcccaagtagctggagttacaggcaagagccaccatgcctggctaatgtttgtatttttagtacagagagggtttcgacatgttggccaggctggtctcgaactcctgacctcaagtgatccacccacttcggcctcccaaagtgctgggattacaggcataagccactgcatccggccgagaactgatagttaaaaataacctggaaccctcctctgtctcctattcttccctgtctccttcttccttctctcatcctccttcctcatacccctcttctctccctctctctctctctctatcttaccatgtgatctacacacaccagttcctcttcacttctgccatgagtggaagcttcctgaagccctcatcagaagcagatgttggtgccatgattcttgcagaatgatgagccaaataaactttttttctttgtaaattatccagcctcaggtgttcctttatagcagcacaaacaaagacacttgctataaattgattctgttgctcactttttttccccttgtgctttgtttttaagatccatccaggccgggcacagtggctcacgcatgtaatcccagcactttgggaggctgaggtgggtggatcacctgtggtcaggagttcgagaccagcctggccagtatggtgaaaccctgtctctactaaaaatacaacattagccaggtatggtggcgggcgcctgtaatcccagctactcgggaggctgaggcagaattgctggaacccaggaggcggaggttgcagtgagccgagattgcaccattgcaccccagcctgggcaacagagtgagactccatctcaaaataaataaataaataaataaataaaataaaagatccgtccatactggcatgtgaagatcagacctgtttttctaactaccgcagtcatatcccacagtgagtatctgtcatgctttgcttatctatccccttctgatgcgcacagcagtggcttccaataccccgctaccacaaacccacctccttgaacatccttgggtgaaactttctctggggtataaatccaggaggggaattgctgctgctcagtctttaatatgcacaggactcacccagggatcttgttaaaaggcagattttgactcaagaagtctggaaggagactcgagaatttccatttctaacaagctcccaggtgatgctgatgctgctggtctgggaccacagagaatatgcagccttcatttgctttagtgtcagatctctctagaatgaccgcgccagtccacagtccaagggcttgcttttagagggggccaaaccccactggcccccctaacacggtgtagacttgcagggctctgctgagagccaccattaaccacaagcatcatgtccgtattgctaccgttcgtcaatacccttgaccctcttgccttcaggaaccctctatttccaagcacatctccaaatcagagccccaccccctccacaatgcaaagtgggaccatctagaagaacatccagcccaacctcctggctttataaagggagaaaccaagactgagagacttgcaagaaatcacaagaaattcccgtttctttgcatcttactcctccagagccctctttgagtgatcagtaattcgtccacaatttataggacttagttcactttacccatctttttccatctccctgccccaccccactccaccctccccatcccatatcccccagcccaccctgctttttaatccttgctagaatcatccattttgcgaccaagtattgacttcaaatgatatatgagacaattgacatttcaaatattccaggcaggatacagaattctgatcacggcccagtctgaaacatctcctccacatctctttccttattccttctgggcaataattgtccccccaccagcccaccccactcccaacctcgacattaatttcccctgattcatttttcatgcctttgaattctgccttttcaaagcagaatatgtttctgtagctgtttctcatacctcccttcccctcatgaatatttcaaatgcaatagtgatatgatcgttcaaccttaagaggcacaccaactttatcttatttatcttaccgagctgcttccgatcccgggattaagtccaaaacatcctttgagagtttgtttgagttgttttccctcaggctgttgctgctgtgtatgtaaattacaaagagaagcagcctccccctcccctcagccccagccccgggcaccagcccccggcccgagacgcccgccctccctctgccaatccttcctgggagatgcaagacgcgctcctctcaaagccaattggcaggcctccggacgggtccctgccagggcatgtctccctgacttcctccagtggtctcttagaagcccaaaactcaccatgcgaccttgggtagggcgttccgccactcaggcaagtttccccatctacaaacaaggggaatagacacggcgaccctaaagtcctttcagctctgagactccatgtcacgtgatgtaatgtaacagacagagccctacctggttccaatccaagctctactactaaacgagtgatgagatggctcaccaactgtacctaccactgactagctgtgtgacccttaactaactgtacctaccactgactagccgtgtgacccttaactaactgtacctaccactgactagtggtgtgacccttaactaactacacctaccactgactagccgtgtgacccttaactaactgtacctaccacagactagccgtgtgacccttcactaactgtatcaaccactaaactatccatgtgtcttttaattgtatctaccattgactagtcttgtgacccttaactgtctgccactgactagctgtgtaacccctaactaactgtacctaccactgactagccgtgtgacccttaactaactgtacctactactgactagccgtgtgacccttcactaactgtatcaaccactaaactatccatgtgtcttttaattgtgtctaccattgactagtcttgtgacccttaactgtctgccactgactagctgtgtaacccctaactaactgtacctaccactgactagccatgtgacccttaactaactgtacctactactgactagccgtgtgacccttcactaactgtatcaaccactaaactatccatgtgtcttttaattgtgtctaccattgactagtcttgtgacccttaactgtctgccactgactagctgtgtaacccctaactaactgtacctaccactgactagctttgtgacccttaactagctgtacctaccactgactagctttgtgacctttaactaaatatacctgcctctgactagatgtgtggcccttaactaactgtatctaccactaaactatccatgtgtcttaaactatccgtgtgtcttttaactgtctaccattgactagctgtgtgacccttaactgtgtctaccactaactagctgtgtaacccttaactaactgtatctaccactaactagctgtgtaacccttaaatctatcactaactgtgtgacccttaactgtgtccaccactgactacctatgtgacccttaactaacagtatctaccactgactagctgcacaacccttaactatgtcaaccactgactagctgtgtgactcttaactgtttctacaactaactgactgtgggacccttaattgtgtccaccaccgagtcggtatgtaacttgtttctaccactaactagctgtgtgaccatgatgcgagttacagaagttctcagggtctcagtttcctcccctgcagcatgcattggttaacagcagctgcctctggggctgtagtagggtgaccagccatcctctttggtttatctaggaccgaagtggttccaggtatagggaacgctcagtgtcaaatccagtaagtgctaaagccaacacaagtttgtcacccaaggttgtagtgagaactaaaggtgaatgaggtgacatggataaaatctagcacatcaatataagttagtgtcattactattgctattgctattgctttttgtttgtttgtttagagatagagtttcactcctgtcacccaggctggagtacaatggagcgctctcggctcactgcaacctccgcctcctggattcaagtgtttctccatactcagtctcctgagtagctggcattacaggcacccaccaccacgcctggcaatttttgtatttttagtagagacggggttttgccatgttggccaggctggccttgaactcctgacctcaggtgatccacccacctcggcctcccaaagtgctgagattacaggcgtgagccaccatacccggctgctattgttaacggttctgctcatggctataaaggaattttttttcacttctaattttttctagaatttcagatttctctttatcaaagcagtacaagcaaatgatacaaatgacttgaaatggaaaacaaagctgtcttaccccagcccttctcccatcaaatccctctccccaaaggcaggcagttgaagtcctttttagcgactgatcttttaaggctgactctgcctcagtcaccctctgttcccactacttcaggccctcaccacattggccaggctggtcttgaactcctgacctcgtgatcctcccacctcagactcccaaagtgttaggattacaggtgttgagccacagcaccaggtccatcggttttcattaccaccacctgacaggtgagcaggctggttcacactctggtcacctggcatggcttgtcacatactggtgaagctgtcacccgcaaaatccagacctgggactgaggaaagagctaagcgatcctaaagagatacagtctctcaggtggcccttgatgggggcaaagagaggaagggacagttcctcttttatttgtccattcacacatgttgggagccaggcattaaatttgcaagccagaaaaggcaggaaaaaccaagtttatggcttttcaagttggttcagaaattactgtatgggccctccaaaaggtttaatgtctctgtggtgtcatcccaaagagaagcacagagaagcaagaggatctgcagctgaagagcccagaggcaatgaacactcaccttgactctcttctcatttctgaggctctatcagttaaggttcttagtttgcaagcaacagaaccaaatcttttttttttttttttttttttttgagacaaagtctcactctgtcgcccaggctggagtgtagtgcacgatctcggctcactgcaagctctgcctcttgggttcaagcgattcttctccctcagcctcctgagtagctgggagtacaggcacacgccaccatgcccagctaatttttgtatttttagtagagacggagtttcaccatattggccaggctggtctcaaactcctgacctcgtgatctgcccaccttgacctcccaaagtgctgggattacaggcgtgagccaccatgcccagccaacagaaccaaatctttacattaaaaagcggggagcttacaggatcagagaaagaatagagttcccagacttgagggggttccagttggaccatctttgtatggtggtggatctcaaccctcactgcagccaacagtcaaccaaagagacttttagaaaccactgatgctgggccctcaccctcagaaattgagatttaagccgggcatggtggcttatgcctgtaattccaacactgtgggaggccaaggcaggcagatcacttgagcccgggagttcaagaccagcctgggaaacatggcgaaacctcgtctctactaaaaatacaaaaattagctggatgtggtggcgcatgcctgtagtcccagctactcaggagactgaggcaaaaggatagcttgagcccaggaggtggagattgcagtgagccgagattgtaccactgcactccagcctagatgacagagtgagaccctggcagggcaaggcagggcaaggcagagcaaggcaaggcaaaaaggaaagaaactgagatttaactggctcaggtctgtcttgtttcacacctcccctaggtgattctaaggtgaggttgaaaaatgagattcactactctcgggatgcaactgcaccgtgagtccagaaaccagcagtactggcatcaccatctccagtagagctcgtcagaaatgcagactctctctcagaaccaccccagacctttcgagtcagaatctgccctcgaacaagatcctccagttagcgttaagcagattaaaggttgagaagcactaggctgcagggtcatggaatgactggactctaatcactctacatccttgatgatctctccttaagatgcaaattcccagaaggcaggcatttgatgggccatgcttttgtcacaccatgatagaagatctgggcataagaaattctgcagagtggtcccaccagacccacaggcaggagaagggccgtccctgaacggagtgggatgcggggctgataaatactacataggttaagcacagcgaccttcacagttcagagatagtgatgccaactaccacttattaagcacctactgtatgccaagcacagtgccaaggactcaaattactcatggaattccccctataaccatgaagccaatattattattactgctacagctactactactattattttataaaggaagaaactaaggtttagagcagtagatccaactttagcatggatcagaatcacctggaagatttgtaaactcacagacttctggaacctaccctcagagttgctggttctgtaagtctagggtaaagcctgagaatttttatttctagcaagttcccagatgatgctgatgctgtttgtccattcacacatgttgggagccaggcattaaatttgcaagccagaaaaggcagtaaaaaccaagttaatggcctttcaagtcagttcagaaatcactgtacgtgcccccaaaaagggaatgccaaacattaggcaagtccccatcttcacaatgagaacttacccacctcagagagatggtttccccaggaaacaagtgcagatggcattttgcagaaagtgcacattgaaagaaagcaaactggcttagaaatatggttaatgggaattctttggaattcatagcatcaggagagagtcgtttccttctaccacacacctggctgggagggtgacaatgtccttaggagggagagactgggaaacattaataccagagccctggctattatttgcaatgtatagcaatgtttttcctcaaggtagatctttggtgagctgtacacagtaaagctagccattcaggtggaattacatccaactagtcatctccgtcatactaaaacagtaaacaatgcttgaagaagtcagatgcctggcatcaaatctaagatccaccatttactggctgtggtcattaggcaagatgcttaacgtctttgttccttattatcctattttgtaaatgggggaattataataatacctaatctctaggttactggatggactaaatgaaataatgtgtgaaatttttagtaacatagctagaatattacaagctcccaataagtctattgtattagtccatcctcacactgctataaacaactggccaagaatgggtaattgataaacaaaaggggtttaattgactcacaacaggtctgcatggctggggaggcctcaggaaacttacaatcatgacagaaggagaagcagacatcttcacaaggcgataggagggagaagtgagagcacgggaaaaaactgccacgtttaaaaccatcagatctcatgagaactcactcactatcatgagaccagcatgggagaagccgcccccatgagccaatcacatccctccttcgacacatggggcttacagctccctccctcgacgcgacacctggtgattataattcaagatgagatttgggtggagacacacagccaaaccatatcacctattttatttatcataccattattgttattattattattggtggatgtgctggtggcgttaatattgttggcaaaactggaactagctggatctttatcaataattgcaatcatgattctgacatctgaccctttcatgccactggtaggcatgtaaacaggcacaatttttctggaaggtcatttggcaatatgtatcaagagccttacaaatacgcacccattttgacccagaaggtccactcctagaaatttattttaggggagtacatccagttgaggacaaagatgtatgcccaaggaagccatcacattattgcaaatggtaaaaaatgaagtgtcaaccaacagaaaaatgtttctgaaattacactatgttcgtacaatgaaatcttcttccaattattaaaataatgttcatgccttttaattggggtgattgtataattttatatctttataaaaatatatgtatgtaagacttcatatagatgatgaactcaattatgtaaacatatgatagaaaaagagaagggaataatccaaaagccatctgctctgggtcttagaatgggaattcttatggttttgtgcatttttgcagctatttctcaatagtcccctttataatcagagcaggctgggtagaatctggtacaggagattgtggcaaactagataattaacccagagaacattatttctgtctgggtatgccattaagttacaaagaccttttgtaaatgtgggtaataatgaaaagagggctatagtgttggaaaggaagacaggagataaggaggaatgaaaaggagtaggtattatttctacagagtcttgaaagattaagaaaaatgaggcagccagatgcagtggctcacacctgtaatcctaacacttcgggagatcaaggtgggaggattgctggagcccaggagtttgagaccagcctgaatgattgagtaagactcccctctctacaaacaaaatttaaaaaactagccaggcatggtggtgtgcacctatgctcaggaggctgaggtgggaggatcacttgagcccaggaggttgaggctgcagtaagccgtgatcacaccactgcacttcagcctgggtgacagagcaagtccctgcctcagaaaaaaaaaaaagaaagaaagaaacaaaagaaaagaaaagaaaaaatgaagcaaaagataccagcagcattggctgagccctagaggtaatgggaagggttgatggggcaagatcagagacttctgtgatgtttccatttgatgagacaaaactcagcattagcagaattaaagttacctaatctctagattaggaaagggaacagagaaatacctcatggcaacacatggcctttttgagttgcaagttgacagaaactcaagtcaaactggcttcactgagaaattcactctaggtgagatctgtcatcaggttggaggggatacaggctgttaggcagtgtgatcggctttccttctcctctctcagctcggctctcctgtgatttccttctcaggcaggctctcccccagggtgatgagatgaccaccagcagctcccggtttccaccctaccaggtttgcaaccccagcaaaaagagaacccctctttccctatccacctaacagaagtcctgccactgatgctctttgaaccaccttaaaggcaggtttctgaatcaatcacaacagccaggagaatggcattctcccatctgccaagcccagtctctcgagtcacccaaaacacatgggctgagaatggaggagaggtcccacctctcccccaaaaaagtgagatactggtctaagaaacagaaaaacgaagcttacataggctaaatgaacccagaagcactatgtggagtttttccttccagaacatgaaccaagtactcaagttacccccagatggtatcagaaggaaggattcaacagtgcccttaaaaaagggccatagttctcaaccaggggtgattcctcctcctcccctcaggggacatttggcaatgacaatggggcagggggttgtgctactggcatctagtgggcagagtgtagggatgctgctacacaccttacagtgcacaggacaaccctcacccaaaggattatctagcccaaaatgtccacagtgctgagactgtgaaacccagaattaggatgaccttataagttatcgcccaaaccagaatgctttcgagacaggcaaaaccaggaaagcagtcgtaacagggactgttgcagcaaatgaggacatatggttaccctactctcaacacaccgtccaaacagaaggcaaagccattctcactgaaggctgtgattcaagggaaacgtttcaatgctccccaccccaatcatcaattacaggaccacagagatgctcttcccagccgaggcttgtctttgaccccttctgctctctcccacttccggcatggctgacagtccctcccatctacttctaagaggtcactaaaaatcgaccagggcttgccagcctagtggggttgcccaaatgtctgcccacagatgccgcttcgaaaagctgtctctggcatggcccctactgcagcggcgcgtgacagactgccttgcttggtggaaggaatcccaccccaattaaattgctggagccctgctgggaaggaggtggaggcgggaggagaaggagagtagggagccgggcaagccactcctgcctctcctttttcatctcggaagagccaatttcaagcttgcctcgggtcataaaagaaattaatttgattctctcaaccttgctcagagtggacacacgtcttcggctggagcatctgctgctgctggatccagagcgaggagaccatcccctcgaaacgattccatttctgttgcaaggcagggccaaaatcatctgcctggagctggagaagcagctgcctggaataccctgggctgtcatttttgctggtaagatcgaaaaacggttctcacagctaaggtgactcccaagttgcaggaggtttacccagagagatactcatgggtagggctggttcttggaaaactcccaaacagaatttagcagtggcagctgcctaacccacttcatattgatcagcttgatcacactgagtcctcttaactgtcaggcatggcccctgggctgtattcctgattgcacacagctaaggtgactcccttgtacaagcctccccgcctgagagaggatggaacttgtgacctgcttctaatcaacagaatatggcaaaggtgccgaatgtcactctcttgatcatatttcatcaaataagatttccccttaggagacttagggactcccttgctggctaggaggaagtaagctaccatgttgtgacagggccatgtcaaagaatgcaggtggcctctagaagctgatagaggtccccagctgacagccagcaagaaaacaaggcctcagccaggtgcagtggctcacacctatcatcccagcaatttgggaggctgaggcaggaggatcgattgagcacaggagttagagaccagcctgggcaacatacagaaacctcatctctaccaacaatttaaaaattagccgcgcgtgaaggcacctgcctgtggtcccagctacttggcaggctgagatgggatgatcccttgaatctaggagttaaaggctgcagtgagctacaacttaccactgcactccagctcgggtaacagaacaagaggctgtctcaaaataataataataataataataataataataataataataataataataattttatttaaaagaaaaagaaaacaagaacccagctttacaactacaaggtaagtcaccagcaactgccatgaggacccattgtctaaatcttttaatgtaaaataaaactacattagaaaccacacaaaccaaatgtgtagcttcttcagcctttccttatttttctaaggttgtacaaaactattgtatttacaaaaatggcacaaaagtgaattcagcagtcaattcacatgcatacttccctcacatcttcaacaacaaaaggtattctaactccaactctacagagcttggcagttttcaggagtactggggacggattttgcaggatatatctctgtattagtccattttcatgctgctgataaagacatacctgagactgggcaatttacaaaagaaagaggtttattggacttacagttccacgtggctgtggaggcctcacaaacatggtggaaggcaaggaggagcaagtcacatctgatgtggatggcagcaggcaaaaagagcttgtgcagggaaattcccatttttaaaaaccatcagatctcataagactaattcactatcacgagaacagcacgggaaaaacctgtccccatgattcaatcatctcccaccaggtccctcccacaacacgtgggaattatgggagccacaagatgagatttggaacacagagccaaaccgtattagcctccatttgagtttgtctgatttttttcttttttcatgattagactcaggtcatgagtttttgcaaagaataccacagaggtgaagtgcccttcttttccaagcttgtcactcatccatggtgtggttcaaactttcccttgtctgtgatgttcctgcaactagttctagacttttagactgcaataatctcattataaggtacagagctcattcaagaaggataaggggcatattgatttcctaaggatgattaacaaaacagcacaaacgaggtggcttgaaacaagagaaatttattctctcacaattcttgagggaagaagtccaaaatcaaggggttcacagagctgtaccccgagcctctggggaagatcccatcctttcctttcctggcttctggtaaccataggcattcctgggcttgtagcagcttcacttcaatctctaccttgtgctcacttcggcagcacgtacattaaaatggaacttcaatcgctatccccattgtcacaagggggtcttccctgtgggtctgtgtccaaatttcctacttcttctaaggacaatctcgtattagattaagggcccaccctactccagtatcacatcttcgtaattacatctgcaatgaccctgtttccaacagaggtcacattctggggtactgagatgttagggctttcaacatatctctttggagaacacagttcaacctattaaataaagcatcccacaaaaccaaagtcagaaagcacagcagggttttgggatagaaagatagcaggagtcaacacagcctgtctctgtctttctgggagctcccggtctgtccttcctaagtctgtattgtgtcctcaatctcttctttctttctctctctctctctctctcactctctctcccccatcttctcgctccccatctccctctctccctctctctctctccgcccccccatgtattactctgttttcacaatgctaataaagacatacccaagactgagtaatttataaagaaaaagagtggtcacggactcccagttccacatggctttggagatctcacaattgtggcagaagacgaatgaggagcaaagtcacgtcttacatggtggcaggcaagagagtgtgtgcaggggaactcccctttttaaagccatcagatctcgtgagacctattcactatcacaagaacagcatgggaaaaacccgccccacgattcaattacctcccaccatgtccctccgatgacatgtggaaattatgggagctacaatttgagatttaggtggggacacagccaaaccatatcaccctgcatatcagttttttctattgcaattgtccacaggccaaacatgactatattgtcaccaactttctatccccctctagtttcaagcaccttccagagataagctcagagattttcaactccaaatttctgggagagagtccacatggcctggctgtaatcccatatccaaccccttggtacacagccatggccagagccaaaagaatcctatggggttctggatctcctagggctctgggaagggcaagtttctgaaggaggaatgggggtggacaaaaattattggctgagaaaatagctggtgaacgagacattatttctggtagggaatgaatgcaagaggccactatgttctggagcacagagaaaactcccactggattctcaggaccgtctgagaggagaggaatttgaaagcagctgaattatcacaggagaaacagaatggagtcagaaaaattctgctttgtggcacttagatcaattctatgtctcatatctttgggagcatgggtggtttcccccaccctccattttcctcttctctctgaacaaaagttttagtttgtgaagtcaaatctcatctttttttttttttttttttttgagacagtctcactctgtcacccaggctggagtacaagtggtatgatctcggctcactgcaacttccgtctccaaggttcaagtgattctcctgcctcaacctccagagtactgggattacaggtgtgcaccaccacaccttgctaatttttatatttttagtaaagacagggtttcaccatgttggccaggctggtcttgaactcctggcctcaggtgatccacccaccttggcctcccaaagtgctgggattacaggaatgagccaccacacccagcccaaaccttgtcatttctgaaatagagtgtcagggtagtgtcttagttagcttgagctgctataacaaattataatagactgtgaagcttaaacaacagcaatttatttctcacagttctgggggctgggaagtctgagatcagggtgctggcatggtcagggtctggtgaggactctctcctggcttgcagatggctgccttctcactgtgtcctcatgtggtggagagacgggtatcatctctctcatatctcttcttacaagggcactaatcctattcatgagggctccaccctcatgatctcattactttccaaaggcctcacctcctgataccatcacactgggggttagacttcagcctatgaatctgagggcaacacaaccactgtctgttagttcacggcagacagtgaaatagtggaaaggagggtgtgattgattctggggagggctggtgttgaactctgactgcaggataaagccctcattggttctctgggccccggtaactgcccatctccccaagagggttcccacatccatttcctcccactctgggagtgagcccagcccagcatttcatcaacaactgatctcaggagccaaaagacacagggagagtatggtgatcagggagctgaggaagagggtgaaaaaaggcaaggggtgccaagcaactcaaccagcacttcccctccatcttctgctggatttgctcctttgtctccccagcaggtaggagggattgtccaagacaaagcattggttaccatctttctgtgccaaggctctgggagacaagactggattgcggtcttccttccttattgtacttattgtctaaccttaaggtacttccttatggtaccattttcacacgctgataaagacatacccccacaccccagactgagtaatttataaggaaaaataggtttaatggattcacagttccacatggctggggaagccttacaatcatagcggaagacaaaaggcacatcttacatggcagcaggcaagagagaatgagagccaagcagagggggaaaccccttataaaaccatcagctcttatcagacttatttactaccatgagaacagtatgggggaactgcccccatgattcaattatctcccactgggtccctcccatgacacatgggaattatgggagctagaattcaagatgagatttgggtggggacacagcaaaaccatatcacttattctgtaggaaatgacttccaaggcattctccacccctgtctacatctgacagatagaattatatttaactatatattagtatattactatgacaataataactcatttattcctcacaccaaccctgtgctatccccgtttaaagatgagaaaacagaggcacagaaggtttgagtattatgcccaagatcattcagctgataaatgccatatccatctaactccaaatcccttgtggttgtacagtcagctgagctggcttttggataaaattggttggaggtgaatagagagaatgggttgggggaaagtggtggatgcccccagcaggtgtctcagaaataatgtgttgtcattttcactgtgaatatctcaggctcaagaataaaattacttttctatataatgatttgcaatagtcatgattctttatgatgaaaatataacccaaatcaaacttgcctaagcaaaaaaatatatatataacataaaattcaccttcaagggatggggctggagttacccccggaagcaagaagaaaaattatgcagagcacctggtatatccatcagagaccaccaatgtgttcctgtcactccaacaggaagcagagaacccaaggctgtgttggcaagtagaagaccctagggacccagagggcccagagagcccagggattcccagtgcaaaccctcagatgccttggtgccttaaggaaaaacacactagcctcatgctgcctaacttcagcaagaaaaaaaaggaccattcccttaatacaagcctcaattgccctgatgccttatggctgttattttagagaattataatgccacctatgattaataccgcaatgtggtcacacagcaaacgctcataagtaacctcccagcataaataccaagaaaatccagacttaccacggcttcatatacattttagatttttgctaaattggcccttgataaagcgtgtggccaccttaatcacagaaatcagcttcctccccaggcctaaaattagaagccccaactgccagtcgttaggtacagagctcaatgcctgctgagattcccctctcatttatcttctgcggggagcatttcaagttatcgccagctctcgtatcagctggcccggggaagggcagcaggcagcgagaggggcagctaacataggaagaggtcagcaggtgaggggtggctctggaggcggtggaactggctggtccctggaaagcttcccgctgcaggtctagagtggagaactcggactccaacagggaagactgtggctgggaagaattacagaccagatccagggctggattctgaatttagatggggcccgtaacaatttgcctaaatgatttatttcaacaatcaacacatccatatgctcagccactcagaatgatgactgaaataaaaatgaaaggtaacaggctgggcatggtggctcacacctgtaatcccagcactttaggaggccgaggtgggaggattgcttgagcccaggaattcaagaccagccctggcaatatagtgagactgcatctctacaaaaaaaaaaaaaaaaaaaaaagagcaagagaaagagagaattggatgcatgctataacagcctatgatggtagatccagctggtctggggaaaaaggagagtatccaactaggcttccccaaggtcatgaatttttttttttttttgagacagtctcactctgtcacccaggatgaggtgcaatggtgcaattacagttcactgcagcctcgaccttccaggctcacatgattctcccacctcaacatcctaagtagctgggactacaggcatgcagcaccacatgcagctaattttttgatttttttttcttttggtagagatggggtctcacttcattgcccaggctggtctctaactcctgggctcaagcgaacctcccacctcagcctcccaaagtgctgggattacaggtgtcagccatcatgcctggccagatgatgacatttaagctaagactaggacaatgaggagttatccaggtgtcaagtgagaggaatgcatttatacagagatagtaacatgtgcaaaggccctggggtgagaaggagttccatgtgttgaaggaattggaatgttgggaggaatgaaaagggtgtggcaaaatatgtgggctggggagggaggcaggggctagctcaggcaggatgagataaactctggtaagggttgtatgtgctcacagaaactcattaacacttcactgaatgctaatatttatttatcaggtttcagagtctgtttgttcgtgaggggagggttttccatcttctccacttgaatataaactccttgaaggcaatgacctttggttcacagttctatcaccagcacctagaacaagaactagaacaaaggcaaataaagacacccttatcaggcacaatgttgcaaagacttagtggttatcttccaggagccagtgaagggccagacctttcttaggaatgtgcaggatttgaactccccagacctgctgagtcaactctactgcaggggaccatacagagatgagaaagatgcgacattctttcacttctgggtagcagagtcaacaaatggaaccagggtgcccccaacgcccgttacctatgacatcttcctctgaaataagctcaacagaagatggtccctggctacagtgacttttgtcagggatctccaagaccgccctcaggcccattgatttgccagaaggacccacagaatcaggaaagccattgtcctcatgaacattgtttattgcactaaaaggatacagattaaaatcaaccaaggtacaagatgcataggtctctccaagagagaccaggggtaagtttccagtagttttctcccagtggagttagaaggatagctcctaatgctctgtattagtctgttttcatgctgctgataaagacacacccgagactgggtaatttatgaaaaaaaaaagaggtttaatggactcgcagttccacgtgactagggaggcctcacaatcatggcagaagagcaagggagagcaaagggatgtcttacatggcggctggcaaagagagaatgagagccaagtgaaaggggttctccttataaaaccatcagatcttgtgagacttattcactgccatgaaaacagtatgggggaaaccactcctgtgattcaattacttcccactgggtccctctcacaacacgtaggaattgtgggggctacaattcaagatgagatttgggtggggacacagccaagctataagagacaattagcaatgtatacaaagtactgccagccacagcagctcccccaagccttggtgtccaggggttttatcagcatttcatcacccaggcatggagcacctgcatgggtgacttttgttactcagtctccagcccctctagaggtcaaactgacacatacaaaaacaggcactcaccataaattgcattgttagcatggactagctagctcagcctgaggccataggtaaacaaagacactcttatcaggcagaatgttccaaagacttggcggttatctcccaggagccagtcaagggccagagctttctttggaatgtgcaggatttgaactccccagaccggctgagtcaactccttactgcatggggaccatatagagatgagaaagatgccatattctttcacttctgggtagcagagtcaacaaatggaccaggctgaacgaagacagtcaggtagaaccagaaaccacctccacctgcacccctgcataggacctaaaaaaatgtcataggaccatgacaacttttttgagacagggtctcagtctgccacccaggatgaagagcagtggtgcaatcatagctcactgcagcctcaacctcccgggctaatgctatcctcccatctcagcctcccaagtagctgggggcatgtaccacatctggctaattttttgacttttttttttttttttggagagatggggtctcacttcgttgcccaggccggtctctaactcctgggctcatcaggagttagatgatcacccagatgaacaacagggacctcatccctccccaggggtcctggggtaggaccctcagcagatgagaggagtagctctcctggcccatacccatgccctgttgtggtgtttataagcctgtcataggtcaggtttctagagagacaagctgtgggatggagatctgggtgcagggggtttactgggaggagcacctgctggaaagcaaggaagcagcattgggcagagaggggagtggcactgtggaacagtcgccaggacccctgagacaccccctgtgatggttaatactgagtgtcaacttaattggattgaaggatacaaagtattgtttctggatgtgtctgtgagggtgttgccaaaaaagattaatatttgagtcagtggactaggaaaagcagacccaccctcaatctgggtgggcaccatctaatcagctgtcagcatagctagaatataagcaggcagagcagcatggaagggcttgactggctgagtcttccagccttcatctttctctcgtgctggatgcttcctgccctcgaacatcggactctgagttcttcagctttgggactcttggacctttgaccacagactgaaggctgcactgttagcgtccctacttttgaggctttgggaattggactggcttccttgctcctcagcttgcagatggcctattgtgagagctcacctggtaatcgtgtgagtcaatactccttaatcaactccccttttcatatacatctgtcctattagttctgtccccctagagaatgctgactaatacactcccatatggaggggcaagggacagagcctttgtaaccctccaggattatgggatgcctaggaggggaggaggatttcccagcactaggtggcttcctacaggtgccttcttgccagaggcaggactttgctatgagctgttagcagccaggtctcccagcagctggggggacagagggcctcggtggtcctgcacagaggtctgagtggtatagcaccgacagcgaagctagtgaccaaagtggaaagacagagatatgaaaatctttcaactaattaagatttaaaactcagattgatgtgagaatcctgaattgactgtttaccaaagagactaggttttaaatgagaagggtctgggtttacattgacttggcaagactgagtgtcctatcactggagtgacaagggaggctggtggggatggatccagggaaaagaagcaaagtatggaacaaagaagtttagaataaagaaagtggccaaggctgggcgccacagttcacacctgtaatcccagggtggccaaggcaggaagattgcttgagcccagaagttcaaggctgcagtgagctatgatcatgccactgcactccagcctgggtagcaaagcaagaaaaaaaaaaaaagcaagaaaggaagggagggatggaggaaggaaggaagggagggagggaaagagagagagaaagaggaaagaaagaaaaagaaagaagaagaaagaaagaagaaagagaaagagagaaagaaagaaagaaagaaagaaaggaaggaaggaaggaaggaaggaaggaaggaaggaaggaagaaagaaagaaagaaagaaagaaagaaagaaagaaagaaagaaagaaagaaagaaagagacagacagaaagaaagaaagaaagaaagaaagaaagaaagaaagaaagaaagaaagaggcatcaaacctcacaggttgaggtaactgtaaatacacggtagtttatccctgagcacaaaatctcaatggcacagtcaaagccccaaagaagtaagaaacaaacatcatttccaccttttgggcctgaagaagcaggtacattagagaagggcagccacaatatctgtgaacagtcattaagctctcagacacagcatcccaccttcaccaatctgatctccttgatgggggtgatgctccctccaagataacaaagaaaacctggccaggcacggtggcccgcgtctgtaatcccagcattttggaaggctgaggcaggaggattgctagagcccaggagttcaagaccagcctgggcaacatagtgagacccccgtctcttaataaaataagaaaaaagaaaagaaaaccttccttttacatgaaggcatcataccttaaatgcacatcctatctgcccaggaggcccacctctagatttgtatcctactgatgaacacacaccaagatggacatactagcataaattgtggagaatgacagaaaatatcctgaatgtccaccatgagggaactgattaatttatacacatccatatactggaatactacacagctgataaaaagaataaggaatgtctatatggactgctatgcaaaaacctcaaagatatattgttgaatgaagtcaagatgcagtgtaatatgtacaatgggctatcatttataaaaccgggaggagacatatatacatatgtttttctatataaagattgtatctctggaaagtttcaagagaagccagcaacacttgtgaccttggagaagaagaactggtggttgggatggaaaacaaacttaattttcactgtatactttttctggtactgtttaattttttttttttaccatatgcacacgtttcctattcaaaagagaatttttttgaataggaaacaatgaaaaatcttgtaggcatacaaactaaattaattagccatccctatagcttcaacatgcatttcaatttgcaagcaccctggcctccaagattgattgattggctgtaaattgagaacctcagcaatttcctttcacagggacagatgttgacattgttcctgtgatttttcacagatgtttgccttccagcatctttaaaatcgagttttctgtcaatttggaaatcccaaatttctcatatcaaatcgagatgtcaggaaaatcaaaaccgttatcacattttgaaagagtttatggatggcaaatgacactgggaagggagatgtttaaggagcagctgacgtctcttaaccctttctcatcacttcctgcctcagtttacctaagccagaaaaaggggaaatttgattcaatatacagacaagggctttagagtctgcgtagctgtgcgatctcactttggctccaactctctagctgtgatactttgaaccagttcattaacttgcccagcctcctctctctcatctgtaaaatggggataatatccccagccttgcagtgtgattttacaattcactgatgcaaaaatggaaaatgcgtggcacttagcaccacctaaatgtttttttccttttttttttcccctttccctcctccttcaccaatcctccaagcagcttttcttccttcttcacgtccccattttgctcacgagattccaagatttacccactgaagctctcatgagattcccagatttacccattgttgagaaatcagaaacatcccccaccccctagaattctcctgacctgtgtcccctccccttaggactctgctctccctcagtggcaacaggcaggaatatgatctactcatacaaaccaaacctctgctgtttgtacatcttagctaataatgcccaacacgcagccaacatttactaagtcaggctcttgagagccacttcatctgcatgacgccacaaaatcctctcagttattatttctgttttagagatatggaaatgagcaccagaggtagatgtaacttgacaaatatctgggtggtagatctggaaatcaaagaaccctgaaccccaaccacagacacatgttcagttcaggctgggtctctacgctttgttatttttaacggggcattacgctccctggatggctatgacgctgcggttaactctgctcttgtggatgaatgcaattatctggggagctcgcacttataagatgtacagctatgggcaacctaaggcacatcgtggagtcttaatttcctcatctgtcaaatgagaatagcaaggatggcagggagggattaaggagcatttttggaaaaggaagtgctatgaaatgaacgtttgtgcctccacccccaaactgatatgtcgaagctgacaccctaattaccagtgttacggtatttgggtatttgaagatgcggctttggtgattatgtttagatgagatcataagcctaaggtcctggagatgcgatgtgtccatattagaagagacaccagagatatctttctctgtctctcactcttgcttgatctctccctctctctctcgcactctctctcatgctggcgtgctctctctctcccctgtgaggatacaacaagaaggcttccaactgaaagccacaaagagggccctcactggagaaacaaatcacccagcaccttgatcttcgaattcccagcccccagaatagtgaacaataaatgtctcctgtttaagccacgtagtatgtggtattttgtatggcagcctgagcagactgccacagtagatggttggtccttcctccaaccaataatagatggcttgtcctttccatcgcccaccttgggcaaggcaaacaggacagtgaaggcaagcacatctcacagaccccagcattcatgtgctaatgaggctcactactagtattggaaagatgggaagtcaaacagaattatgtccttgcgaacatacaataacttggaaaattttattgaaagacattaagtttgcatacacacaaaaatgagtgaagagttttttgttccattgaataatttagaggacatgtaagagaacacaagtttgaaatcttattatattttgtataatgatacataataatttccatgataaagctgatgtgtattgaggagatcatatgtgccaagcactcactgtgtgttaagcatattctattcattgtatcatttaatcctcaaaatatgatcaccgcctgtattgattggggttttccagagaaacagaaccaatgtctaaacagagagagatttcacgcaattatggaggctaacaagtgctgtcatctgcagggcgaggcagcaaactggagaccccagagaactgatggtgttagttccagtcctaaggccagcaggctcgaaacccggaaagagcagtgtttcagtctgagtacaaaggcagaaaaaagccaatggtgcagtttaaaaaccttcaggcaggaggaattctctcttacttcggaaaggaccgacttttgctctattcaggtcttccgtggattggatgaagtccacccacattaggaggggcaactgctttcctcaatctgccaatttaaatgacaatcatcccaaaacgccctcacgaacacacccaaaatgatgtttaggcaaatagctgtgcacctgtatccctaagagttaacacataaaacctaccaacccatcactctttccaaatagaaaaagtgaggctcagagaggttaagtcacttccccaaagtcacagagcttcttataagtggtggagggtttgactgaggacccatgctctattgtaatcatagaaaatcctagtggaattttccaatagaataaaatgcctgcccagctgcagccaaacgttccatagacaatgtctctgggccttttgtggcagaaaaaccaacataaggaaaagaaggccggagacgccagttttatcaaactcccataaggtaaagggaaatatctttctggggaaaggagactaaaggagaaaattaacagccacttttcagggagagagaaagagcagggacccagcccctctgagactgtgggctgggtgtggcctgagctgattggcagctccattgtaactatactgtaaaggaatgactctaccgaaactgagctaaaggagagtttgaagcatttttaaaaactctgcccaggccaggcgtggtggctcatgcctgtaatctcagcactttgggaagctgaggcaggcagatcatttgagatcaggagttcaagaccagcctggacaacatggtgaaacctcatctctactaaaaatacaaaaattagctgaacatggtggtggacacctgtaatcccagctacttgggaggctgaggcaggagaatcacttgaacccaagaggcagaggttgcggtgaaccaagactgcgccactgcactccagcctgggtgacagagcgagactctgtccaaaaaaaaaaaaaaaaaattctcagacaaccagcagtgatacaagagataaaaggcatctggctttacgctgcaaacaaaacggaaacaggaagtgagagagcagttggcctctaagaagcatccatttattttaccctgccaggtgcctacaaggtgatggttttgcctcccaaatataatcaggggcccaatctctgcattcaaagaagtatatttcagcaacccataagtaatccaaaagcagttccccacacatcagctcaaacagtgttacagggcaggcattcttggtgccatcagatccaatgtcccatgttttaaccaacaattgaaaagccctcttttttttttgagacagggtctcactctatagtccaggctggagggcagtggtgggatcttggctcattgcaacctccacctcctgagttcaagcgattctcgtgcctcagcctcccgagtagctgggattacagatgcgtgccaccatgcccggtacattgttttttttgtatttttggtagagacagggtttcaccatgttggccaggctggtctcgaactcctgacctcaaatgatccaccagcctcagcctcccaaagtgctgggattataggcgtgagccaccatgcccagctgaaaagctctcttttctaccctgaaaaaaaaaaaatgtgctgatcctataacccatctactcttctaaccaatcacaattgtgccctaattataataaaaaggagaaatgaaatgatgaggatttctaatgaaataatatatagagaaatgatttgggtttccaccaggaaagacggagcgaagcagtcaagtgctcacacacgtgtgtgtagaataaccagtgacagtcacaaacgcagacagcgtggtgtgttgtcgcatcggctttactgagagtgccatgttcttcaaaagagtggctctttcttgataaattcccataccaaacagagtcaaatcttctcttgatttacaccatagctgctacattcttggaaacatcagtgttcattcaacacttacatgtaaaatagaacatgtaaacatataaaatagaataggcagataaaatagaagaaggttggaccgggcgtggtggctcacacctgtaatcctagcactttgggaggccgaggtgggccgatcacaagatcaagagagcaagaccatcctggccaacagggtgaaactccgtctctactaaaaatacaaaaattagctggacgtggtagtacccgcctgtagtcccacctactcgggaggctgaggcaggagaatcgctggaaccggggaggcagaggttgcagtgagccgagatggcaccactgcactccagcctgggtgacagagtgagactctgtttcaaaaaaaaaaaaaaaaaatagaacaaggttatagactctgataatcatggttcttctaacccatatgaatttgggatctacacatatatatattcaaaaaactaccccacaccgtaatgactcccccatccctatcattagggcaaccaaaagctctctgcagatttaaaacacacacacacacacacacaaacacacacacacacaaacacacacacacaaacacacacacacacacaaacacacagacacacacacaaacacacacacacacaaacacacacacacacacaaacacacacacacgggacaattcagtccccagtgagaacctctgtaataaaaggtccaattcctaacctgcaataatattctttttttttttttttgagacagagtctcgctgtcgcccgggctggagtgcagtggtgcgacctcagctcactgcaagctccgcctcccaggttcacgccattctcctgcctcagcctcccgagtagctgggactacaggcatccgccaccatggccggctacttttttgtatttttagtagagacggggtttcactgtgttagccaggatggtctccatctactgacctcgtgatctgcccgcctcagcctccaaagtgctgggattacaggcgtgagccaccacgactggcccacaataatattcttaaagtcccctttcccgcctcctcagttctcccacaattcccagtttccccagaacaaaccccaagagatttctctgcccttccccccacccccaggcagagatgtcttccaactcttccccagcactgtaactctccactctggtcaagtggactccaccttggggaaagaatgtttgtaccgggcaccaaactagactttggagatacactagttcttagtatctgctagtatctgctactgtgataattaaggtaattatttagaccaggaatctgcaaaatacagcctgaaggccaaatccgagctgcctgttttcctatggcctgaaagctaagaaagaatggttcttacattttatattattattattattattattattattattattattattattattattattttgagatggagtctcgctctgtcgcccaggctggagtgcagtggcaccatctcagctcactgcaacatctgcctgccaggctcaagcgattctactgcctcagcctcctgagtagttggaattacaggcacctgccaccacacccggctaatttttgtatttttagtagagacagggctttaccatgttgtccaggctggtctcgaactcctgacctcaggtcatccgcccacctcggcctcccaaagtactgggattacaggcatgagccactgcgcccagctagttcttacattttaaatagttagtgggaaaaagacaaaaggaataatacgtcattacatgacaattatatgaaattccaatttcagagtttataaataaagtattgtctgtggctgcttttgcactacaatggcagggttgcatggttgcaagagagcacatggcccccaaagcctcagataatccactatctgggcctttacagtaaggttgtcagcccctggcttaggcactaaacaggtgctttcaagcacctactatatgccagacactaaagtaatagagaggggagacaatcaacaagaagcattctttctcaaaagttttaggctgggcacagtggctaaagcctataatcccagtactttgggaggtcgcggcaggagggtcaattgaatgcaggagtccaagaccagcctaggcaacatagtaagaccccgtctcctcaaaaaatgcaaaaaaaaaaaaaaaaattagttgagcatggcagtgtgtgcctgtagtcccaggtagttgggaggctgaggtgggaggatcacttgagcccaggaggtcaaggctgcagtgagccaagccatgatggtgcaatggcactgcagcctgggagacagagtgagaccctgtctcaaataaataaataagtaaattaattaattaattaattaaattaaaagcatgttattcagaatcacatagacttgggctcagctcttcagccataagcatgtttcttttctctttttctttttttttttttttttgttgagacagagccttgctctgtcacccaggttggagtgcagtggcacgatcttggctgactgcaacctccacctcatgaggtcaagcgattctcctacctcagcttcctgagtagctgggattacaggcacgtgccacgatgatcggctaatatttgtttttctttctttttttttttttttttgagacggagtttcgctctttttgcccaggctggagtgcaatggtgcaatctcagctcactgcaacctcctgccttccgggttcaagcgattctcctgtctcagcttcccgagtaactgggattacaggcgcatgccaccacacctggcctaatgtttgtatttttagtagagacagggtttcaccatgttggccaggctggtctcgaatgctgaacctcatgatccgcccacctcagcctcccaaagtgctgggattacaagcgtgagccaccgcgcccggcccatgagcatgtttcttgacctcagtttccccttctgtaaagcatggtgtggattgttcacctcgcatgggcatgtgaatatcaaatgagacatcctgtgcaatgtgcctcagacaaagaaaggagatcagcaaataatatttcctttctagttcatcctctcttcccatgtatgccaagaaagcaggcgagattgagtgagggaggtcatatcctctttgtctaaatgttttcttgttagagaacatctttcttcttaacatcccttcctacataaagaatctctgtcagaggaatattaaaaggccctaacctacagttagatggaaggcgagactccgatctcacagctgaatcactttagtctacctctctacccatctaatgttacccccttcaaaaataataataataatatgaaagttgggaagtggaaaaccatcctctggagttttcaaaaactaattccgttgtaatcatagaagactgaaggcaggattcatgtcacatttctcttcctcctgggcagatgaatctacaatttgtatttgattttaaatgtgattctcctgcatcttcagtgggtttgattgatagagcacatggggccactcagtaaaatgatacagtggagatcaaagccggagagataatttttgccaaaatgtctgcagccgacagtgagttataagcctttgtctcccactttacggaacacaattttatttaaagccgaaatctgtcactttggtattgtttattgaaatgcatcccataccacggtcccgtgaagaacaacgtcaagtcaaaaggtaaaaaaatccaatggttacaaacagcccaggaccaaataaaggagggagaatgcttccaatctgcataaatattacccaccagtgatgcatttggggcaagcaatgaagtcattcatctgcaaagtaaatatctggcattgtcagaggtgcctgacacagccccataaacccagtgagttctgttccattcagcagctcacacatctctatttgataactttgctttatttatgggtccacaatgggagtcataactgggtttttatctttgcacaacttttttactttattttttgagacagggtctcactctgtcacccaggctggaagtgcagtggtgtgatcacagctcactgcagcctcgacctcctgtgcccaagcaatcctcccacctcagcctcccaagtagatgggattacagaaatgcacttccacaccttgctaatttatattagtttttgtagagacgggctctccctaggttgctcaggctggtcttgaactcctgggctcaagtgatcctcccacctaggccttccaagtagctgggactacagatgcacaccaccatacccagctaatttttaaattttttatagaaaaggagtctcactatgttgcccaggctagtctcaaactcctggcctcaagacattctcccaccttggcctcccaaattgctgagattacaggtgtgagccactgtgcccagcttgcacagcttttttaaaccttttttttttttttgcattcattcacgcttttcatacatcatgattgaggatctaccctgcagactgtatggagttatctagaaggcaggaaggcagagaactaaaacctttggttaaaatatctggggttgagctcagtgtttcctgctctccagctatgtgaccttgatcgggtctcttcacctgtctgaacctcagtttccccactgcaaagtggagagcaaatgagaccatggacttggaaatgcttcatacatttctgagtgcctcacagatatgaagcccaaagatagcaccattctaggctctgtcaggacaatgaggccaaagttgtcactgatgccataaagttgtctctacagcgaaaggtccctggaattagcaggaggcttttgtggagcaaatgcctccttttctgcgtagaaagtgagatgcctcaatcactctgcctagatgcctctagatgcctcaattcctctgccaccaacagactctgtgacattgggtcacttttgagattcctgggtcctgcctacttcaccagaatgtcatgttctggaaccttctcagtctccaacctcatcactcacaagcttttcttatgctttgatagatgctacgattgcttgtcaaaaaaagagcctctcttctccgttgctaagagaaccccaatttttaaagtattgaacagtcacatgctttaggagaagttgcccttctgagcctcaaggagtgaatcttgactgacctaaactaatcatagtaatactgaccccctgtctagtgattgctttcgaataggcacgtgacccattgtgaccaatgagagttgatggaaatttcctccttgctgtcaacaatggacacaaggaagacacattttctcctctgacctttggacattgaacgttattgtgttaggatgtgatgtaaggcactgtggcacccattttgtgctcattagaggaaaagactggaattaagcccttgctctgtaagtcagagcacaaagatggcaagagcccaggtctttgatgatacaactgaactactgaataaaccaaccctagactcacctacccccaaattccttttaatgtgagagaataatgtcccatcttgtttaagcaatttcaggtttccattacttactaatgaatatatttggattccaagttgttatttccttgcatggaatgcttctgacacaactcacccttgctagcctcaagggtggtggccgaactggggagggtccaagaggaattgcaaaaaacagagctgcaaggagcagccttatctctgaccgctgtggtgagccctccactttgtataccctcccccaaccgtgtgactctggatcagccaatcaggtgatctctcttggcaccttgactcatgatgcaagaacacaggccctattgggtttccatgaattctctgcagggagagcaggggtccccagatcagcctatccctaacgcatgcccttggaggagttgccgctataaagctatctggagtcaccttgtatggggtgttttccaaggctgggccttcagcagtgccttcggcatgttctctttctttggtaagagtcagtttctggggtgaacaactgagaactcagggacatagacaagaaatcatgtctcattcttaaaagcctcagcacaagtcctggcatagagtaagtgttgaagggaggttggatgaatgaataaaggagtgagaaagttaattgcttcccttctctgggctgctgtatcaatcaaggttgtggcaggaaatacatagtaaactcaaatggggtaactaaaaagagtttagcaaagggctatatatagctgtataagtgggattaaaaaaaacaaaaacaaaaagggaggttgcagtagccctaactagcagcagtgaggagccatttctacccctagacctggaggggaaatagttatggaacccaaggagagtagccacagtcttcagggaaagacagctgcctggcaggagcttccaacctatggcaacccaacaggaaggagccacagaaataaatatccgaatccctctctcctcccaccttctagtattctatgatccccaccccattggccaaacccaagcagccacaagaggatgggagaccacatgtgatgtagtccatagaagtcagcctcctggggtacaaagcaggaaatgggggtggacagtggatgtaaaggagcaaatacaaaatatccggcacagatattgctatggtttgcatgtgttccccaaagttcaagtgctggaaacttaatccctgatgcaaccgtgttgagaggtgaggccttcaagaggtgtttggatcatggggacatcatctttctgaatggattaatgcctttatcatgggagcgggctggttttcacaggagcaggtgctctctctcaccctctctctcacccatgtgatgccttgggtcacaccatgatgcagcaagaaggccttcaccagatgtaagctctcaacctcggacttcccagcctccagaactgtgagccaagtaaatttctattcattgtaaattacctggtctgtggtattctgttatagcagcacaaaatggactaagacagatagtatctagtgataggatagactacaagaatctctttcacccagatcctgcagccacaaaagggccaacgctctttggagagtttatctctcacccaagcagccaccagcatcatcagcaaacagcaatgttcctctacacgcttgtgtgtttccttcattggtacaagtttccaccattgttttgcttataagagaaaccattctccaaagcccagagtaattatagagcccagaagtcttggggctttctgaatttgaagcagattcagggctcaagagagccaagaagtcatatcaatgccaggaatctggaccccaggcagacagcgtggataacctaccccaacagaggtgcaggctctcttcctttcacccaaaaaatagcaaacacatttattgatcaccgtgggccctttccttccacctggaggttagcaggaactttcaaaggtttagtgtcatccatatcccattgtcttcttcatgcacagaaaagagaaacttcttcatctctggaaaggagacatggactcacactccccttattctgaatttttgcccactaagccatttcacaggaagttagccatggtttgtggatttttaaatgcttctgggaggagaaggatttactagtgataagaaataaaaatgcaaatgttttactgatgacatatgcatgtaaagtgcttgatataatgcctgacatggaaaaaacactcaataaacgttagtcatcagtatttatatcatcattccttttaatacacgccatcgactgggtgcagtggctcatgcctgttatcccagcactttgggaagcagaggcgagaggatcacttgagcccaggagtttgagacgagcctgggcaacataagaagaccccatctctataaaagaatctttaaaaattacctaggtatggtggcatgtgcatacagtcccagctactcaggaggctggggtgggaggatcaattgagcccaggaggtcaaaatgaggctgcagtgaaccatgatagtacaaaaaaatagttagaaagaatgaataaggccgggtgcggtggcttactcctgtaatcccaacactttgggaggccaaggtgggtggatcatgaggtcaggacttcgagaccagcctggtcaatatggtgaaaccccatctctactaaaaaatacaaaagttagccgggcgtggtgacaggcgcctgtagtcccagctacccaggaggctgaggcaggagaattcctggaacctgggaggcagaggttgcagtgagccaagatcgcaccactgctctccagcctgggcgacagagcaagactccatctcaaaaaaaaaaaaaaaaagaatgaataagacctactatttgctagcacaatggggtgactataatcaaaaacaatttaatcgtacattttagaataactaaaacagaataattagattgtaacacaaaggaaaacgcttgagatgatggataccccatttggcctgatgtgataattacacattgcatgcctacaatatctcacgtaacccataaatatatacacctacgatgtagtcacaaaaactaaaactaaatataaaacaacaagcatttatcatctaattgtctggatttggaacccacaagccaactcagctaagtgctctggcttagggtctcccatgaggctgcaggtaagatgtcagccaggactgcagtcatctgagcgtttctggggctgaagactaggcttccaggctcactgtgtggttgtctctatcccttactggctcttagacagaaacctcaattcctcaccacgtgggcctctccgtaaagtgccttagtgtcctcaaaacatggcagctggcttcctccaaagcgactgatccaagaaagagagagaaagagccaacaatggaagctgcagtctttcatgacgtaatcgcggaagtgacataacatcacttctgcggcattggtcacacacgagccccaacatggatctttccagcgtgggaggggactaaacaaggtgtgaatggcagcaggcagggattgttgcgggccatcttgaaaactggttccctcagaggagagctggaaggctggggacaaggacacaagagaggcttttttatttttttatttttttgagaccgagtctcgctctcgctgcccaggctgaagtgcaatggcgcgatctcagctcactgcaacctccgcctcccgggttccgggaattctcctgcctcagcctcagcagagttccccaagggtgcctgttggcctagtttgagactcttggctctgttagtgggagtctcaaactatgctccaggctgctgattgttctgagggatttctctctctttctttctaacactaagaaataggaacttggcctcccagagtgctgggattacaggcgtgagccaccacgcctggcctgtctgtaatctttaaaagtaatagcatattagctctgagggtcggttggattttttttttttaaacagttggcagtcatttgtagccaagtcaggtgaaaagggtaggtgatcaagctcattacaatttttattgaaataaaatttatctttagtaacgagattgattttttgtgtgtgactccggagggcagtttgcccagagcagtggttttcagactcttaacaaactatccctgagaggaaaagagaatgaattcatactctgtggagtgtagcccaaaataacctctgcaagggtgaaattttctttgaagtcttattttaccttaggtatttgtgaactctgcgttctattttgtgccacatgtgttttaagttactattactctgctaaagtttattcatcctccaggaagatgatgatgtttgtactgtagttttttatgtcccagggatacagcagggttccccaagggtacctgttggcctagtttgagactcttggctctgttagtgggagtctcaaactatgctccaggctgctgattgttctgagggatttctctttctttctaacactaagaaataggaaatacagttttcagtttaaaaataacataattaaaaagtgtagaaaagtctctcttggccgggcacggtggctcacgcctgtaatcccagcactttggaaggccgaggcgggcggatcacgaggtcaggagttcgagaccagcctcaccaacatggcaaaatcccatctctactaaaaatacaaaaattagctgggtgtggaggcaggcagctgtaatcccagctactcgggaggctgaggcaggagaatcgcttgaacccaggaggtggaggttgcagtgagctgagaatgcactactgcactccagcctgggtgacagagtgagactgtctcaaaaaaaaaaaaaaaaattacaggcaaaagaggttgcccatgttctcatcattggcagcagcagcatcaaaatatggcacccactccagtgatgcctttccagaaggagcaacactcatgtgaaaccaccagctttgctttgttttggttgttgctgttgttgttttttcagagagagtctcactctgttgctcaggctggagtgcagtggtgggatcatagctcactgcagccttgaactcctgggctcaagcgatcctcctgcttcagcctccccagtagctgtggctacaggtgcacaccagcacgccttgctaattcaaaaaaaaaaaaaaaagaaaaagaaaagaattgtagagatggggtctcgctatattacccaggctggtctcaaacttctgacctcaagtgatcctcctgccttggcctcccaaagtggcaggattacaggcataatccagccattgtccctggcctggcttttttttttttttttttttttaatgtagctcacgaccacaaacggagtttggtttccttgctctctctttttcccatttggtacttttctttctctcccatgcactcctcttcaaaccaaaagtgaatcttgttatttcttgaaaaatgtgtagatgttgaagggatgaaaaacctgaactctaacgtctgactatctgaacccaaattctagccgccccactcagttgctgtgtgactgtgagtaagttcttaccctctctgagcctgtttcttcacttggaaaataaaagtatacatatatatagctgttagccagaactcagcctagggtaacctttcaataaatattagcatcatcaaggaaatcacttgacaaattaattttcattaagcaatgagggtctataacagtgatgacttctgaccaaccagcccaatggctgacaaaggactgataacactttacatttttataatttccctagatttcaaattctccataaggagcaagtacagtttttataatcagacatagaactcgcgttcactctgctcatcctgaccctagccactggccaccaatttctgggttggctgctccaacctgagagcacagctactggaatcagaggcagaggagctcctcttgcgtttcgttgctggtttcccttggttttgtaaaaataaataaataataaaatagggatacacccttcagacaacaggtaacttcctaagctaagatgaacaggaggaaatttaaatgtctttctccggttcaaatcccctaccctctcccatctgcctaccctgggctccaacactcgggagaaagaccataagtcgttcagatgatgctttggagctggacaatcaatcgtgatcaaaaacaggggcatgggagcccggctaacgtggaaggatgggagaaaatcaggctgaattagagaagggtacattgtggagtgtgttttacaacgccattagttctaagcacataaggatttcaaatcaaggagcatccacacacacacaaactcttggattacttaagagataaggcggatccaaaattagcatatagatcagaggcatgcagttgagtgctgctaaagtgggctataaatgcttgggggaaaataaactagttgtttttctgaagaaagctttacaacgttccaaaatcttgtccaggaagtgtgaactctaagtccaatggactgaactgtgtcccctcaaaattgatatgttgaagccttaacttccattatgatggtattaggaggtgggcttttttggaagactattagtttagatgagatcatgaggatgaggtcttcgtgatggaattagcatccttacaagaaaagacaccagacggcttgctctcttgctctgtctctcctcttccctccctccctctctctctccctctctacctccgctccccccaccccccacttcctccgtcatgtgagaatgcagagagaaagcagctttctgcaagccaggaggagggtccgctgggagctacatcagccagattgtggcacttctcagcctccaaaactgtgagaaatagatttctgttgcttaagccatccagtttatactattttgttattgcagcctgatatggttcggatttgtgtccccgcccaaatctcgtgttgaatcgtaatccccagtgttggaggaggggcctgggggaaggggattggatcacggggacagacttcccccttgctgttctcatgacagtgagtgagttctcacaagatctggttgtttaaaagtgtgtagcactttcccctttgctctcttcctcctactccagccatgtaggacatgccagcttccctttcaccttctgccatgattgtaagtttcctgaggcttccccagctatgcttcctgtacagcctgcaaaactgtgagccaattaaacctcttttctttataaattacccagtctcaggtatttctttataacaatgcaagaagagactaatacacagcccaaactaactaagacaaacccactctgacccattctgacacccaaactaactaagtcctggtttgaacccttcgctattgtgtcaccttggggcaagtcacccaacttctccaaatgtttgtttcccaccaggaagatggaaatgacagtacctctccttcctaccccgcaagcctatcaggaggatcgaaagggacatggcaagcaaatactttctaaactgtaaagtgctgtgcaaacgcaagacagcattactctctttttatggagttatttatactctacctggttacagcagaggatttatggtagatgtcagtaaggctctttattttgaattttaagagagaaataagaatctttgttatctgtagagaaacaaatataatttccatggggcactaatataatataatataatataatataatataatataatataatataatataatataaatataccttaccgaataaaccctttgctcagacgtagtgaaaaggtaaattccccttcaacctaatgaagtttcagtcgctcacattttctgaatttgccgaacagaaatgcgatcaggtgcatactaagtgcagtacccagcatgatgtctagcattgaaacatacagtgtatacaccagcacctccaccaaacccatatccagcatgcaaaacatacccttttcaagtcggaagcacatagatagattttttggagttcaaaaggtcttaatgcaaactggctccaattcctttttttttttttttttaaatctttgaaacattggttaagtcttctcagagctatcattttgcacacatggaaactttagaccatccatccttcaagtgtcttggggtaattagagatactgaaggttaaggacctagcatactactaatagattttcaacaaatggtagctactgttatttctcatcattgcagatttaagagtgccaattctcagagcacttcagataaaaaccctacctttcttaaggcaaaaaacaacggcattaacttttttttttaattaacctaagttcccattatgtttagagaagagatcacaatgataaatgcttgccctgtctctcttttttaaaaatttactgttcttacatgtgacatatactgtggtacttagtgtcaccctacaaagaataaatttaaattgaagaaacagaaacacgggagagtccttgtttgggtttaatttgtatctgactacaataaaattctatcctggaagctagagtcataaaactaaaagtcaggaaggaaaagaatggctaattaagctccgaaactaaaagctctttccttattgctatttctttaagtcctaacaattggtcaggcacaggggcttagctgcgccattctagttaatggtcggttacaaatttccaccataaactcatcttccttctagcaacttaaatctcaggcactgggatgtaataaggagagaaagctcttaggcccagggcaatctctctcaatcccaatctccctttcccccatccctatcccaccacaataactgttagtaagagcttttggttgcatgcccagaaatctaactctggctaaattaatcaagaaacgaatatactggtttatccagctgaggtcatttacggaaagggagtgctaaggtttgaatgtgtctcctccaaaattcatgttgaaacttaatcctcattgcagtggtattaagaggtgaggccttttaggaagtgattcagtcaggagggcttggcccttaaggaatgaattcatgccttataaaggggtagagggaactaacttaggcccttttgcccttccaccttccacatatgaggatacagcattcatgccctccagaggacacaaggcaccaccttagaagcaaggaacagagccccttaccagacacaaaatgtgcctgtgccttgaccctggactcctcagcctccagaacggtgagaaataagtttctgtcctttataagttatctagtcttgggtattttgttacagcagcaaaaacagactaagacaggaagagaaaagaaccagagccccagggactagaaacaggactcactgcctcaaagtacatgtatactctctctctctctcgctctctctctctctctctctctctctctctctctctctccatttctcttcactgtttgtctttgctcagccttattctccatctctctccatgtgggagggcaagtagaggctggcacctccagatatatatcctctctgttcaagaaccacaataagttaatccccagggaagattctgatgcctgtgccactccaaggtccaacactgctgggtggatagatcctgatgtttgaccagatatgtgccacttaccaaccatagcagacactggcaatggccacccatgtcccttggaccctccccatcccatacaagctgaaggcatccctctgcaagcacctgcaactccccacctgaaggccttttctcggcctcggcaagacaggccagaagttcaaggatgtcaaagtccctgagagaatcccttggtcaatgtcagatgagtgatgaaagataaatatctcagttttctcaacactcaggtgggacaatttgaggtgtgttccatgccatcaaccaaagcccatcaaaaggaccaagccctggctccccatagaagtaacttactcattaccttgctttattctggtttagatttccttgtctcattttgccctgtgatggttaattttatgtgtcaacctgactgggacgctgagtgcccagataattggtaaaacattattctgggtgttcccgtgaaggtgttttcagacgagattaacatttaaatgggtagacggaggaaagcaggttgcactccagatgtgcatggtcctcatccaatcagttgaaggtctaaatagaacaaaaggccaacccttgcctgagtcagagagatctcctcctgcctgagggccttcaaactgaaacgtcaaaattttcctgcctttagactcaaactgaaacacagctctttctggatctcaagcctgctggttttcagactggaactacaccactgggtctcctgggtctccagcttactgactcatcctgcagatcttaggacttgtcagcctccataattgcatacacacacacacacacatatatataaaagtgcatatagatacatatatgtatgtgaatgtatgtatataaaagtgcatatagatacatatatgtatgtgtatatatatatacacacacatacacacacatatatgtgtgtgtacatatacatgtgtgtatatatacacacatgtatatgtgtgtatatatacacacatgtatatgtgtgtatacacacacacacacacacacacacacacacacacacacatatatatatatatatatatatgaagaccatagagaagtctctaagccaaagctggggacaggggaatcctgtgtctcctggggagaggtctgctttagtgtccctgccatgctcagtcattacccaggagcacctcatggaaggaagcatatggattccccatatgcttatatatgtgtgtgtgtgtgtgtgtgtgtgtgtatatgtatatgcatatgtgtgtgtgtatgtgtgtgtgctattctattggttctacttctctaaagaaacctgactaatacactcccattctcctactggtgcttcccagagtcaccctacaaataaaccattacatggaaatcctcatcacaggatctgcctctgggaaaacccagcctaagacatccatgactttcataggagaagaaagagctctagaattggcagccttactgaaccatgtggaagaggaaaggagaccacctaaacaaaagggtattaaccaattaaaataacctaaacccacacttgtccaaattgctgagcaagtgggatggaatggaacaactttcaaccagtgtccaaatattgctgtgactcctagactggcttgacacaaaggcagtgtccaccagctctaaacatccatctcaactaagatttctccaggaaggctagaactgacaccctctgcttaggttctcagtgacttcacccagccagcaaaggagctcttaggaaggcagacaagccctgaagtctgtctgctcagactccagctacctgctctattcctgctttatcaacctctagcttagtcgctcaatctccagctttgctccttcccattagattctatggctgaacctgactgccatagtttgtttctcagatgaatttaaggcaagggttgcaaactttaatgcacacatgggcagacaagtaacacaaatgagtgaagagtacagattagggcaactgggtctggtggagactgtggcaaactagagagcacacaccctatctaaggaggcagcgaggacttaattttgcaagatttgtggaatggactcccaatgttgccaaactgccactattttttaaagagaagcaggaaatccaggggtttttaaagatgtaaaatacacagtttgttgaatgctggcaactgatttttttttttttttttgagacaagagtctcactctgttgcccaggctggagtgcagtggcatgatcgcagctcactgcagcctcctcctcccacattcaagaaattctcctgcctcagcctcctaagtagctgggattacaggggtgcaccaccatacccagctaatttttgtatttttagtagagatgaggtttcccccttgttggccacgctggtctccagctcctaatctcaagtgatctgcctgccttggcctcccagaatgctggagttacaggtgtgagccacagcacccagccctgattttttttaatgtaaatactgtatgaacccagacaaatgttctgccaggccagtgctgcatggctcaccatgtggtggccctgagaatgggcctcatcgacctccctctactgggagtgtaattaaccagggccccagctgctgcgctggggaatccatatgcttccttccatgaggtgctcctggctaatgactgagcatggcagggacactaaagcagacccctccccaggagacacaggattcccctgtccccggctttggcttagggacttccctatggtgttcgcaccctaacttttttctcctctctcttttactcagagtcagacttgcattactgtctcaggttctcccagctttatgtggcaccttctttgctttctctcaagggcatttcccttaataaaaatcacatatgtgtaaacctgtatgggagtttgtttctcagaactgggctgacacaccatcttgcaaactctgctttcggcattcagctcacacttacttacaccctccaaactccaactatttagggctaattccattccagctcccaccccttgaatcccttcccccctccccccacttcctcctcccattctgctttcctggaaacagcatttccacttacttttgaacaatggtccttccttcactgttcattcatggagtttggatagcaccatcttctaaagctagagctgagcacatgatcaggactgactaatcaccctcttctacttccttagccacaataattcgttcagagatgggcacctgactcttacaatgcaatgagagtcagcttcttatgccagtgcttttggcaaaggtaggttcattttcccctgggattactaagctggtaggaggtaagtcagcagctgctgatggcataagaaaagggcctgataatgaagccaacatggatgaaaagagagctgagaagtagagatcagacagatttcaaagcatatcatttaagcatctggatccagccatacttgaagtccagtctatctgtgggctttgaagttgcatggaacaatagcaagatgtagctgagagagttttggctaatataccacctcacctctcattcagtttcatggaatataacagacattgccaactaaaatttacaaacagcattgatataaaagctccgccatttaaaaaaggaaactttctattctttcactgtgtggccttgggaaatttctaatccgttctgaacttcagcttttttccctctcaaatgtagcaaatacaacataacttgcttgccatggagggaaatcagatgcccttatctaggaaagtaaagatagaggtataaaacattgttatttcaaaaaaaaaaaaaatccagcacataagtctaggagcattgaacaagggtcagattgcatggattcagattccagctccattactaacaggctgtgtgaccttggacaactcaattgacctctctggccctcagtttccttattagtaagacggaaactccaatcatatctattgcacgggatagttgtagaaattaatagatacataagtgcttagtgcaacatgtggcactcaaaatatgtgtggtatgattgttattgacacaatggttgacccatgaatgattgtgatgccaaccccctcacagttggaaatccacctataacttttgactcccccaaaacgtagctactaatagcctattgttgaccagaagtcttaccaataacacaaacaatatacacatatgttgtattttatatgattatacactgtatttttacaataaaataagctagagaaaacaatatatgattaagaaaatcataaggaagagaaaatgtatttattattcattaagtggaagtggatcatcataaatgtcttcatcctcattgtcttcacattgaggagactgaggaagaggaggaagaggaggaattggtttcgccgtctcagaggtggcaaaaacagaaaaaaatccatgtataagtggacccatgcggttcaaatccatgttgttcaagggccaactgtatttatattacaataaatgctgttaatgttgtcactgttgacccttctagtccattcccaacatcacttcctacgcccagtggaaaattccatcttaaaatcacccagcccaagccctcttcagtagactcagatagatggcttgtcaagggcatgacttaacttctccaaacacaaccagcccagtttcaactgccatttggggaactttcccaattaccacatttccgcacatcaagtatgaattactttaattgccccagaagaacgcactgttgaaatatttgacttgcccagaactaattgtctgtcaaaaagagattttgcagccaagctgatctcttcattggacatctaatttaactgaaaacctttttccctgcttgttttatgctttcttctcctgtttttgccaaattctggatgctgggcactgctttcggaaataatttatcttgttattttctattataaaagtaatacatgttcattatagaaaaactgaaaaaaaaaattccaaatgaagaaaaacagttgatcctagactcattgcccagaggaagactatgaacattccacatgaagaaaaacagtggatcctagactcattgcccagaggaggactatgaacattccacatgaagaaaaacagtggctcctagactcattgcccagaggaagactatgaacattccacatgaagaaaaacagttgatcctagactcattgcccagaggaggactatgaacattccaaatgaagaaaaacagtggctcctagactcattgcccagaggaagactatgaacattccacatgaagaaaaacagtggctcctagactcattgcccagaggaggactatgaacattccaaatgaagaaaaacagtggatcctagactcatcgcccagagaaagactatgaacattttagcacgtctccctcccaggtttcctagaatagatgtctgtacatagttaataaaaacatatattcaagttttgcagctttttgttccactttacattttaagttgaacgtttacacttcccattccaagatcttcagaaacatgtttagaaacagaagagtatcccaacaacagtctgtttaacctcttcccctaatgctgaactattgttgctttaagaatacattttctgtgtgtgtttcagatgtagtttccttaggaaagattctctatgctgtgcaacaattccccatgtgtctcttacatttctgcacatcttgtgtcagcttttgttctagaccgtctttataaggatgtttgtatagctaatagcattagaagatagggctagtatagtagaagacagatttatttgctgattaggattataataataatatctctggaccaggcgcagtggctcatgcctgtaatcccaccaatttgtgaggctgaggcaggcagatgacctgaggttgggagttcgagaccagcctggccaatatggtgaaactgctgtctctactacaaacacttaaaaaattagctgggtgtggtggtgggcgcctgtaatcccagctacttgggagacaggtgggagaattgcttgaacccaagaggcaggggttgcaatgagctaagatcattccactgcactccaacatgggtgtgacagagcaagactctacctcaaaaaaacaaaaaacaaaaaaagaagaagaaaaagaaaaagaaaggattataatgacaatgtctccctccatccagggtaaaggttgaaaagaccaagattcctaaacttggggttcctcaggtgtgatgcaaatccactgcaggcacagattctacctggatccatccatgtattactcatttctcacactgctaataaaaacatacccaaggctgggtgtggtgtctcacacctgtaatcctaacaccttgggaggccgaggtgggcagattgcctgagctcaggagtttgagaccagcctgggcaacatggtgaaacctcatctctactaaaatacaaaaaattagccaggtattgtggtgcacacctataatcctagctactcaggaggctgaggtgggagaatcgcttgaacccgggaggtggaggttgcagtgagccaagaatgcgccactgcactccagcctgggcgacagagtgagactctgtctcaaaaaaagaaaaaaaaaaggctaggcatggctgtaatctcagcactttgggatgctgaggtgggcagatcacctgaggtcaggagttcaagaccagcctgaccaacatggagaaaccccatctctactagatacacaaaattagctgggtgtggtggtacatggctgtaatcccagctactcaggaggctgaggcaggacaattgcttgaacctgggaggcagaggttggggtgagctgagatcctgccattgcactccagcctgggcgacaagagtgaaactctgtctcaaaaaaaacaaaaaaacaaacaaacaaaaaacataccctagactgagtaatttataaaggaaagagatttaattgactcagggaggcctcgggaaacttacaatcatggcagaagggaaagcaaacatgtccttcttcacatggcggcagcaaggggaagaatgagcaaaagaagaaaaagccccttataaaaccatcagattttgtgagaactcattcactatcataagaacagcatgaagataactgcccccatgattaaattacctcccactgggtcccttccatgacacatggggattgtgggaactacaattcaagatgagatttgggtggggacacagccaaaccatgtcaacctgtgtcacccttgagggacttgggggtcaaagggaactggtgcagacatgaagctcaagcttcctgttgtgccatgaaaaataaagtcctttatctctcaatccagagtctcatgtcttctgcccacatccataaaactcactagcctccatgtaggataatatcttagaccagcacagttcttgacactctagaagtgaatttgttggatcaaaaagcatgaacaattgctaaaactcttaatatgtcttgtcaattagctctccaaacaaatgagtcattgcctgaaatctcttttgtcatcaggaagggatagagctgcttgactcagatctcccaggtggccttagaccgtaatgtcttcctttcgtgcagagctcttaccatcctaagccactactcctacctaatattctataaaaagctttttctccctacccagtgtctccaatgagctgactttcttttctggattactcttttatgtaataaaaagtagacatgagggtcaaagggaaaaaggggaatttgtttaatttctaccaagtgccaggcatagtacaaagaacatttagataaggcagaaggcattaattatttttatctacccagaaccccctgccccacctaagcaccccagcccctgacctggccacgtgggtggctatgtgacctgagctgaaccaatcagagtccttccctgggatttttttcacatcataaccacatgagaaggtctcccattatgaaacagagaagcttgttggcagccatggttctagccaaggatggaaaaaacaaccaaaaaaagaaaagaaacaaaaaaaaacccaccatggtaaaaaaatacatatataaaaataaaaaagatatgacagacagacagacatggggaatggtctctttccagttgcccctgccactcaactgctctcctaccttcctggatttggttatgagagtcaataaattatccccttttattgcctaaatgacttccatatgagtttctgctccttgcaaccaacataatcttgacaattaatagtagctagcattttgtgagtgtttactgtgccatgcccattaatacacctaatcctctctacaattggacaggtaaggtgcttttagtaacctccaatgtacaaaaaggaaaacaagttgggtgaagtgaaatgacttgctcacagtcgctgggctaacaagggggcagagtcaaagtttaaagccagagcccatactcttccctattgtataacacagacatgctgtctctgttcccagtgctggggaatgcagagaactggggactgaaggaagagcaggcgttcaggtaagcattaatcaggggaccttccacaagggaaaagggagtactggcccagttgaagtccagccagcactcagcatggtcaaggatggggtggtgctctctccagccattcaaggtgctgagaaaagaacagaactttcatctgaggaatacaagccttttaaattattaggcccagagaggcaatagaatgagatagcaatcatgtcctacataccccctttgagctcggtattcatttcttaaaactgcttgccattgccacaagtagctatcaattaatctaataatgccccactggatgctataacccacaccttatagcttaacaatgtatagccaatcactcgtcaatgttatttctgaaaaccagtgagaattcctgacaaccaactgtgtaccagcccactccatgtcccccttttttgcctttataaatccacttgtaactgctgctaattggagtgtatattcagggaaacttgaatctacgctccctggctacagtcctcaagcttggcccaaacagagtctttacttatattaattttgcctcagcttcttccttttaggttgacagtgctacaggctgaattatgtccccctaaaattcaaatttgaataaatgttcaaatatgaatttgaggccaggcacagtggctcatgcctgtaatcccagtactctgggaggccgaggtgggcagatcatcttaggtcagcagtttgagaccagcctggccaacatggcgaaaccccatctctactaaaaatacaaaaattagccaggtgtggtgacgcatgcctatcatcccagctacttgggaggccaggataggagaatcacttgaacctgggaggtggaagtggcagtgagccaagatcgcaccactgcactccagcctaggcgacagaacgagactctgtctctctctctctctatatatatatgaatttgaagcccttcaaccatatggatcatatgttgaagtcctaaccccctagcacctcagactgtcattgtatttggagataggggctttaaataggtgattaagtttaaacctatttagctcatttagggtgagctctaatccaatcagactcgtgttcttataggaagaggagattaggacacacagagagacaccaggtatggacaggcacagaggaaagaccatctgaggacacaccagaatcgaccatctgcaagccaagaggaggtctttggaggaaccaaccctgctgacaccctgatctcagacttccagcctccagaattgtgagaaaattaatctctgtcatttaagccacccagtctgtagtactttgttatggcagctccagcaaactatatctacagtaatccatcaccacttatgacaggctctgccacatagtaggtgtgtgtgcacacaccacacacaatcatgtttagaatatgaaatccgtgaaccctactcccacactgataacagttcaggaacagttgatttttcctcagggaatctggtttgttttcctagtttccatcccatcaagaccccttcccacctgctgggaaatacttgcctgaacccctcgttcctttcacaacacacacctgatggtaggaagaagcttccaactctgatattgacagggtgcttgtaacctagcaccctttctcctaccttgttatggaaaaataaatcctttatcctatttcaactacagtcttggcaaaggaaaaaacaaaacaaaaaaggaaaccagcctagaaatggaaaccaaagatcatgaacagtgctatgctgagttacagctaagggttggcctttctggagctggctgccttcagatggcagggctctgagagtgtgtgtgtgtgtgtgtgtgtgtgtgtgtgtgtgtgtgccagaagcacaagatgacacaccctgtggtggggtcaggcaagctgattgtgggaaaggtgggaacagaatattttacaacaatgttggaaaaatgggtttacgttctctgagaggaagatacccaaagcttcaagctcacctcaagggaaaattgagctaggttcccatgctctccacttggatctcacgcacatgaacacacatacaaccttctcctcaatattcacaagaggcctctgttgtctgcttctccagagagtggaggtgaatttacctgaagctaatgaggcttgggcttcagggtcttttccttgtacctgtctctttaaatgctggacttggggaaggctttaggtgagaagggaaagctgggtttcaataatgaagcacctctatgttcacatttctgattaattgcctacacagatcccagaagaatggaatggaaatagctaaaggctccagaattttctctttttatttttttgagacaacatctcactctgttacccccaggctggaggctggagtgtggtggcaagatcatcgctcactgcagcctctaactccctggctcaagcgatcctcccacctcggcctcctgagtagctgggactacaggcacacaccaccacacctggctaattttttgaatttttttttttgtagagatgggggtcttgccatgtcgcttaggctggtcttgaactcctgggctcaagaaatcctcctaccttggcgtctcaaaaagctgggattacaggcatgagctaccatgtccaggcagctacaggaatattatacttaatttctcattccaaaataacattctcttttgtgcctaattttaaattcataattttgtattctttttcttaaacagagatccccatattatataagcttcagtccccacaaaaactggatctggttctgccaaaatgatatatcctttatgatatttatagagacgttctgattatttctgaacatctcagactttctggaaccaagacaggttcgattatgaacatctgttgtctaattttaaagaccaagggggaagccgggtccttatgaaggccataaaggctccaagctagatggatattgggggagtgggttagcagagatgtcctaaaacaatgtattacactaatgggaagaacaaaaggtaagtctaatcacagatgtcttggttttcaagctagtcagacttcagataactgtcaaatcttcagccataaatcgaaagtggaggagaattaaagacccatccttgtttgcttacagaatttacttaatttagccactctatccttaattgatagcaacaggttttttcaaaatagccaaagtaatctatgctttgctacataatagcaaaagtaatagccaacatacatcaacacctactatgttatacccttgacaggttttcctattttagtagtcaaagcaatttcatggagtagcaattacagttgtaatttcactagtgagaatgcagagtgaggctcagagaggttaaggaacttacccaaggtcacacagctagtgagtggagagttggaatttcatctctctgattttaaagtctgggccctttcctctactgcctctctctgaactcaatgacacatcctaagtaagtaagggcttctacacaggatgggttagactatgctgcagtaacaaacaacccctggatctcaggaacttaaaacaaaatttcaggctgggtgtggtgtctcacacctgtaatcccagcacattgggaggccaaggccagtggatcacttgaggtcaggagttcgacaccagcctggtcaacatggagaaaccccatctctactaaaaatacaaaaattagccaagcatggtggtgggtacctgtaatcccagctacttgggaggctgaggcatgagaatcacttgaacctgggaggcagaggttgcagtgagccgagatcacaccattgcactccagcctgggcgacagagcgagactcttgtctcaaaaaaaaaaaaaaattctagaaataactccaaccttattttcttgaacacgactcatcctgaccctccagcactccattgatctgggctaaatatatggaatcctgcagatgaagacaccagcacccaaagctaatgggacacagaaaacagaggccactcaaataaatgtcagcactcctagttactgaatactctgtgtctggcaagtttcatcattagtcagttattcattcactcaatcaacaactacttactgagttaatatagcagcatggttatgagcacagactctggagcaagaggtcctaggttcaaatcccagttaccctgcttatcagctaaatgacttctcagtgccttggtttctccacccagaaaaatggggattataattaataattgcctacctcattgggttaagtggataaactaagaacagtggcatgcccatatgacatgctctataatttttattatcactgtgtgccaggcattattctatatgatggaggatgcagctatgaatagggcagacaaggtgcctgtctttacagagcttctattctagtgaaggagagaggctttattagcgagtaatccttgatcgagccatacctgaagctaactacacatccttcaaccttccaatttccccaggcattaagttcttttttcttttctgcctaggctagcttgcactgagtttctctcccttgtgaaccaaagtgtcctgaccagtacagaggtctaaagcctaagctctttccagtctgccccttgcccctttccagctgaagccctattcatttgcacccaacatcatcattgcgtccagtgcctcaccacttggtgagacccttgaatattcaaaccagcgtgtaagcagagagttaggaactataaacagtaaattataacaagcatgaagtggaagcctgctgctgatcattcgcaagagagcaatcaaatctgtcttggtgcctacatgttttatggaaaacatgtctatgttttaaaagtgtttttgaaataaaaaataatttactaactaaattagatttccacatgttttatctagttaacccatcccttatcataagaaacgtaacttcttattttttttttttttttttttttttttttgcgatggagtctcactctatcacccaggctggagtgcagtggtgtgatcccgactcactgcaacctctgcctcctgaattcaagtgatgctcctacctcagcctctcaagtagctgggattacaggtgtgcgtcaccatgcccagctaatttttataattttagtagagatggggtttcaccatgttgaccaggctggtcttgaactcctgacctcaagtgatccccctgccccggcctcccaatcatggtgggattataggcttgagcccctgtgcctggcctagaaagctaacttcttaattgcaagctactttcatcaatataatgcatttgtctcactccttaaaggactcctgtcacagtgaattggcaaagaactggtcagacacaagaggcagtggagtattagtaaaatacacgtggatttggagtcagaccttcctaggtttaaatgctggttttatcgcatactagttgtatgccttcatcggggtttcccaagaatcagaccctgagacaagactccaagagtaagtcatctatgtgggaggtaaatgaaacatgacacaggaaatgaaataggtcagggaggcagccagtaaagggcatattataaaacaagttaccacttgggacaataactggagcttaaacttgctggaaaactctaggatacactgtagaacatctctagcaatgtgctggtagatgtttaacaaccaacactgcagaaaaatattaaaagcccagatttgtagtgtctgcccatatccatggtgtaaatcctcccaccatggctgatttcacactaccttgtccctgaacaaggacttggggaaagatgcacataccagctcttgcttcatagttatctgacctaaggggtgagggagatggggtagttatccacttacaccaactctcatcagttcctggtggagggatgctcccagggcaggtgttgattcctccaagacttccaagccatcatacgggtgggcaaagacagtacaaccagaaaaagacctcagaaagagggccaggcatggtggctcatgcctgtaatcccagcactttgggaggccaagacaggtggatcacctgaggtcaggagttcgagacagcctggccagcatggcaaagccccacatctactaaaaaaaaaaaaatagctgggcatggtggtgcatgcctgtaattccagctactcaggaggctgaggcaggagaattgcttgaacctgggaggcggagattgctgcgagctgagatcacgccactgcacttcagcctgggcgacagagtgagactccatctcaaaaaaaaaaaaaaaagaaaagaaaaagaaaaagtcctcagaaagagaatgcaactacatttggatgggtcagtggatgcttaagaggtaaagggttagaagatacaagggaagcactgaaagcatctgttactctgtgcaattgtgaaaacgttatttcatttctctaggcttccaatattgcattggtaagatatgattcattgaatcttccaacaaatattcatggagcacttagtatatacccggcaatcttcaggccacaggaaacagaatgttgagttaccatgacaaagtcactgtcacagagccagtggggaaagcagcctctaaacatgccacccagtaagtaacaaagatcatttcaggaatggtgaggactatgatgttagagagggtgatgggagggagaataatgtagcggagaggacatgaacgggaaaatctttctgaaagggtaacgtgtaaggtgaggctcaacagatgagaggaaatgtgttgtaaaaagatctgggagcagcattccaggtggaggaaactgcatgtgcaaaggcccagaggtgggaaggagcttggcttgttcatggaaaagaatggaagccagtgtgtctagatcaaaatgaatcaggcagaaggtaaccaggaaacagagtggagaggcaggcaggaatcagtgtctgcagtgcgtgctcagcatcataaagggtttgagtagtaacacaaccctgaagagttgttaaatgagctcccatgcatgtaactggcattactcatgttattaacctgggaaactgtcacgtctcttacttttccatttaatctcatgcccatcctctttgctcacaggagccaagaagtccagtatctcactccacatctgccttctcgtggtccaacactctgccgactcagttaatccaaagatcacttccaaacttcaggctgatggaaacctgaggagtcggatccattcataggcagccccattttcaccttcccttgtccccgaggctgccattaggttgaaaaccagtctggtactgtcagcgtgtctttgtctacagctatgaaaaagtccacatagtccagtctctacatagggcacaatgattctcctctacatctcagctaccaggaaccagcttgtcgaacacacatgcaaacattcaaacccttctcaggttcccctctagggccttcagggacttatccggcatacctgaggttggggccattgcaatctattcttagtctagtgttaagccgggtcaacagcggagatgctccttctccttgaactaattttatttccagagtttcattttccttccctgcaacattaggcaccatttggggatatttttatccatccatatggatttcaaaatctcataaagaaggagctgggagaagaatgaggaatcactgattttaatgactgtatttgttgatctcttactccattcctggacccatgttgaataacataaatatatatgcatgtacacatgctatacatggtatctagatgctatatgtgttatatataacatacatgttacaatatatgttagatatgtatgtcatacatatcataatatataattatacattgtatattatatattatactattacatataatatataattatacattgtatacttgtatactattacatagtataatatatacttatgtttatataataaaatataatgtatatgaaatatacataatacatatatgatatattatataattatatcatataatatataattatgtatatttcatataccatatattttatcatacataaatatataagttatatataatatataatgtcatatattatataaattataattattatatattatataaaacatgtattatattatatataatacatggtttatatgttatataacatatataacaaattatatattatataacatgttatataacaaattatatattatataatatgttatataatataacaagttatgtaatatacaatatatgttattaaaatagatattacataatatattaaataatatatgttttatatattatattatatatgttttttatatattatataatatatatgttttatatatattatttttgtttttttttgttttttgggggttttcttgagacagagtcttgctctattgtccaggctgcagtgcagtggtatgatcttggctcactgcaacctccgtctcccgggttcaagcaattctcctgtctcagcctcccaagtagctgggactacaggtgcccacaaccaggcctggctcatttttgtattttctttagaggcaaagtttcaccatgttggccggactggttctcaactcctgaccccaagtgccccgcccaccccatcctcctaaaatgccgggattacaggcatgagccactgcatccagcctatatatgttctttcatcatcaccacatcatctaattttacagatgagaacactgaggcttggggagatattaaatgtcttatccagattgcatgcatgtaagtgacataagcatgatttgaaactaagcaatccaacacgagagtcctaggtctagagcctctctgacctgctttctacctagaaattatctgagttctttatgcaaattgatgcactttttcatccctttggtctcttgaagtggcagcttttgctgcacccagttctcacaacaacttgcaaagaggatcaacacacacgactgatcacgagataaaggaagtctgaagcagtccccaccaaacatgcaaattcaatgaatgaagatccatttcttgcagctttctgctttgcataataacatttggctgtgatgatctattatgacactaatccttgcacagcccagagaagatgggcaatagttttctggatgtcagtgggactctggcacaagggccagccaattttggtgagcgcaacaggaaattctttgcaatgtccttgtgaatctgaggttacaaagactggctcaatctgtcacaggaagcatgctggaatgcctttgtccttctttctagtttttctttctttctttctaataattctcagtgtgggagaatattattctttctaataattctcggtgtgggcttacatcctttgctttggggaaggtttctatcattagacctctcttttcccccaaccatccagctgtgaagcggttcactgcggacccaacctctggcatgactgtggatcagcagcaccaatgccatgaagactgcagacacactggagaaccaaggctaattcccttagccattgagcctccgctttccatccatgaaatgactctcaaaatgccagcttgggctattgcttgcttcagagcacctaagagcatctgaacaaaaggaatatctttttcacagatgtaaatgaggaaagcgaggattatacagtagaagaagtgctctataaggctgctgaagatcacaatttttttttttttgagacagtctggctctgtgtcccaggctggagtgcagtggtgcaatctcggcttactgcaacctccgcctcccaggttcaaacgattctcctacctcagcctcccaagaagctgggataacaggtgtgcgccaccacacctggctagtttttgtattttttagtagaaacagaatttcatcacgttggccagacttgaggtcaggtcttgaactcctgacatcaagtgatccacccgccttggcctcccaaagtgctgggattataggtgtgagccaccgtgcccggcctgaagatcacaattcttatctaactctgctattcattggctgggccaccttgggcatgtccattagctttctggttcttaggaccctcatgtctaataacaaggtctttcctacctgccccacagggctgttgggaggaccaaatgagatcaagaatgcaaaagctctctgtcaactgtgaaacactaccaggagtaaagattcacaaggcatgagttgccacaaggcagtatagcatggtggttaggaggttaagctcttaaaccagattatttggattccagtataaccccaggaaacttaactttgttttgtggtgttgttgttttgttggtgttgttgcttggtattttgtctaatttttagaaacagggtcttgctctgttgcccaggctggagtgcagtgggcatgatcatagttcactgcagccttgaactcctgggcttaagctatcctcctgcctcagcctgtggagtagctgggactacaggtgtgcaccaccgcacctggctaatttatttaatttttgtggagacagggtcttgctttcttgcctcagcttgtctcgaactcctgacctcaagcaatcctcccatcttggcctccaaaagagctgggattataggtgtgagtcactgcgcccagccaatttaaattctttaagtctcagtttttccatttgtaaaatgggcatagtaatagtacatttgtcacagagttggtttgtgataggataaggtgatgcatgttcactagaaatgaagagagaagggttatgattcattgaaaagaaagaaaaacctaggctgggtgtagtggctcacacctgtaatcccagcactttgggaggctgaggcaggaggatgaattgaggacagaagttctagaccagactaggcaacatagtgagaccctgtttctactaaataaataaataaataagccaggcatggtggcatgaaccctgcagtccaagctactcagaaggctaaggcaggaggatcacctgagctcaggaacttgaggctgcagtgagttataattgtgccactacactccagtatgggtgacagactgagatcttgtctctataaagaaaaaaagaagaagaggaggtagaagaagaaagtctgaactactccctgcaggaagagtagacaaggtaaagagccctagaaaagattcgtccccgtgctttcctctagaatgaggactccagtaatttataccagtgctggagcacaggcttgacaatggctggagctcagcctccacagtatctgttgtgattagtgctcaaaagcataaagcataaatggaactaagaagaaacaagatgctcaaggtctccccttcagccttccttccaagtaacagaatcatgatttgatgatttgaccccttcttctaccacctcaatattgaaatctgtttccaattcccgttaccttagagaacaccatcagatgtccattgtatatctcagattcatttctttccaaaaacgaatttaacttgccttccaaataattttactcctaatttttagctcactttctccatgaatatcatcaccattcacccagttacccaaaccaagagcctgaacaacatctttgagtccttctccatcacaccctacattcaaccaattgccaccttctcttttatatacctccttaagtcacggccttaatttgggaatgatcgtttctcatttggacttgacttcatggtcaaatatggcatccagagatctagccattgcatcctaattcaagaccaacaacaggaaaaatgggcaaagaaatatatggtcctcattctgagaaaatgtccatattactcttctctttgcattccttggccaaagctaaatcacatggcttgggtagcttcatgagagattgggaaattagagggttttggttttgttgttgttgtttaaagcagagtctatgtcaccctaattaaaatcagtgtttcatcttttattcttcctcaaatattcagtgttaaagtcactaaagggcaccaaccaaagtaagcatcaacgagaggggataggacagagatctggcatggggtgttgaagcctagaattggtgcacgacctagttctagtcacgaaaaagcatcagacaatccccaattgagagctcttatacaacataaatggcctgtatcttcaaaagtatcaaggtcaagaaagtaacaaagagactgatgaatctgccggaataagacgtgacaattaaatgctatgataatcttgccctgcaagattataaaggacattattgggatggtcagtgaaacctgaatggggcctttggattagatggtggtaatgtatcaatgttataataatttcctgactttaatggtcatattatgggcatataggagaaggtccttattgcaagacacacacagtaaagtattgggaaacgattcgaggagagggaaaacttaattgtactgttcttccaactattgtctcagtttgaaatttttcccccgaaaataaggtgttatttcagagaagaaaagggaatgtagatgtttcaatatgtaaatagtaggctccaccacagatggtatttaaataatgtatcagaagaggtcatcccaagggagtaatatttaaatccagagccaaagatagaaagccatccacgtgaagagcaaggagacaaagttttcaggcagaaggaacatgtgagaagtagctgaacttgttttcagagttataaccctagcaatatggtggaaaataacaaataactagcaatatggttgaaataaacaaactgctattccttcagaaacatgagtaagcaccactgtgtgcaggaacttgcagcagtcagctagatgctgtaagacaaacaaccccaaatcccagaaagagcttatttctctgccatgcccatatagcttggctggagcagctctgctggaggttgcaggtctgaagacatgctggggcggctctgctctagatgcatctcatttttctaggaccagcgaccaactaagtcatgtttttctcatagagaaggcaaaagcacaagaaggcaaactcatcacacgagagcatttcaagcctttcataagggttatgtcctctcacatcccattagccaaagaaagttaagctcaactcaacagtcgaagggtagggaagtacactatgccatctctcagggaaaaggaagtcacatagcctagctgaacatcaatgatgtaataggagagggaacaaatatttactaaacaatagtctcatctaccgtaaagctcaaatacttcacaaaagagccacccttagaaatagcttttatctcatctattttatgggtgagtggggaagaaggatgacaaagcccctttaagaattttatataccctagacacattcacttttggaggtctcaccagataagcatttgaaacatgctacaaatttgcctgtatcctacattaaatggaattttggctctaaacattttttgagaaaattttaaaattctgctcctgaaattatctggcaataggtgatttatttaaatttagattggatgtgatttcttggtaattgtgcatattcaggaggtctagaaagtgggaaattctaactatccacatttttcagatgtaatgaaatccctaggaatgttaaatttaacaattagtgatattgacaaagcagcacaatttgtaggtaattttttttttttttttagaaggagtttcactcttgttgcccaggctggagtgcatggcatgatctcggctcactgccacctccacctcccaggttcaagcaattctcctgtctcagcctcctgagtagctgggattacaggtttacaggcatgcaccaccataccaagctcattttcatatttttagtagagacagggtttcaccatgttggtcagcctggtctcgaactcctgacctcaggtgatctgcctgcctcagcctcccaaagtgctgggattacagtcgtgagccaccatgcccagcgtaggtaatttttaagatattcattaatttcaattttgtcattttctcttttgcatttttaagccaatgtgtgtgtgtgtatgtgtgtttgtgtggtgttttttgtttgtttgtttgtttgtttgtttgtttgtttttggtctcaaacatttctgtagatcttgaaaaacgtataggtcccgggaagaccctatgcctaacggattaaaaatgcacatgttgcctggaatcaaagctaattattattggttgggaaatggataccctcccactccagactcctcagcacaggaaaataagagcagctaactccaacagaacccaattcatttaggaggctctctgcctctgcataagggtgaatggtttgggattgctgctcagcagagcccttcatctcattcacgaagccattcacactgtatccagtccatttgtaaggcaaataaaaatgtcgtcttccaatcttggctcatttcatcttataagaaaagtctcccgtccgatgcctagccaacatttccctgttgtgattaaagaaacagcaggtaataaaagctggactaacggttggtcctctaaggaccaaaatatgattgaagaagcaataacttaccccagtgccgccaaggcaagttgtctcaataatgtaacaaagctatacttaatggcaacagagcacgtttcactgatactacaccataaactgcccgctttcaattagttgcatatgtattaaagggagtcaacacatatttacagcaatcatttctatgtatacaagatgccacaaaaatgtagctttctgctccttctggtcatttggccacataggaataatcaccaaccatagatgcaattctggaaaagtcattaatgctcatctctatggttgcaagagattattgggcttctatttcatgccaaggcactttacatatgtaaataatggtgcatgctttgaatgaagtcatgtttttgtgacctacaatccccactggctgctgcagcacctggcacatattagccactcaagaaattctcgttgagtgaataaatgaaacattcaatggctctgagaccctacctttcagattatcagcaccatgaccctgcttttgagacccctactctctctcccttccctattatctcttggtgaatattggggaatggctcacctgaactgccccacgatttcatgcctgttttcgccattacctgtcaccttacctggccacagtcattccttccaaagccactattcacatctctatcagatgctctgcagttctggggctcctgcctcttgggacaaggctagtactgtcataccaggtgtgatggttaatattgagtgtcaacttgattggattgaaggaggcaaagtattgatcctgggtgcgtctgtgaggatgttgctaaaggagatttacacttgagtcagtggactgggagaggcagacccaccctcaatctgggtgggtaccatctaatcagctgccagcatggctagaataaagcaggcagaagttggaaagaacagacttactgagtcttccggccttcatctttctcctgtgctggatgcttcctgccctggaacattggactccaagttcttcagcttttggactcttggacttacaccagtggtttgccaggggctctcaagcctttggccacagaatgaaggctgcactgctggcttccctacttttgaggttttgggactcagactggtttccttgctcctcagcttgcagatggcctattgtgggacttcaccttgtgaccgtgtgagtcagtaccccttaataaactccccttcatatatacatctatcctattagttctgtccctccacagaaccctgtgtaatacaccaggccagcagaagggagacatttgctttcctggacattttctgttcattttacatttgctcaatgaaaaaaatcaggttgcaatacatatataaatagaaaacacagagagacataaatattttttaaaaagaatcagaaacatatgccccaaaatgctaatatgattacatctgggtggttaatatttattttctgtttctattctctttgtgtttccccaaatttgcttgttgacagcacatgtgcattgcttttggccaataaatgtttggcttatttaaagagttatcttgatgatagccaggtgtggtggctcacacttgtaatcccagaactttgggatgccaaggtgagcagatcacctgaggtcaggagttcgagaccagcctggccaacatggtgaaaccccatctctattaaaaatacaaaaatcagtctatcttaaaaaaaaattagctaggtgtggtggcacgtgcctgtaatcccagctactcaggaggctgagacatgagaattgcttgaacctgagtggcagaggttgcagtgagccaagatcatgccactgcactccagcctgagcaacagagcgagactctgtctcgattaaacacacaaacacacacacacacacagttatcttgatggcagttcaggaacttgggagatgagggctgttctcctgaaaccctataagaaccctcaggtgggttatgccacccgttcactaatatcccatttacgggtgaagggaaaggtggaggagaccaaccaacccaccagcagtggcctcagtctcaaataaaacttagtccctgagttagaagccaacttaaccatggagaggaaagagttcatccgatgggactaaacctgctcacttccttccaagaaccaccccaagggttcatttcccaggcaccaggagccacccagctccaacatgctgttttctgtcttctggtgacttatcacttgttgtttcttcaagaataagccttcgttgttccaagtaaacatctcaaatgcacacattcttaaagtagtaagtcatgtatccacctgtgcatccaacaaattattatgtagtgaacacccatgagggacgtgctgctgtgttcaatgctggggacaccacagggggccacccacggacttggttcctgccatcatggagctctcggtccagtggaggaattagacatgaaccaaataaaacacagtcatgaatgtaaaaccagaaactagagtaagtgctcttgaaactgtcttagcaaaattatgactgagacagtgaaagagatttaacttgatcaattccatctttcttctaacctccaagctgtccttattcattcttgggtgtaggctgacctaactttgggagaaactgagttcatggttcatagtttgtagtttaaagcaaagatgataacagccctttcccaaagcagacctccttcttgcctggggactagattgcctttgttaggactaaaatcagccacaagattagaaactatggtttaggagtcaggcggctggaggttacaagattctgaccctccctaaactgttcctaagatcagtgcttgagataatttgcagaccctgcacgtgacgggtcaggtggcaccacccagatcgatcaactggctcatctgatcttgtggccccaacccaggaactgactcagcgcaagaggacagcttcgactccctatgatttcttccctgaccaatctgcactcctggctcactggcttcaactaaccacccctaccaagctgttcttaaaaactctgctccccaaatgcttgtggagactgatttgagtgataatcaaactccagtctcccacaatgcccctctgcatgaattactctctctgtattccaatccccctgtcttgataaatcagctctgtctaggcagcgggcaaggtggacccaatgggcggttacactctgtcgagaaggaacacagggagctgtggaaggcttccagaggaagtgcctgggctttgaagaatgagcaggcattaagtgggcaaaagagcatgtgcgagggtactgtgcaatgtgtcaccacccagggagagaggagaagtggactatgaggctggggacataaacacggtcctggccatggagggccttgtaaaccccatgaaggatgtttgctctttatcctaatatcaacatgaagtgattagaaggtagcaagcccttgattaaccaacaattctagatccttctccaaacttctcttttagggaaaggaaacctagaagtcaaaatataaggtggtgggatttcagttgaaaaggtgcccagggtcggcctcgggtcagtctatctttgggtctatcacaaacactatattaattgcccctattaatctttcatcatgtgccaggcattgtgatgatgtatactttatatccattggcacatgtaagcctcaccacaagatttagggcctatcattatgcccatttcacagatgaggaaactgaggttcaggggggcttgtaacatgtcccaaatggtgtagctagtaagtggcaatgccgaggctcaaatccctccaaagattctctctccaaaggtcattttcctttccctaagccatgctggtgcatctggggtcctggaaactaggagatgattttcagaattataagacttaggtcgtgcaagcttcttaatcatcaaagaaagtctggaaagagaagaagatgtttgcaggaagctgccacagaagagaacattttagacagaggaacagcatgaagaaccgaacacacgtggcatcccctaggggccatgaatatagcagggaggcaaccacagagttgggaagatccagagagaggcgggacagatacagtgggtcctgaaagtatgttaaatagagtcacagtgacacggcaaccaggagtggcaagggagccacagacacacatgattagacacaacaatcatgttttcaaggcacagcccacttagagatcacagcaagatgctttatccaatctccgccggcaatcagagcttgaaaaaggagcattgtcgtcaatcaacttccctttgggcaaaaggcacaggcaaaggagaagatacttcacccaccttttaataaatgtgtcttgaggagagagttggcccacagagtacggtctccaagatctaagactccacatgggtagtggcaggggagacaatgggaaccaacaggacattggctggaatcacaagtcacaccttcagtaaaccagaggagtcatttctctctcccttattgactctgggccctggagaaatgccacagaaattcatgagaagaggagttgaaggtagacggcacctggacattatttctgccagcccatttgagttcatctggtaaacattttgcatttggaagttgacatcgtttaataataactgtcaatgtcaatgatcaatgccatcataatggcacaaatacccttgtgggcttggggttgggaggggtacggtggggactgacttctttgtctcctgtcctttcaatggttataaataatgatgataataatttctatttgtgtagctttgtgattgcagagagctttaggcttcctgagagctttcacctatattacctcagctgatccctctacaatgtgcagtatctattttggtcccctctgggaacctgaggcttgacaaggtcaggaaaggccacaccatggcctgttcctgaaataggtgccacaaatgaaaatccttgcagagagtccaggcagataacataagtgaagaaagggaggaatgagaagcagtagggaatggtggggtctgtggtgaattggagtgcatgccccattgaaagacgggggtagctgcctatcttgtatccaccaactgtctccacgtgggaacatgggcccaatgctgtcagagcttctaataaattaagagaagctaaaagccagatgctatgtcagtctcccagtttttaaatgatcgcaactgggagtcttgcaactctgtctcccaggctgtaaggcagtggcacaatcctagctcactgcagcctcgaacccctaggctccaaagatcctcctgcctcagactaccgattagctcgaactacaggcatgtgtcaccatgcgtggctagttttcacaatgtttgtagaaatggggccatctcactatgttgcccaggctggtctcaaactcctgggctcaagcaatcctccctgctcagcttcccaattagctagaactacaggtgtgcaccaccacacctggctacaaactctccttgtcaccccctgttgacaggtctctttccttcacaggctgagacaactccaattcaactctgaatccccaatacaggacctgcccagggaacagggctcagacatttatgctgcgaaatactcagcttttggggctcagcgtccttttctgcaaaaagagttcccctcccaagaggaaatcccctaagcctaaggacaggaggtgatggaaagatggacggatgggcagatagatggatggaaaaaaaatggacagttggaaacagacaaacttggtggatgagcagaaataagcctcattctcgcctgacaatgggacagcctgggggaggggcgggacacaccaaggctcccagttgacccccagcaattggacaagagagtttataaaccagcatcggggttttaggagcattgtaagctgcagagtgcatggggtcttcagtgggaagcatctccttccccatccctgttctctgtcctggggttgcccatcaagctaatcacatgtccacccctggggtccctctggcctctgccactcttcaccaaagtacagttaaactccaggggcaaatgatgtgttgggggtgtggcagacagggattgtgtctcagcagagagggcacagcactcacaaaatagcttcaatagttccagggtcagtagatgtgcccgaagaggaaccccacatcgcaagtggcctaagcctggggtagggtgagcactgctcactcctgcccagaggagtagctgaggggcctaagctctagctctgagcccaccagccattccatccaccacccacctgaaactgttctgttgacccacagcaattggtcctggtgccaggcacagaacagatgctcagaagatacggttgatcctgtctgggtgcagtggctcacgcctgtaaacccagcactttgcgaggctgggatgggaggattgctggaggccaggagttcaagaccagcctgggcaacatagtgagatccccatctctataaaaataaaaattagctgagcatgatggtgtgcgcctgtagttccagctactcgggagactgaggtggaaggatagtctgagccaggagttcgaggctgcagtgagctacgatcatgacactacactccagcctgggagacgcagcaagaccctatttaaaaaaaaaaaatggtatggttaatctgcctttactgattacaaatcaataaatttgtattatcgtaataaatctgtctttattgattacaaggcactttctcatcccccatcacctaagacaactgcataaagaccgcatgagctataaagaccatttccttgccccaggtcacatggaggaaaagagacagagccaggatttaaacccctgcccctggctttcattcctttgctgtgtccctgcagacccgaggcccacctgggtgaagaacaggtgggtggacattggcagtgttcaccaggggaagcatgccaggtgcaaggaaacatgtgagcacctgtccgtgcccaatgggtctctgtttgtctccctgcatcttcacccaaaccagcttctcacacccccacggccaccaccagcactccaggcctctacctgggccctttaatgccccttccccattcctcaagagcccactggggtcccttccctgatggcctgctggcctcctgcctccctccctgacctcagcctcctcggattttcaacagcctggggttgcaggctgagctcagcatctggcaggggcctggaagaaatgacctctagagggcccacactctctgggtgtcatattttggggctattatcacaaaataccttagactgggtaatttataaatgacagaagtgtgttgctcacagttctggaggctgggatgtcccagatcaaggcacctgcagattcagtgcctggtgaggagggctcactctgcatcataggtggtaccttgttgccatgtccttatatggcaaaagaggcaaaggcgcttgctcaagccccttttataaaagggggcactaatcccattcatgaaggtggattcctcatgaattagtcacttcctaaggggcccctcttactactatcacattgggtattaagttccaacatatgaattcaaggggaacaatgacattcagaccatagcaccagacgtctatctggggaagcccccaaatatttgtcttttttttttttttttttttttggaggcaaggtctgcctctgtcattcaggctggagtgcaatggcacaatcacagctcactgcagctttgaactcctgggctcaagtgatcctcctatctcagcctccccagtagctaggaccacagatgtgcactaccacatccgactatttttttattttagtttttttgtagagacagagtctcaccatgttgcccaggctgatctcgaactcctgaccccaagcaatcctcccaccacctcagcctcccaaagtgctgggatcacgagtgtgagccatcatgcccagccagccccctcatatttgatccaggcattaagcctcctggcaagaccagcagctccctgcacctgaggcagggctgagtttcagaagctgcttttcattctcagactatgctgagcctggtactgtgcacacagcacatctgaactttgttcaacatatccctgcaccaacctggcaggacggcctcaggccagggaggaaccggggagatgatgtgggatgagaagagagatcagacagaggctgtctagacacagtttcctggcaaagtcaccaagagccctgcgagcagctgtccacacctcctggcactctctgtatctgtcccgtccctgccagctccccacccgcccagtgcttcaccagctcacccctcagacactgtccaggtgggaaccattcccctcaactccctccagaacaaccagatggcacctgccagcagccctgggagccagaatcccacccacctgacccaagggctctatctgatctcagcctaacccatgaatcaggccctttggagagccaaaggaaaattgggcttccctgccagctgactatgtgacagttcagatgtcccagagcacaggaaagaggcagagacagggtcgtgaggagcccttgcttctccttcaacatctcccataaacagctggagaggggctctcacagggtccatgggaagagaccaaggaggggcatggaggagaggggagggctgagaagaccagggtgaaatggatgaggagaaggaagcagatggcagggaccctcccatctcccacatgggcctccttaggtgctactggccttgtgcaaatttgcacactcacattcacacatttctgtctgcttctctccaatctttcagatacctagcacacaccccagcctctagaatcaggtagtcagtctagcagagtctttagcatttgacttctgggtttaaatcctggctttagcacttcctagcttcacggccctgtttaggcagtttatatgcctccctgagcttcccaaattttggggaggaataaatggcatagcagatggggaacatctagcactgtcctgctatatcatagactgtgaaagatcactgtttttgtactattggccttgctttgtagtaattatcattaacttttttttgagataaggtctcactctgtctcccagcctagtgtgatcatagttcactgccacctcgatctcctgggcttaagtgatcctcccacctcagcctcccaagtagctgggactacaggcacacaccaccacacttggctaatctctctcctttttttttttttttttttttttagagaccgggtctcattatgttgcccaggctggcctcccaaagtgctaggattacaggtgtgagccactgcacacggcctactttgtaataataacaaacaatacagccgctactttttggtagtttcaaaccatgatcccagaattttttgattcatcaaaaggtagaacctatgtcatctaccgttgaatccagactgtgcgattgcttgaccaatagaatatagaagaaacgttatgcgacatccaaggctacatcataaaatgtgacagagcttccactgggttctccttgtcttagagcccagccaccatacgatgaggaagcccaagtagctgaagagaggagaggcccaaacaaaggaaccaagtcccctggaccacagcctagctgagctcccagccaaccagaaagcgccaacttagcaaccactagaggagccatctcagaaatgaattctgcagccccctggtgagctccagctgatgccacgtggagcaggaacgaactgtcccctcaacatcctgcccaaattgtggatgtgtgagcaaaataaatgactgtcatgttttaagctactacatgttgggtggtttgttgcacagccatagacaactggatgacaaacacatatctgacgctttatccgtcattgccatgctaagctgcagatatttttgtaatctacacgtttagaccttttccagcttttagagctcacacttcccttcagtacacctgcaagctccctgaattcattttcatgtaatcctccacttttttccttcagccggttcatgttaggtttctctcatagcccctaaacacagtgctcaaataccaataacctggatcccatcttgcagctctgcaggaagctgtttttgcacaaggttcttccacatttctgggaacccaggagatgtctacttcagctacaatctctcctgctcgtcccctgtcccctcgggagggtctggctcagaacagatttcactgtgggacccaagccaacctgttagccactcctaccccaggacggttgaaacagtctttcagtaacaagacttacttttgaaggatggaattacaatatggaaaaaatacaacttcacaaggtacacgttcagttcatagcagcagccaagactttgaaggaagagttcaagtcgccacaaaaacatagcagagggaatagtacggattttagagccagatagtactggagacttggagactgcagggctgggagggtcacagacagtcctgagttcaaatctccactccaccactcattgcccacgtgaccttgagcaagttatttaacctctctgagcctccatttcctcaaaggcaaattggggataataaacgcagtgtttgtgaggatagataggatgcatattctgctcgtggttgtgccaaccaaggacacattcagagtaaattcaagactcttcttgaagagtcacgagcacagtggcccatggcagtaatcccagcactttgggagggtgaggcgggtggatcacttgaggtcaggagctcaagaccagcctggacaacatgttgaaaccttgtctctactaaaaatacaataaattagcagggcgtaggcatgcctgtagtcccagctactcagaagtttgaggcaggacaatcccttgaacctgagagatggaggttgcagccgctgcagtccagccagcctggatgacagagagagactgtctcaaaatacaaataaaataaaataaaaaaagaatgagactcttcttactgcaaaaactgacctctgcggggtggaaacaaacaaacaaatgagcaaaaaccattgttcttgcctagctgttaaagaatattgcgttttctcataacttgacacgatacagaaacatacaatgaagaatctggtgggtattgaactgtcaattgcaaaataattattcatcactgcaggtccagcctgttctccgggaaggactgtttgaatgtcctgggcctccaagccaagctcccagagcccagaccatctctttggctaatgctggctctatctcctgaagaaaatagtttgatgcaaggaagaactttcattatcttttgccctggagcaccagtaactgtctacaaagagcagagcaagggaagaagggcagtgagaaattaatctttgagtttcctccttggtgattcatccatttagaaatgggtagattcagagaagtgtttcttcatccggtccctctgttcccatgatctcaaaaatgaaaaggcagccaaccctgatcaccacccatcagtcagcctcttttcacaagtgggaggcatgggctgtgctggaccaagtgcaaatgcaagacatgtctctaacaggccttctggaaccaggggaagctggtggcttggatgcacccactgtgaggtagagtgttatactgcagcccccataaccctgcacttctccaagtctatgattatttgactctggaatctggtgtagcacatctgctcagttgctcagtcattacttactgagcacttacaatgtgccaggacaggcagggtataaaggattgagaattgaacaaggtagtcaaggtagtatgatccctgccctcaaagagcttgttttagtatatagggtttctcaactttggcaccattgtgggctgaataattctttgttgtggggctgtcctatgtactataattttttttttttttgagacagagtctcgctctgtcgcccaggctggagtgcagtggcgctatctcagctcactgcaacctctgtctcctgggttcaagtgattctcctgcctcagcctcccgagtagctgagattacaggcaccaaccaccacgcctggctaatttttgtatttttagtagaaacgcggtttcaccgtgttggccagggtcgtctcgaactcctgacctcaggtgatccacccacctcggcctcccaaaatattgggattatgggcatgagccaccacgcccggcccactataaaaactttagcagcatccatggcctctatccactagattccaatatcacaccctttctcccaattatgacaaccaaaaatgtctccaagcattttcaaatttcacccgagggtcaaaattcaccccaccccactcctaccattcacgattgagaacctctattccaatgaaagaagcaggcagcttagtggaaagagtgtgagcttcggagccaggtgggcctgggttctcccttccactttattagctgcgtgatctttggggaatcacttctctctcttacgcatacgtagattatttgaaaattatgggtagcaatcatatttttacaaggttgttgggtgagctaaagatcaaatgtgtaaagaactgtggcaggctgggcacggtggctcacacgtgtaatcccagcactttaggaggccaaggcgggtggatcacctgaggtcaggagttcgagaccagcctggccaacatggtgaaatcctgtctctactaaaaatacaaaaatcagccaggtgtggtgccacacgcctgtaatcccagctacccgggaggctgaggcaggagaatcgcttgaactcaggaggcagaggttgcagtgagctgagatcacgccactgcactccagcctgggtgacagagcgagacaccatctcaaaaaaacaaacaaaaaacaggggcagacactgtcaacaccaaaagtcatcctcttgtcttaattcttcttgctaacagaaccccagttctttcaagggtccctatctcagaagttgggctcagtccctagagggggtgggcatgcaaaccaggtctagttaatgagctatttgagggagggggccctctgggggtagaaggttaataaaaagtttggttattttatttttatgcttttatttttttagagacaggaccttgctctgttgcccaggctagagtacagtgccacaatcatagctcactgcagcctcgaactcctgggctaaaggaaggtggggactagaagatggataagcactccacacttgttagctatctattattgctgttagcactgtcattatcagtattttttttttttttgacggagtctcgctctgtcactcaggctggagtacagtggtgcactctcggctcactgcaacctccgcctcccaggttcaagcaattctcctgcctcagcatcccaagtagctgggagtacaggcgcctgccaccacgcccggctaatttttgtatttttagtagagacagggtttcaccatattggccaggctggtctcaaactcctgaccttgtgatccgcccgcctcggcctcccaaagcgctgggattacaggcgtgagccaccacgcccagccctttttgttttttttttttttttgaaacagggtctcgctctgtcacccaggctggagtgcaatggtgcaatcttggctcactgcaacctccacctcccaggttcaagcaattctcctgcctcagcctctcgagtagctgggagtacaggcacgtgtcaccacgcccagctaatttttgcatttttagtagagatggggtttcaccatgttggccaggctggtcttgaactcctgacttcaggtgatccacccactttggcctcccaaagtgctgggattagagacatgagccaccgcgcctggcccaaatttcattttttttttttagacagagacagtgtcttgctctgtcacccaggctgcaatcagtggcgtgatcatagctcactgcagcctcaaactcctgggctcaagagatcctcctgcctcagcctcctgagtagctgggactacaggtacatgccaccacgtccgactattatttttattttttgtaaagatggggtctcattatgttgcccaggctggcctcaaattcctgggctcaagccatcctcccacctcagcctcccaaagtgctgggattacagatgtgagccaccacacccagcccaaattccaattttctaaagaatctggggctctctgtgttttaagactattagactctccccagtttcaggggatgaatcttgagcagtctgatggagggctggcaaaccattgcctaaacccggcccaccacctgcttttgtatggctcaggagctggaaatggcttttacatttttaagtagttagaaaagatcaaaagtgtaataatatctcctaacacataaaaattaggtgaaattcaaatctcagtctccataaataaacccattcacttatttattatcatctatagctgctttcacactgcaacagcagaacagagtggttgctacagaaactgtgtggccacaagcctgaaatatttattctctggctcttcagaggaaaagatcttaggaaaccagaggttctcaaactcagtgtccatcagaaacccccggagggcacgtttaaacatagactatgggccgggcgcagtggctcacgcctgtaattctaacactttgggaggctgagagtttgagaccagagcattgtttaagccaagagtttgagaccagactggacaacatagcaagaccctgtctctacaaaaaataaaaaaattagctgggtgtgggggtgcacacctctagtcctggctacatgggaggctgaggcaggaggatcgctcgagcccaggagttggaggctgcaatgcgctatgatagtgtcactgtactcctgcctgggcaacagagaccccgattctagtaaataaataaataaaaacatagatcccacccccagagtttctgatttagtaggtctgaactggggtctgagaatttgcagttcttaaaattgcctagacatggcagatgctgctggcctggggatctcactttaagaagcactggtctaaggcaaccttggtaattccattcccttgccagcaactggcttagaaaagggcacgtgatacatttctgaccaatgcgatgaaggagaagtcagctggcagcttctgagaaaatgagaaaatgatcataaaaagggacagatgggctgggcgtggtggctcacatctgtaaccctagtgctttgggaggttgaggcaagaggatcacttgaggcccagagttcgagaccagcctgggcaacagagggagacctcatctctagaaaaaactctgaagttagctgggtatggtagcatgcacctatagtcccagctactcaggaaactgaaggaggatcacttgagcctagaagttcaaggctgcagcgagctatgattgcaccactacactccagtctgggtgacagagcgagaccctgtctcaaaaacaagcggggaacaagtggaagaaggctctcttctctcttgtccatattatcttgagaccatgatggggtgtggctgagggcaagagccagctgctaagaatggaatagtggaaaagtggaaggaaacaaggcccaccattccacaatggagccactgaatcaattaaccacatggccccctgcagagaaacaataacttccattagcatctacaccacttccagttgggttctcagtgatttgaagccaaacacaacctacctggcaaccctacaacttcacccctcaccactgtttggacactaccaaacttaggccatgatgattaaggccaggcatgagctccaccctccctgccaccctatgaggaataaagcagatatggggaaggtgaaagggcatgatttagggatccataaagccccagattggagccttagttctacaactcaataatggtgggctagagctctatgcaccccatactctaggatggggactcatacctgcatggttgactagtgcagtcatgtctgtgcatctgagcagttattttcttctctggaccattattaaccattagagctagcatttgtccccaggtcccgggcactgtgcaagtcttcacctacattatcctactacctcataagatagtttggatgtgtgtcccctccaaacctcatgttgaaatgtgatccccaatgttggaggcggggcttggcgagaggtatttgggtggtgggagcagatccctcatgaatagcttggtgccctccctgagtaatgagtgagttctcactcttttagttcacggcgaggtctgattgttaaaaaagtgtttggcacccttcctgtctctctctcacccctcttctcaccatgtgacacacctgctcccctttcaccctccacagtgaagaaaagcttcctgaggtctcaccagaagcagatgctggcatcatgcttcttgtacagtctgcagaacgtgagctaaacaaacctcttttcttataaattactcaccctcaagtattcctttatggcaacgcaaaacaggctaagacacctcaatggactaatacataacagccccataaggtgagtgccaccatctcccccaccttacagatcaggaaacaggggctctgaaaaactgtggctcactcaaggtcatactgcttgttaagtgcagagataggattccaactcagaggcatctggctcaagaacccatgtgtctgtgtttcaggttgcaatgctgaggttaaacaagaggatgtgtgctaggagccccagcacaccacaggggctgggaaacgttattgcatcgagtttgagtccaacacacggtctcattcctccacccaccactcagcctagaaaaagggtcggaaggttgactccactttcagaagcttgccagctccagccagtcagccagagtgaagctgacaagagcaatgagggaaatacggaaagataaatccagatgtggacaatgagaccgtgtcccctgagaactgtggtggcagcgggactcaaagatccaggcctgctcggtgtggctgcggctcgggttcctgggccacagggctgccttacctgccagtttccatgcctggctgactccccccaccgcccctctggcttccacaccagcccactgatgccaccccagagaactcggctgtttgccttgctcctctagagggcaggtggatgcggtgaaacgggcagcgattccagagccatcacaactcctggctgaaaccaaacatgacagatttaccattgggcaggctgctccatttattatttaacgctcgcaataaatatttgcatgacccagtgctggagggaacgctctgtgataactcactgcattttcctgccaaacaccagcacagtcggattccgaagctgcagcagagaatattttatgctattctaaaaatccaggtgatggccccttgttagaaaaccttttctcatccatttccatagaggaaaaaaggagcagggagaccttagctccgagaagcaactagaggaggaagaagaggaggaggaagatgctgacaggtgacatttacttagcacctactgagtgccaggccctaagctaaggacttcacactcattcattcaacacctctctctagagggtagggttgccagacttaacaagtaaaaatatacgacacccaattcaattttaaatccagtgaaataaggaatgattttttaaatacaagttatgtatctgatgtaatactggaaaattattcaatgtttatctaaggttcaaatttgggtgcaatggcacgcccttatattcccagctacttggaaggctgaggcagggaaatcacttgaacccgggaggcagaagttgcagtgagccatgatcatgccactgcactacagcctgggcgacagagcgagactctgtctcaaaaaaaaaaaaaaaaaaaatagaacaaactgggctacaaagttttgccaggcatggtggctcacgcctgtcaccccagcactttgggaggccaaggtgggcagatcacctgagatcaggagttcgagaccaacctggccaacagggcaaaaacccatctctactaaaaatacaaacattagccaggcctggtggtgcacgtctgtaattccagctactcgggaggctgaggcatcagcatcacttgaacctgggaggcagaggttgcagtgagccaagatcatgccactgcactccagcctgggggatagagtgagactctgtctcaaaaaaaaaaaaaaaaaaaaaaatgtaactgggcatcctgtttgtatctggtaacactccttaaggttggactaactatgcgaagacactgaatttaaaaggcttttcttttcatttattttttaagagacgtatctgtgtaactcaggctgcagtgcaatggctattcacagggatgatcagggctcactgtagcctcaaactcccaggcttaagagatggtcccacctcagcctcccaagcagctgggactacaagtacatgacactgcgtctggtgttcagtggtgcaatcacggctcactgcagccttgaactcctgggctcaagcaatcctcttgcctcagccaccagagtagctagaactatgggtatacagcaccacgcctcgctatttttttttttttttttttttttttttttttttttttagagatggggtctcaatgtgttgcccaggctgatctcaaactcccggtctcaagtgatcctcctacctcagtctcccaaagcactggaattacaggcatgagccaccacgtccagcctcttttttttctttaaggaggcttattttttagtgtgggttagggaagagccatgtgtgaagttgactctggagcagagatgtcaaagatgagaaagagctacccataacaaaaaaacggggaacaggattcctggcaaagaccccacaaagaccctggggctggaaaccatgtggggcattggaggagtcaagggaggtgacacttttggagctgagtaatggagaggaaagtgacaggagcagactgcacagggccttggtcacaatgaaggatttggatgctattctaagttaaagggaaggtatgggaaagcttttcagctggaagtggccaaactggggaccgactctggctgtacggatttctgagcctggagatggcacaaaggacctgacattggcaggaaaagaaaagaggaggaacaagaacacgagaaattgccttaaaagggagttggtcaggtctcgccagaaaagttcacgcaataacaaaccagtcgcccacaacagacatctccacattttcccagagctgtcccccagccaggcggccggagtgaggggatgccgacggtgacaatgctatcaatttccattttgcttttgccaaatacggaaaaggacacttcaaagacttttaaaaataacttccaaacaactcaagggtgaaaaaaaagaaagaggtaaaaaattacagtctgcctgcttgagaatagcgataatgaaaataagtgatagaaataagaacagctgcttttgcacacgttatgtcatctgctccttagcactctatgaagcaggcggaacaggtcatggtatccccatttcatagataaggaaactgagacccagaaacataggatacaacagagaggaaatgatcaggtgggtgagaagctatgtttgtctggccccaaagcctgggttccccaaagccctctgcaggctgatatgagcctaaccccagcccggctcctggctctcagccatctcatcctcccagcccagctatggggagcaagatacctcctaccatgtcccttgcagccttcctccctcacctgcaggggcttcctgcctggaaagcctgttcctttgcccttcttctccagaggattcacgtacctcagcacatgttcgacgacaaagtcacagcactgcagggacacctcccctggagaggaacaggatggtagagtggaaggggcacagctttgccattagaatgcctgagttcaaatcccagctcaatcaccaactggttgggtatccttaagctcttccaaggagtgggggataatccaatccatccccacaggatcctggtggggattaaatgagatgctgtatgtaaaacatcaacacagggccaggtgccatggctcacacctgtaacaccagcacattgggaggtggaggcaggagaatcgcttgaagccaggagtttgagactaacctgggcaacatagccagacccctatctatacaataaaatgtctttttaattagctgggtgtgatagcccatgcctgtaatcccagctacttgggaagctgagacaggaagattgcttaagcccaggagttcaaagctgtagtgagctatgatcatgccactgaactccagccatggtgacagaactagaccccaactctaaaaaaataaaaaacattaaaaaaaaatcagcacagtgcctggcatacagtcagcacctaataagtagtagctgttttttgttttttgtttttttttccatctctgaaaaaaaaaatcagccattttttaaaattagctgagtgtaatggtatatctctgtaatcccagctacttgggaagctgaagcagggggactgcttgaccccaggagtttgaagcttcagcgagctatgattgtgccactgaactccagccatggtgacagaacaagacccaatccctgaaaataaataaatcaattggcacagtgcctggcatatagtcagcacctaataagtagtagctgttagaatacttacaaaaggccaggcgtggtggctcacacctgtaatcccaacactttcagaggccaaggagggtggatggcctgaggtcaggagtttaagaccagcatggccaacacagtgaaaccccatctctgctaaaaatacacacacacgcaaaacaaatcactgggcatggtggcacatgcctgtagttagtctcagcttcttgagaggctgaggcaagaaaatcgcttgaacccaggatgcagagattgcagtgagccaagatagtaccactgcactccagcctgggtgatagagcaagactttgtctcaaaacaaacaaacaaacaaaaacaaaaaaaacactcaaatcatgggattgagtgttcaatcattcaatcaatttttattgaatgcctactacatgctaggtacttagggatataacaggaaataagacatacgtgattctaccttaatgaaacttagaagaaggaatatacttatggtgtagtgaaagaaacatatttattagaaatcaaacataaaaagcataaaaagtgttgaagagtgctctaaaagaacagaggtttctgtgaatcatctactttatttatttatttatttatttattttgagacagagttttgctctgtcacccaggctggagtgcagtggcgtgatctcagctcactgcaacctccacctcccaggttcaagcgattctcctgcctcagcctcccaagtagctgggattacaggcacccgccaccatgcctggcttatttttgtatttttagtagacacggggttttactatgttggccaggctggtcttgaactcctgatgtcaggtgatctgcctgcctcagcctcccaaagtgctgggattacaggcgtgagccactgcacccagcccagaatcatctactttagactgaggcatctgagacgtgctcaaaggacatttcagtggagaaccatgggtgtgaaggagggagtcacacggagactgggaagggacagacctttgtaggacagacggcaacacgtgcaaagcttgtgctgggaggtgaagggagaacaactcgctggaggaagcaaggaagaggagatttagttagagcagacagccaggatcagagcatgcagggtctgatcatttatttccaagttattctgaaatcaaagagaagcaggcttttaagctaagaatgcagcacatcggctagcatagaataagagttcaaaaaaagtgtaagctcccttccctctcctgaaacaaccaaagtaaataaaaatggcccctctgttttgaattatttatttatttgtgctttcaaactgttttcttaaaaaaaaaaaaactacagagtagtgagtgggggcgggggggtaaggggtggaatactcaaaacgtgttcaaaatcaaacgagccagaaactcctcgctggaaattttctctctagatctctgcaggaatcagtggaaccatgagagacagagtcgaaagcagcagagcctggaattatttctctaagcaagacccagacgccaggcaggtagtgaaattgctcctgccccacctccatccttgctgcctatctgagaacagagtctgccaacccctcctgatgagagactgacccctcatagccactgcaggctggaagccataagcttaaaccacttcgataccatgaaagcaaaatgtatggttggcaaaaagcaaaaaaaaaaaaaaaaaaaaactggttactggcgagtgcagaaccacagtctgggtcgatgacaaattatccagcatgaatcttggtgtgacttaggcccctcttagtcctctaaaattcatcacattttgtttattcgttcactacccacttacagtagatgccaagaaatatatataacaagattatagatataaatttaaaattaggactaaagaaagataatctagaataagaggtaaaagcagaacagagcaggatggaaggtagaataaagatatacaggccagaaggccagttactaaactggatttgagaacatggcgctgagttccctggtggccaagtcaaaaagggcagttggagatgttctcatggtccacaaaaagaaacacacttaactttgcagaacaagcactgtcctgccgtgtgacctcagataagtgatttaacctacttagactcagctgcctcattgccaaaaagttagtgaaaattattgaatgtttaggtaaaaagttgtaataaaaaacaagaatgggaaaggattccctatttaaaatggtgttgggaaaactggctagccatatgcagaaaactgaaactgggccccttccttacacctgatacaaaaattaactcaagattgattaaagtcttaaatgttagacctaaaaccataaaaacccaagaagaaaacctaggcaataccattcaggacataggcatgggcaaaggcttcatgactgaaacaccaaaagcaatggcaacaaaagccaaaattgacaaatgggatctaattaaactaaagagcttctgcacagcaaaacaaactatcatcagagtgaacaggcaacttacagaatgggagaaaagttttgcaatctatccatcgggctaatatccagaatccacaaggaacttaaacatatttataagaaaaaaacaaccccatccaaaagtggccggaggatatgaacagacacttctcaaaagaagacatttatgtggccaacaaacatgtgaagaaaagctcatcatcactggtcattagagaaatgcaaatcattgtcagagtgctcagagagggcatgttccctgggtcttggtggatttagaggtcaagggaccatttctggaagctcactgtgtgccagggcagcttatatcagagctccgctctttttctttttcttttttttttttaagacagagtctcactgttgcccaggctggagtgcagtggcaccattttggctcactgcaacctccacctcccgggtccaagagattctcctgcctcagcctcctgagtagctgggactacaggcatgcaccaccaccacacctggctaatttttgtatttttagtagagacggggtttcaccatgtgagcaaggctggtctcgatctcctgacctcaggtgatccacctgccttggcctctgaaggtgctgagattacagtcatgagccactgcgcttggccagagatctgctctggaagaccccccaggctggagggcactgccacaagcagacagtatggcgagggtccctatgaccacctggcaggcagggtggattctggagggaggtggcctgggagcaggctgaggatggggtgagggcatttgagcagcagagtgtctgcgtgaccgggcataactggagggacagtaaatgactcttgtgtgagaggatgagggaggggtgagaggggctgactacccccaggacttgaggtgcagtgagactccttagctttaaccagactcatgggagccatggaggtttgaggcagaggtgtgggctgctgggagagtgaggactcaccatccagagaggaaggtgaagctttcaactctaaatgccgttttattttcgtgtgttttttttttttttgagacagagtttcactcttattgcccaggctggagtgtgatagcacgagctcggctcactgcaacctctgcctcccgggttcaagcgattctcctgcctcaccctcccaagtagctgggattacaggcatgtgccaccatgcgtggctaattttatatttttagtagaaacagggtttctccgtgttggtcaggctggtctggaactcctggcttcaggtgatccgcccgccttggcctcccaaagtgctgggattacaggcatgagccactgtgcccggccccaaatgtgttttacattttcttcctatttgattcatctttgtcgtgcaacataaatatgctacttttccactgataaaaagacaaaatggaatttaaaattggcctggacttctcaaaaaagtcagtgtgatgaaaacatgttctagataaaacagaaatgagactgggcatggtggctcatgcctggaatcccagcaccttgggaggccaaggaaggagaatcacttgaggccaggagtttgtgaccagcctgggcaacatagtgagaccgcagatctactaaaaatttaaaaattagctgggcatggtggtgcatgcccgtatgtctggaggctgaggcaggaggatcgcttgagcccaggatctggaggctgaggcaggaggatcgcttgagcccaggatttggaggctgcagtgagctatgattgtgccactgcactccagtgtgggtgacagagtgagaccctgtctctatttaaaaaaagagagacaagatgatcaggatgagcgcagtggctcacgcctataatcccagcactttgggaggccaaagcaggtggatcacatgaggtcaggagtttgagaccggcccagcctagatggtgaaaccccgtttctactagaaataaaaaaatcagctgggtgtggtggggcacgcctgtgatcccagctactcgggagactgaggctggacaattgcttgaacctgggaggcagaagttgctgtgagcaagatgacaccactgtgctccagcctgggcaacaggaatgagactctgtctcaaacaaaaaaaaaaaaaaaaaaaaaaaagggatgatcaaacacaatgcgtcaacctcccggagctgttgtgagcaagatgacaccactgtgctccagcctgggcaacaggaatgagactctgtctcaaaaaaaaaaaaaaggggatgatcaaacacaatgcatcaacctcccggagccgtataaaccctaaacctaaaccaggaagcaggcaagcctgtgtgtgagtttccactctattgctggtaccactcggctctggcaacctggaaggccaccttcccctgttgttactgtgtaaggaggaaggagcactggtttgcaagtcagaagcctgggttgaagcctctgcttgagttcctgctggctgtgggaatgtggggttacctttcccggctggcctcgtttcctacatgtccaatgcaggggttccagtcacatgcattgggcaccattacatgtccaagctgtgccaggatctagataaatggctgggctcagtccaaggggccttcctatctggcagtgaaaataagaggagataccaagggccctgagcctgagtctggaggaaaagtcatgagcacagggcagtgccagggcctgggagctgccacagaggagcccaccttggtgacagacacctgtaggctcatatgatgccgagtgcccaacacagggaactggacaaaggtttcatgcacgactcttttccctccttggctaccttgaggaccttgattataatagttagcctttttttttttttctttttttgagactcttgctctgtcgcccaggttggaatgcagtggcaaaatcttggctcactgcaatcttcgcctctcaggttcaagtgactctccttcctcagcctccctagtagctgggattacaggcatgcaccactatgctcggctaatttttgtatttttactacagatggggtttcaccatgttggccaggctgatcttgaactgctgacctcaggtgatctgcccgcctgggcctcccaaaatcttgggattacaggtgtaagccactgagcccagccggattataatagccttttcatgcaccaggggctttatactcattatctcatttcattcatatgagttgaagtcagcttatcccccatttcacagatgaggaaaccaaggcccagagaggttaggaatttgtccaaggtcacacagccaggaagtaggattcaaacccagacagccaggctgtaatacctaggctcctctcaggctcatgcccttcccaggggtctgggaagccctgacctgcagcctgtcacctttgtttaccccccagcctccaggatattacgtgtgcaccggcgtgggatcctggaactggcaggaactgtgggttgtgttggtccctgaactcccatcgcctatgtgaaatatggttgcttttgtggcttgggaggccatggccagccccgcgatgccattgactggtgagtgcatgcctgggaccaggctgcaaaatccctcacactctggggtagtcaaggcttatgaggaagtacccaaaactgaagctggggtttggtccagggagatcccagtgtgcagtactactttgcaggcaggcagaggcctcttggataacatggccagtgaagccagatcttggtactagctgtgccttaccctggccatgggctgaaaacgttgccttaaaaaattggccaggagcggtggctcactcctgtaatcccagcactttgggaggccgaggccggcagatcacttgaggtcaggagttcaagaccagcctggccaatatggtgaaaccccatctctactaaaaatgcaaaaattagctgtgtgtggtggcaggcgtctgtaatctcagctactcgggagactgaggcaggagaattgcttgaacccgggaggcggagtttgcagtgagttgagattgcaccgctgtattccaacctggacaacagtgccaaaccctgtctcaaaagaaaaaaaataataataatataaagtgaccaggtgtgttgactcatgcctgtaatcccaccactttgggtcgaggcaggaggatcactggagcccaggagtttgaaacgagcctaggcaacagagtgaaaccctgtctctatattaaacacacacacacacacgcgtgcacacacacacacacacacacacatacaaaggcagccagactatgcactaggaactgccctgggaatccctttgtgttctcacaacaatcccatttcacatgaagaaacctaggcacagaaatattcagtaacgtgtccaggtgcggtggctcacgcctgtaatcccagtactttgggaggctgaggcaggcagatcacgaggtcaggagttcgagaccatcctggccaacatggtgaaaccccgtctctactaaaaatacaaaaattagctgtgtgtggtggcaggtgcctgtaattccagctactcaggaagctgaggcaggagaattgcttgaacccgggaggcagaggttgcaatgagccgagatcacaccactgcactccaacctgggtgacagagcaaaactccgtctgaaaaaaaaaaaaagaaatattaagtaacttgtctgaggccacatagttaccaagacgtgggagctgggacttgaacccaggcagtctggctggattcatgcctgcagcctctgcactcctgctacttactgtgtgagaagcgtctgttctgtggaaggttgtgggctgagatctttccatgacttccactcatttacccccaaggctgttcttaaagacgggcatgacagttatgcccattttacagatggggccctgaggctcacaagggcacgccattcacccatttccacaaagctatagttagttagcagagggcagaattcggccgcctctcccctagcttgtaggctgtgattgacacagaggtttttttgttgtcgttgctgttgtttgttcctttttcttttttttgagacagggtcttgctctgtcatcccggctggagcgcagtggtgcgatgtcagctcactgcaaactctgcctccaagatgcaaatgattctcgtgcctcagcctcccaagtagctagaattacaggtgtgcactaccacgcccagctgttttttgtagagatggggttagtagagatttgtttaatagagacggggtttcaccatggtctctactaaaccctgtctctactaaaaatacaaaaattacccaggcgtggtggcacatgcctgtagtcccagctactcaagaggctgaggcaggagaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaattttttgtgtgtttttattgtctcgagacagagtcttgctctgttgctcaggctggacagcaatggcgtgatcctggctcaccgcaacctccacctcctgggttcaagcaattctcctacctcagcctcccgagtagctgggattacaggtgcgtgccaccatgcctggctaatcttgtatttttagtagagacagggtttcgccatgttggtcaggctgctctcgaactcctgacctcgtgatccacctgcctcggcctctcaaagtgttgggattacaggcatgagccactgagcctggcctggtgactaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagggaggcaggcaggcaggcagggaccaagcttgggcacagccaggaaggcagagggcatggtggggccaatggaatcattacccaagacggggattttcagggaaacagcttagataaggccaggcgtacagtagctcccacctgtaatcccagcatttggggaggctgaggtaggaggactgcttgagcctgggagttcgagaccagcctaggcaacatagtaagaccccatatccataaaaaatttaaaaaaggagtttgtgttcctgtagtagcatagttgggaggttgaggtggcagtatcacttgagcccaggagttcaaggctaaagtgagctgattgagccactgcactccagcctgagcaacagagagatacgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtccagcctgggcgacagagaaagaccctgtctcttaaaaaaaaaaaaaaaaaaaatcttagataagaggatgctgtgcctccctgggggtcttcagtcacccatagtcctggcaagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctggcatagccagatgacttccgtgcccctgttgcaataaccactgcttccaagtctctatagaccaccccttgggtatatctaatgtaagtgatatttattttatttattttttgagtcagtctcgctctgtcacccaggctagagtgtgctgatgtgatctcggctcactacaacctctgcctcctgggttcaagcgattctcatgcctcagcctcccaagtggctgggactacaggcatgcaccatcacgcccagctaatttttgtattttttcagtagaggtggggtttcaccaagttggccaggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggatgacaaggaagaagatagaaatggcatcagataataaacagtgtaaatgtttatcagaaagaggctggtggtcgggacaagtaggaggattgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctgggtgacagagcaaactccagtctcaaaaaaaaaacaaataataatattttacataaccaaccacttctaaagattaaaaaaacccctacgattaaaaacctcaggtccctcaggcaatcataccagatattgaaacaaagcaataacataaggactgcagtattcattttatttttatattatttatttattcttccttagtttcttgagattatcatccgctgagggtggaaggggagtgagcagacacactcaggaggtgtcttgagattatcatccgctgagggtggagctgagggtggaaggggagtgagcagacactcgggaggtgtcttgagattatcatccgctgagggtggaaggggatagagcaggcactcggcaggtgtcttgagattatcatccgctgagggtagagctgagggtggaaggggagtgagcagacactcgggaggtgtcttgagattatcatccgctgagggtggaaggggatagagcacacactcggaaggtgtcttgaggctcagggagttatcaattatagaatgttgttgagttggaggaggtggctggtggcccatcctgttttttaaagtttcagctgtgaggtagggccagtagggcaatcctgaagaatgacgatgctccactgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtgtcagtgtcataatatcacccttccactgagtactgccgacagctagggggtaaagaaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaatagacagtaagagacagtaagagaggcatgaaaagcccattgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcgcgtgtaatcataggactcggcagcttttgaaggtacagaggccacacaagaaccagcttagctgagcatcatttaaggccctcatttggaattgtccctgtgggtaataagttacattcactcttcactaatttacagtcagggcccatttgctattacaaatacggaacctctgacacttagaatattagatgggggccccactgggtggggatgaaggtgtttttgcgcaacacagttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgatctgaaaaagccaacacatgagaaattgaatgttgagagagtctaagggccgtggcatcatctgcatcagcactgaactatcctgcaactgcggggaggaagctccttactttgcatctgtagtagtcctctgcccgccgccgcaacgcttgcgcacgttgaaacatttccctatggattacaatcactttcatcagataaagcaccactttcaggatgattttaaataatctgccatgtttctgttatcctcacaactgtacccttacacaatctatctctacctagaaaacgtatttcagatggctagaagagtacagtctgagccggtcacggtggctgacgcctgtaatcccagcactctgggagggcgaggcggatggatcacgaggtcaggagattgagaccatcctggctaatacggtgaaaccccgtctctactaaaaatacaaaaaattaggcgggggtggtggcaggcgcctgtaatcccagctactcgggaggctgaggcaggggaatcacttgaacctgggaggcggaggttgcagtgagccaagatcacgtcattgcactccagcctgggtgacacagcgagactccatctcagaaaaacaaaaacaaaaacaaaaacaaaaaaaactgtacagtctgatccaaactgttgctatattgattcctcctcttgcttactgcctgctgacttctgagatgatagtttccttccccattctcagtatatccctaattcatccttcattgagcatcttttatcataaagctgtattctctttgtattaatatctttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtactttgttttctgttttgtgaactctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctcctcttctctgtgctcacgttctttcatgcttagtttcctcagactagaagggagagaaatgcacacacatgatccaccagcacgtgtgggattccctctgcccttctggcatctgaaggctgtgattcaaagatcccccctgcaaccttcccacaaatgaaccaactgattctcacaactgaagggagaatggacacctcccattgagggataaaaaaaatcacactctggcctgctggcaagtcacctgtcatttccagctcatcttcatagttccatagttagtcctattctttagtaaatataaagactattaaaagcttctatgaggtgcactatgtgcgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaatatggtgtcattaaccccgcagttcactactgcactttgccatgattcaggactggaactcttgtcatcgactttaaagatcctgaaaaggcaatctgaatgctgggcgcatctattgaattagaaatgatcggaatggctcctaagtcagggtgttatgtcctgaaaataggtgacaacggcaaaccatccaccctggtgttgactgactttaacaaggttcaattcacagagattgagggcagaaaaaggaaacggcctcaaaagggtaagtttgctgtgttgccctcacaccacttgattcatggtcctgatcctaaggatctcacctgatacttggttttataggaaggatgtgtaaaattcccagaacgctaggaaacagggacgaaaacacttcaaagagaaagttaatgaacttgtttctgaccacagggcatccttcagcacatgctgtctggagtggcctcaaacaaggagtgtgtggtgaggtgctgacaatgcaatgggagcagggtcctgtccccacgctaaagaagctcacagtttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaaaccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgatccatactgaagtccactggctctggttgagacccagaagagtcatgcatcagaatagaggtggacaggaaataccctggcctttgtagggactgagcctgcagagacgacctcaattgcagcctgtacggaggacccctgaccatcccccagaagtagactcccatctcttctgcagcaagataacatgctactaggcctcaatgcattgttaaatattttttaaaaagtatctcacatttaacaaaaaaagatcagtcatatggcagcaaaatacaatgtagtatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggctgggcacggtggctcacgcctgtaatcccagcacactgggaggccgaggtgtgcggatcatgatgtcaggagttctagaccagcttggccaatatggtgaaaccccgcctctactaaaaatacaaaaattatctgggcatggtggcatatgcctgtagtcccagctactcaagaggctgagggataagaatcgtttgaacctgggaggcggaagttgcagtgagccaagatcatgccaccgcactctagcctgggtgacagagtgagactccgtctcaaaaaaaaaaaaaaaaaaaaaaaattggccgaatgtggcggcacacacctgtaatccaagctactcgggaagctgaggcagaattgcttcaaactgggaggcagaggttgcagtgagccaagattgcaccacagcactccagcctgggcgacagagcgagactctatctcaaaattaaaaaaaaaaaaaaaaaggctgggtgctgggtgtggtggctcacgcctctaatcccagcactttgggaggctgaggcgggtggattacctgaggtcagaagttcgagatcagcctggacaacatggtgaaaccccatatctagtaaaaatacaaaaattagctgggcatggtggtgggcacctgtaatcccagctacttgggaggctgaggcaggagaattgcttgaacccaaaaggcagtgagttgagattgtgccattgaactgcagcctgggcaacaagagcaaagccccatctcaggaaaaaaaaaaaaaaaaaaaaaaaaaaaaagagaaaggaaaaccaatgccagtactagcaactcctcttcccctgaaaaaatgacaaacaagaatgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttctttggcggtcttcctctttccattgattttgtcatgacggttgacttttgttgtcaccttcatcttacggattttagctcgaactttggtttccacctgtctccataaagtaaagatgtcttccaggacaattttaattcctggaaaggaagaaactcttttctttgtgtgcatacaaatggacttcagcccttggtgagagtgaggagaggagaaggtgagaaacctgagggcaagaagctgttctttccctttccagggcaaactcatttccacactatggggactccaacagagccataccttcctgtctacggcggttggacctcctggctctctgctgtacatccgtggatccatcatgtccattttgagatgggaagatagtcttcaggaaagacacctaggaaataataatataagaatgacggctgggcacggtggctcatgcgtataatcccagtactttgggaggccgaggcaggtggatcacggggtcaggagttgaagaccagcctggccaagatggtgaaaccccgtctctactaaaaatacaaaaattagccgggcatggcagtgggcgcctgtaatccgagctactcgggaggctgaggcagagaaccgtttgaagctgggaggcggagtttgcagtgagccgagatcacaccactgcactccagcctgagcgacagaatgagactctgtcacacacacacacacacacacacacacacacacacacacaaagaatgacatgaggctggcagggtggctcactcctgtaatcccagtactttgggaggccgaggcaggcggataacctgaggtcgggagtttgagaccagcctcaccaacatggagaaacgctgtctctgctaaaaattcaaaattagccaggcatggtggtgcatgcctgtaatcccagctagtcgcgaggctgaggcaggagaatcacttgaatccagcaggaaaaggttgtggtgagctgagattgtgccattgcactccaacctgggcaacaaaattcaaactctgtctcaaaaaaaaaaaaaaaaaataggccaggtgctgtagctcacgcctgtaatcccagcactttgggaggccgaggcgggtgaatcacaaggtcaagagatggagatcatcctgggcaacatggtgaaaccccgtctctactaaaaatacaaaaattagctgagcatggtggcccacgcctgtagtcccagctactcgggaggctgaggcaggagaactgcttgaacccaggaggcagagggtgcagtgagccaagatcccaccactgcactccagcctggtgacagagtgagactctgtctcaaaaaaaaaaaaaaaaaaaaatgacatgaatatacttcacacaactgaactgtacacttcaacacggttagatggtaattatcatcttgtaagtattttaccacaggttaacatgtttcacaacttgaaaaggaagtaattaattaccttcagctctctgagttctagaatttgtaacatttcaccccctgctccttcctgatctgcactggagcatctttcttctgtccctgctctactcagagttcactttcccttccctcacatcagcttcgttgaggctggtttgaacttaacgcaaaacattctcactaatgactgaattcccaccaagatttccatattatcacagtatgcttttaatcttcgaagatattaaatatttgttctcatcatagctaaaatgcaatgcaaatcccatctcagatgtgggtcagatacctatgaatctcctgaggtagtcattgaaatgacttttttcttgagacggagtgtcactcaaccatgctgaagtgcagtggcactaccttggctcacggcaacctccacctcccagattcaagcgattcttgtgcctcggcctcccaagtagctgggattacaggtgcctgctaccatgcctggctaatttttgtctttttagtagagatggggtttcactatgttggcccatctggtcttgaactcctgacctcaagtgatccacctgcctcagcctcccaaagtgctgggattacaggcatgagccaccacacctggcctgaaataatatctttcaaattctttgtagaacttgttttttcctgatttctgcacataggattaaaaaaaaatcatgtactaggatttcaagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatggcacccatgatgtccctgcttaggaggtaatggtatagatgactagatgacaaggacaaagatgagaggtgcaaagttgtccaagtccaacagctcaactgaactttcctaaatggaattgttaaaaagtggtaaatttaaaaacttcccctggctcacgtggtgactcacgcttgtaatcccagcactttgggaggctgaggcgggtggatcatttgaggtcgggttttgagactagcctggccaacatggtaaaaccccgactctactaaaaatacacaaattagctgggcatggtggtgggcacctgtaatcccagctacttgagaggctgaggcaggggaatcacttgaagccaggaggtggaggttgcagtgagccgagatcacaccattatactccagcctgggcaacagagggagactcctcttgggggtgagaaaagaaaaaaaaaaaagcttcctccaatttataccgaaaattctctgttcaggactaagtggcatagagaatgttaaatgtgcctagatatcttcataactcatatattttctgttttctacatatcttgaaaggcagtgccaaatgacgtgtaattatctaggcggtaaaactgaaacatacttcctcttcccttgaatataaaaaagcattgtggtttagtacttttatcttggatcattgttcagaaggaggttcagcccccacacaaccacatttttattgtcatgaatggcaagacaaaatgtagagctcaacttacgcaaaggataaaaggctcaaaagacaaattatggcacaacttagcagccaaattcttaccaagtatagacttttgacatactgatctcattccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctaccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagactttcccatttaagtgacgaaatctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaattgtttcatataatttattcttatttgtgattacaagtatacctctacagaaagttagtatactcacacaaaggtaacttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaaatttttttttttttttttgagacagagttccgctccactcagtcgcccaggctggagtgcagtggtgcaatctcggctcactgcaacctccagctcctgggctcaagccattctcctgcctcagcctcccgagcagctgagattacaggtctctgccaccatgcccgactaatttttgtatttttagtagagatgaggtttcaccatgttggccagtctggccttgaactcctgacaggcgatctgcctgcctcggcctcccaaagtgctgggattacaggtgtgagccaccgtgcccggccattttttttgtttttgtttgttgtttgtttttgagatggggtctcactctgtcacccaggctggagtgcagtggtgtgctctcggctcactgcaacctctgcctctcaggttcaagtgattctcctgcctcagcctcctgagtagctgggagtacaggtgcctgacagtgcactcagcaaatttttgtattttttgtggagatggggttttgccatgttggccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttatttttgttttgagacaaagtcttgctctgtcacccaggctagattgcagtggcatgatctcagctcactgcaacctccgcctcccgggttcaagcgattctcctgcctcagctactgagtaactgggattacaggcgcctgccaccacgctcggctaatttttgtctttttagtagaaacagggtttcaccatcttggccaggctggtctccaactcctgacctcatgatccacctgcctcggcctcccaaagtgctggcaatacaggtgtgagccactgcacctggccagtagttatcttttctttagttatttacttgttttttaaattgatgtataatattggatgcatttattatatatcacatggtaaaagaatccctctaaataatacttctctcttggattatatgaatctttgtcatttaaagctcagcataagtaaaaaaaaaaaaaatacaatgaagagattacttcattcacaaataagtatcgaattttagttcttaaaaagtaacaaggtgggctgggcgtggtggctcacgcctgcaatcccagcactttgggaagccgaggtgggtggaccgcgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccaagatcgcaccactgcacttcagcctgggtgacagagcgagactctgtctcaaaaaaaaaaaaaaaaaaattaccaaggtggagatcatgaaaatggcatgaatagcgtgggatttctctaagattgttgatattaattccattagactcttatgtgagtgaagacgaagacttcccctgagtaagttcagacagcttctgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccgtacaacaatggtaatgatttcagaaacatggtgttgagcagaataaagcagacacaaaagagtacctatggcatggcatgcatctgtatacgcgaaattccagaataagcaagctaacctatgataagaaagagactggctgggaagagtgagagttcactttctggggtgacataatagtgtagatcttggctgggcacggtggttcatgcctgtaatcccaacactttgggaggccgaggcaggcggatcacctgaggtcgggagttcaaaaccagcctgaccaacatggagaaaccctatctctactaaaaatacaaaattagctgggagtggtggcacatgtctgtaatcccagccactcgggaggctgaggcaggagaatcgctcgaacctgggaagcagaggttgcggtgagctgatattgccccattgcactccagcctcagcaacaagggagaaactgtctcaaaaaaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggccgaggcaggcagatcacgaggtcaagacatggagactatcctggcgaacatggtgaaacccagtctctactaaaaatacaaaaagtagccaggcgtggtggtctactaaaaatacaaacattagccaggcgtggtaatctgagctactcaggaggctgaggcaggacaattgcttgaaccccggaagcggaggttgcagtgagccgagatcttgccactgcactccagcctgggcaacagagtgagactctgtctaaaaaacaaacaaacaaaaaaaagtcatcaaaccagatgacacaaatcaaatgacatttcactttgttttggtccgttttgtctgttggagacaagagtgcaacagcgccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcagccccctaaagtgctgggattacaggcctgagctgtgtaatttcatgccgcgtgacacagcccagtaaaaaggaagaaaccccgcgggtccagcgtctactcacacaggtggactgatggctgataaatcccagcaggagccaaaagagcagccacagcacccatctactcacacaggtggactgatggctgataaatcccagcaggagccaaaagaggagccaaaagagcagccaccgcacccgcatgtcctggtcctttcagggcgccctgaggcagccaggacagaggtggaggtggcttagggcaggggggagggaaggggacggggaccgggccggatctgagttggggagggggaggggagggggaggggagggggaggggaaggggggaagtaagggaagggaaaggaggagaagggggctgttggggaggaggaggaggagaagaagaaaggggtctgggaaaggatccggttcaaattaagttctcaagcgctggtggaaggtttagctacaggtcacggagaagatcagggaagcaacaggacaggcggggcaagggagcgtgaggcttaggagcaattagagggagacaaaggttctgctttccaccaaaccttcttcggtctgggccctcccttagcaaccctggggctttagactctctctccaccaatccctgatgaccccggtggtgcctcacaatggacattccaagtagcgcccgcatcatcccaatgacccctcccccatctcagtcccccacgctcctcccaaggccaggtcctctctggaaccttcacaaacctgacttctggtcctccccaaccagctccctgtccctgcttctgggcgctccttccttcctgagctcccagggttcctcaaggtcacttttggcgacaaaacataaaaaacaaatgatggcaggatggcaggaagaacctcatacccaagcagagtgccaggttgtacagcctccgctcagccattcatatcctaagcaacaaaacatcagcaggatgcggaaggtcccgatagtaaaccatctccatcacatccatgtagccatccgtccatcaacctgtatctcaggaacaaatgtacatacattcattttaagcatgcatggtacatttacaaaaattaacctgacttattttgttccagcaaatctcaatatatttgagagcaatcaaatcacacagcatgtttctgatcataaaactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcacccctaacccacctagacattttaacatccgaaactgagtgatgatgtccttatctatgtcatcttactgcccgtgtgtgtggactttaaattctgaacccaaatgagggggagaaaaccaagctgactttcatgactgagctctcagggacgtccaaggaatctgtgcatttcaagaaacaaagttcatcagcttctctcctaaggtatttgcccacaatacccagagggcttggccgcatcatgtgtgatgggtggggagctccaagcaggcgggcaggacccaggggcctggtgaccaggacagacccccactgtccatcacctttcctggccctgtcctcagctaaacttcccacaggccttctgcccgatcacacagagtgtgcccaaactctctcaggcctctggcagctgaaaaccactgctttaaatccctttaccatttactatgacataaggttattgtaaacaggaaatattctattgatgctacaaatggaaagccaatgcctttaccataaatagaaaaacaaccctaagaaacaagcaaaacaaaaacaaaacaggggctgggggtggtggctcacgcctgtaatcccagcactttgggaggccgaggtgggcagatcacaaggtcaggagttccagaccagcctggccaatatggtgaaaccctgtctctaataaaatacaaaaattagccgggtgtggtggtgggcacctgtagtcccacctacttgggaggctgaggcaggagaacagtttgaacccgggaggcagagtctgcagtgagccgagattacaccactgcactccagcctagacgacagagcgagactctgtctcaaaaacagcaacaactacaaacaaacaaaaaacaggattaacaaaactatggaattcaattctatttatatgctgcagccatgttccagccctagatttggctgggcatggtggctcacgcctgtaatcccagcactttgggaggctgaggcaggcggatcacgaggttaggagttcgagaccagcctcaccaacatgctgaaaccccgtctctaccaaaaatacaaaaattagccaggcatggtggcacacgcctgtaatcccagctactcaggaggctgaggcaggacaatcccttgaacccgggaggcggaggttgcagtgagccgagatcgtaccattgcactccagcctgggtgacagaatggaatgagactctgtctcaaaaaaaaaaaaaaaaaaaaagaagccctagatttcggttgtgttggttgtaaaaggagagacccagtaagtgggggttgtgccgcagattgctacccacaatggacgggtcactgagcaggtccggccaactgggcgttccctcgctggagggccagcacaccagactgcaggtggcgcgggtcagcaaggtaccaggggatgtgtcacacacacagcccacccccgtccagtcacgcacggacaccctgggcttccgagcaaacctgctcccacgtggtgtgaccacatggagccacagacacccagcaaggacacgcagcccgcacacccccggtactccagacacagtgacctgcaccagggctcgaggtttctctagggaacccacctcttagaatcatccagaaacaagtcactcttcacctgtccagcaaaggcctgctgagaggtgcacagtgtctggagtccaagctgcgccaaggcggcaggacccccagcccagcccaggacccccagtagagccctcacctcagcgtggaggcctgagaacgtgaggaaggagctgtccagcacggacgagtccaggcagctgtcgatgtccagcacctactgcccggcaggtgtggggctcaggctcccagccacctgcaggacgacggcagtggtcagcgggcggcagctcagacctgctcaggacagggatgagaagccacctcctcagcagacaggacagagcccggtgccatctaacagaatgtcctagaatgctggatatatgggacatctgcaccgtccgtgatggcagcccctcgcgacatgtgccactgaacacttgacagcagactggtgcagctaaggaacagagttttgaatttcattttttttttttttttaagatggagtctcgctctgtcacccaggcaggagtgcactggcgcaatctcagctcactgcaacctccacctcccgcgttcaggcgattgtcctggctcagcctcctgagtagctgggattacaggtgcctgccacgatgcccagctaattttttgtatttttagtagagacggggtttcactgtgttggccaggctggtcttggaactcctgacctcaagtgatctgcccgcctccgcctcccaaagtgctgggattacaggtgtgagccaccacgcccggccatcgttccattttaattaactttaatacgagcagccacatgtggcctctggttcctgccacggactcgggagcaacccctcctggtcgcggcttatgcgccttctctgtgtgctgctggggttagtttgcatgtaacctcttgaggaccccacgtgtgcattcctaaggggtgcggcctcccgtttccgtatgaatgggaagagttcccacctgctgtattcttggaaagagtctgtgaaggattggtgttaattcttccttaactgcttagaaaaattctatcgtgaaggctctgagcccaagcttttctttgtgggattttttttttcttttttttggagatggagtcttgctccattgcccaggatggagtgcagtggcgcaatctcggctcactgcaagctccgcctcctgggttcatgccattctcctgcctcagcctctcgagtagctgggactacaggcgcccgccaccatgcccagctaagtttttgtatttgtagtagagacagggtttcattgtgttggccaggctggtctcgaactcctgacctcaactgatctgcccgcctcggcctcccaaagtgttgggattacaggcgtgagccaccgtgcctggccctttttaatgttttatatagatggggtcttgctatgttgcccaggctggtctcaaactcctggactcagatccgcccacctcggcctcctgaagtgttgggattacaggcgtgagccaccacacccggcccggccactgggaggtttctaagggactaactcggcctcttcacttgctatagatgtactgagattttcttctggagtgcatttcggaagcgtgcacagccgcgtgcttgcttcttctgagttatctggcgtgctgctgtgcagttgtccgtggcgtctgcttagcgaagtgccctcgttctttcacgattctggcttctgagtcttctctctttctccctggtcagtctagctaaggctgctcaagtgtgttgacccttcccgagcagcctttggtggacgcctttccctctggctgcagcactggaaagtggcggccctgggcatggtgccgaggcccaggctccattcccagtactcccgggtccccagccccagcccaccttgctccgggacatccggaagagaaagaggatggccaggtagacgggatagacaaccacgctggacaccaggccaacagcgactgtgtcgacgctcagcgggctcagcctggacacatgccccgtgctgtgtggaggagaggaggccacacaggtgaggctgaggggcaggaagggctgggcaggaagaggctgtcccgacccctacggcacccacctgtaggcagagtcaccaacagccccgtaccacacggcgttggcgcccaggaagaggcagatgaggagaacgcagcaggtggccctctggatgcgagtgaaacagctacgaggtggccggtcccatatggagagccagatgtgcttgtcaaagaagccacgctgcagctcagccaccagcaggcgccggaagcgcaacagggctgcgtgacctagaaggcagggagggccgcactgcaggaggccacggggcaggaccaccctgcccaacctcccacggagtgggaacatggaacgaggccttactcgcagccagcacctccttctccaccaggcccccgttggcctccgtctccaccgaaagccagtcattgaccaggaagaaggtgctgcgtgccgtctgcaggtccctgacgatgatgtgctgcaggaaccaggcagggctgagccctgcagaggcgcgggagggaggtcaggctcgcagggcgccccaatgcgggggcagaggggcagagcttggcagggtccgcacagacctttgttgtcgtgccacactcggatcttccacacgctacccaggctgtgcggggtggcgatccggaagatgtccagactgttgcggtggaaggctctgtcgccgtccaggtgccggtggccgctccggctgtccaccccatacagcatgatgcccacgtgggccgtggtacctggagggcaagagggaggggtgggaggctcggtctgctgcccaacacgtgtggcatcccaggcaagtcatctcagctttggcctccgcgcactcaaggagccacacaggcagtcccggctttgcacggctctgccatacacgaggagctgcggttactgcaatttgtccaataaacagcaggacctcaaggacatgattaagttacacggaaagaactgtaacttgtgacatgcaaacatggctgcacacgcctcagtccacaccacaaccagtgacccgcgctgcacacctgtccacgcctcagtcacgccacaaccagtgacccgcaccacacacccgtccctcagttcatgcacagactgcgaagcgtgaagctgtgtcacctcctctcccagtgacagacccaggtgacagtattttttttctttttttttttgagatggagtcttgctgtgtcacccaggctggagtgcagtggcgcaatctcagctcactgcaagctccgcctcccgggctcacgccattctcctgcctcagtctcccgaggagctgggactacaggtgcctgccaccacgccgggctaatttttttgtattttttagtagagacagggtttcaccgttagccaggatggtctcggtctcctgaccccgtgatttgcctgcctcggcctcccaaagtgctcggattacaggtgtgagccaccacgcccggccgacagtttttaaaagtaggtaatcaaaagaactgggaaatgaagatgaaagcaacacggaaataaaaaatgggaacacagccaggtgtggtggctcacacctgtcatcccagcactctggcaggccgaggcaggcggatcacctgaggtcaggagttcgcctggctgacatggtgaaaaattaactgggtgtggtggcgtgcacctgtactcccagctactcaggagaatcgcttaaggggaatcgcttaaacccaggagctggaagttgctgtgagccaagatcacgccattgcactccagcctgggcaacagagtgagactccgtctccaaaaaaagaaaaacgaaaacaaaaagggaatgccagaagggcaattccaataaaggaaaatggaggtattgaagaaacagccacggggagggtgctggcacctccgtctgagagacgagctatgcagtcaggatcgcgggtggatgcatggtctcccacagtggtagcgatgctcatgtcacttgtggggccacgctactgtgcagaacgtgggctgcccaccctgactgactggcacctacttccagctaggagctgtcctagtcctcagggacagtgagtgctcacgaggtcattcccaggatgaacacacgagcccttcacacagcactgcaaaaactgccttgttctgacgcctgcgacgagactcactcccagagggtgcaaccagcacagccagtgagagcaggggaggccctgccaccccgccgcgcccctcacctgagccccggccccagcctgtcttgacgaggatctcgtacttgaagcggccccgctgcccacagaaggggatggcgcagccccggctggcatccaactggtccagcttgtgcaggatggcggccatgaccatgtaggtcaccaggcacacagcacatgtcagcatgacgatgtagtttacatccgctgtcggctcctgtgaagacacagccgccgggcccaggaggtcacgtgcaagctgtgccttctcaggatagagccgagcccacccaggccctcctcgactctgcagaggctcccaggagcacagggtcactcacaggaaacacaaagcgtacatggcttgggggcatgaagaggctggcgccgaaggcggtgaggtggcgggtgaggcagacggcctggcggggcgaggtctcctccaggggcagcagcccctctgtccgccacaccacatcctcctcgctgaagtactggcacagggacgtgtacaagcccacggacacctccagcgccgaccagcggaagtggctggagaggttcagacggtaactccccactgggtctctggtcctgggaagggaaggggcagtggacgtgagcccaggctccgccaggttggatgtcggagtcccagagcccatacccggtccagtcccctcgctgcctgccgtccccacggggcccgtaacccgggcaatgctgacccatgatgccctgccctgccctgccaggccggcccgcagagctcaccccggggaaatgaagaaggtgtagggccggtggtcggcaccctggagggactctgggcggatcctcctgctagccgagcagttgcgctcattgggccggggctccgagtgcaggtagactgccaggtagggctcgggttcctcagacaggtagcggcctggggcagaacgcgcaggtcacacgcctgccgggaagctcaaccacccgggggacacccacgatggccctcctgagcccaccctctgccacgggcctgaaaggccataggagcctctgcaccagagctggcacctgcttctccgtggcccccagctcctctccggccaggcccccaacagcccatgaaacagcaaatttcaccagagacacccatggaagccctacgagaaacgccttccccccaagaacaaggccagggggccgcgtgtgccccacccgctgcacacaccgtccagcagcgtatagttgagctgcagatgcagcacggccacagggctgctgctgtccagggtgaccacagcaccgacggaggcctggggctggaccacaacggagttggcggagctgcggtggccccgggcagcccagtccgagttgttgggcaccttcacggtgatggcgcgctctgaggccagccgctcgatggggatctgggcgccggcctgtgtctggaacgccatcgaggccaccttggtggagacggtgtagttgctgatatagccaaagagaaagggattggagtccaccagaaagacgagctgcaccacgtcactgaggttggcgggggccctgctgaaagcctaggggatggagaggtggcagccaggccctggggcgccgccatagcacagcaggctccgcgggtccgagcgcttgccctgggccatgatctcctcgcccgccagcgtcacgggctcctcgttgagcacgcgggagcgcgtgaggatgcgcatgagggcagaggtcaggttgtaggcctgggacgccaccatccgcaatggtgactcggctcccagctctgagcgctgcggtgcccgcacgtctgagctggccaggtggatgaggtctcctgcagacaggcgtgaggtcagtgcagagacagggaggcagagggagggtgggggcaggcaaaaagggggagccggagggtgggggctgggagaaagggggaacctgagggggcagagagcgaggtgcaggcagaaggaagagggaagctggagagagagtggtggagggggagggggaaggggatggggatgaggacgaagatgagggggatgatggggagagggaggaaaaaggaaggaaaagggtagagaaaagagaaaggggagaagaagaggagcagggtgaaagggaggggaaggggataagggggataagggaggggaagggggataagggaggggaaggaggataagggggataagaaagatgaggggaatggacaaaaggacggggaggatcgggggggaaatggagaaaaggggagagagatggagaaaagggatggtaatagggaagggggagggggaggagaatgggaattgggggagggggataaggatgggaattgggggagggggatgaggatgggaattgggggagcgggatgaggatgggaattgggggagcgggatgaggatgggaattgggggagggggatgaggatgggaattggggggaggggagggggacgaagatgggatggggcaaaggcgaggcggttgtggggaggagggaggcagaggaaagggcggcatggggcggacgggccacgtggggcgggcgggtggcgtggggcacgggccgcggcacctgtgatgttgaggatgctgtctccgatggcggtgggcgtcacggtgcccgcggtggtctctgcctgcaggatgcgcatcatggcctccagcttgtgcagcgtctgcttcaggcacgagcggcatacgagctccctgctgggcccctgtgtggagccagcagtgtccagccccgctcctggccccactccttgcacacgccctcctctctacacgggtcctcacctggctcccacccccagccctgcagctggagagcccacttgactggacccccacagcctcctcactaagcattttttgtggctctgcatgacccagggcctccacctggggaacacgtgatgcagcccaccgaccacacaaggcacctcttcacatgagagaaggaggagggcagaagggagagaggagagggaagtggagaaaaggggggagaggagagggaaggagagagaagggggagaggagaggggaggggagagaaggggggagaggagggagggggaggaggggaggaaggaggaggggaggggtgaggggatggaggggctgggggaggagtggaggggctcagcgggatgaggtgaggggaaggtctaggggaggggaggaggggaagggctaggggaggggaggggctgggggaggaggcaggggctaggggaggggggagggactaggggagggaagggggaggggaggggttaggggagggaaggggaggggaggggctaggggagggaagggggaggggaggggagagtggagggcacagagcagcatcttcttagtccctccccacatctgggcccctctttacaccctgggtcccccgagaggcaccctgcgttcacacaggacagcagaatggctgaggctactgaagcaggtcagagaccgaggaacgccatggcaggaaggagcccaggctggaggctcagctcctcggccaagctgcccgtctgccctggggggctgaacccagtaccctggcaggcatgcggggcggggagagcatgtggggccatcctaccatgcactgggccagcgcagcagcgatctgctggatgtcatccacagtgtggaccctcagggacaccagagtctccgtgatgttcttgcgtatctgggctcggcgctgccgctcgtgcttgggctctgccgccacgtccagggcccgctcgtactggggcaggcagggggcacagcaagctgtcagcagggcaggaggccggcaggaggccagcagatgcccacgactcccggggtgcagttacgtgctagatgctgtgtgatgtgggcactgacccgcaacactgagctgtttcttcatgggcaaaacagggtaagcacatgggccctcctgggcgggggctgcattgtggaaagcagacgccggagagggcccggtgggtgtggctgctgggagcggaacgtcggggtgctgcttcagggtcactgggatttatctctggggcccgggatgagccctccgcaaagctccaggcaggggaacaggtcttggtccccagcacgcatgcagcagatgtgaggtcccctcccaggctgcactcacctcgttcagcacagtgaccagggccagcgagtactcgatgacgtgctggggatcggcctgccgcagcagccccgggagcacactagcggtgagcccgtgcagccagactgtgagccccattgcgctgccgttgggctctgggagggtgatggccagagacctacgagcagaggggggtggtgagtaggtggcagtctcgggggcgccctcccacggcctggctcacctgttgagggcgaccacagcggctcccagctggtcctgcaccaccacggccaggcccacctcgaagtgtggcctgaaacccgggggcagcacggctccgtagccggagaggctgcccttgtagacacagaactcctcgcagtggccctggcgacagcgctgcagcagcagggcgtacaccagcggggcgccagcatcctccgcgtcatgccagcctgagggacggtccccacggcatcacgggagggctccgtgacctcacagagtcgggggatcccgctgctccccctacgcaggcctgcactcacccatgcattcgaagtgcaccttggtggtgagagcgtgcacagcgcccagtgggaagaggcggcaagagccccccagcggcgggcggttgggggacagggggatggaggcgcagccctcctccttgccagagcggcccagcaccgtcagcgtgaaggtgtatccctcgccgtcccgcagcacgccccgccgcagcaccagtcacatgcctgcgctgcccgtggatgtggtggtctcatccagcaccagcgtcttgttgctgaacgtacgtgcagcccaccgctgcaggcagaagggatggtgagggggcgcaaccctctgccctgtcagccccacttctgcctgcaggccccgtcccctcggccatgggacccatccccaacccgcccacaccccgctcaacactcacccctcgcttggagccgctgctgcaattgaggcagcggccctccaggtacacgtaggagctgcggctcacttcgtacacggcctgtgccttgcaggacacacactccaaggacacaatgggcacccggccactgcggatcagcacctggcgtgggagtggggttacctccaacacaggtctatttggcctgctggaaggtctgggggacccgtggaggatgctgctcccaaactccaggtttcccaggggcctggccactgccggtgagctcaccccctcccaggatactcatccggtttgccaccttccaacctgggcggcggaagggcatacacagggcagaggacactggggtgtgcgttctggtgtactggagccagctggaccctggcaggaggcaggcaatgctcactgagggcccctggggggatgcgtgtgggaacagacgtatgtgtgggtgtgaggaccgcagttgccacgtaggcctgactcacagactcctgcagcccttagccagggcctgggtcaggaggctgagccgggatggaacctgctcccacaccctcccctcagacgacccctctgggcagacccccaatcaggccagctgaggaaagcagggactggggaacagacacccactctggggtaccagcaggccccagtcagggaggcgcacacgctcacagagggcagggaggcgcacacgctcacaggcacctgctgcgtccggttctcgaaggcattagatgccagcaaggtcaggacgtactcacctgtggggacaggcccaagtggggcagccgcggcacccccacctgctccccacccgctcggcagaagccccccgcctgaggagcccggggtgaacggctgcacctgcggcccagccttaagggtcccaggctcccaagccacgtgcgggacggagcacaggtgcagcagcactgagggctgcctggtgaggacggcaccgcctccaagtgcagctgcactcggggcagcagagcagcaagagccaggccgcggtggggggcagttcagggggcccagcttccctgtccactcctcccacgcctggcccctccctcaccccagtaggggcctaagccatcagcccaggtgaggtcacagtgagggctgttggggaggaagcggggcagcttgactgggggactgggggggccccgtgctcagagcctgaaaggcagtggccccctcaccccctcatccctcacctggggcagcgtaggtgtgggtgacattgtgctccaccagcacctgggccaccgaggggtctggaaccgggaaggactcgttgtacggaggctggaactggtggagggcctgctccccatccccaaaggtccacctgccggggcggtgggaggcagtgagtgaaccgggacaggggtgcgcagtggcggggcacaggtgcgcggtggcggggcagggggtgcttgggacccagccgaggctccactctgcagtcacgccccgggcctccattcagggcccacccggctgtgctgaggcctctcccggctcccgtgcagcctcagggctcctgtgcacccagtacctcccaacagacagggaaaccgaggctcagaaaagcaaccccctgatgtggggtccctcggctgaggctggagccgggacaagagcctggtgcccggacaagagcctggtgcccaccccaaaccggcccctgagtcactcacaggaaggccacctccacggccgagtccaccagcacgcccgccgtcagtgccagcgtggcattgggggacagcacggctggcactgtagagacccgcaggccctgcatcctgttcatccgctccacggtgatgttgtagttcacggtgacgttgctcacgtggttggaggccgtcagctgcagggacaggcatcagtgggcccaggtggcaggtgagaggcctgccctgcttggcgtccctccctccactcaccacagccatggcagcgtcctcgggcagcatgaagcagagcagaaggcagaggtgaaggtggagcccgcccccgccccgccccatcccctcccctccccactcccgcccacctactgagagcttgaagaccgccgcgctctgataaatgacattgaagaccacgttctggaaggtcagggactgcttgtcgttgatggtccaccggaagaccatgtccgagccggcctccaccacggggctgtacctctgcggggggactggtgtcagcctgggctctgtggaggactctgcccttagcctgtcgcctcctggacacacctcccgtcgggctggagagtcccacgcggggcacagaggagaggaggtgcccggggctctgcatgccatgagagccaagcccgggctgggacactgactgtccggctctccagccagccatgtagtactactaatgcctcaacctctctgtgcctcagtttccccatctgtaaagcaaacctagtaccagctacaaagagtccacctctctctgagtcttctcagaccctcccggggctcctgccccagctcctcagccagagagctcggagcagtgaggggaggcacacgggcctcacagggacagcacctacactggcttacagaacccaggacaggctgcacaggtcacgccatttctgatggcccctcccaaggcccctggtgaaggggcaggtacccgcaagatggaacagccctgtcccccatgtacccagcatggtggcactgcgggcagcccgcagtttcccatcaggggttcggactccacctcaaaagccacttgctttagccaggcgagaacacagcagagggcgtgagagactcacggggactcgtgtgaggtcagggagcggagttttaaattcatttcgtgaaatgagacggtggaatgagttagcggagccgctgtcagagccgtgactttccaggaatttaaagcccaccaggtagcctgaggagccagccagcaggacctgcccggggccgacgtccccagtaactgggctgctgccctcactgggaagccaggcctcaagccctgtgtgagcaccctgtctgcaggcacctgcctgggggctggtggtggagcctcggccatactcaccactgggactccctgcagtacacgggcctcggggctgggcgtggcgcggaggccacagatgggctcctccgccgtcacccgcaggctgaggttggcccggctggcgctgttttccaccacaacgtccatcacgtgctccccctcaccgagccacggcagtgctaccactgagaacagggtatcattggtctcccaggggcagccgggcacgaaggtggccaccagggcagggcaggcattctcaaagcgggcgctgacactgcccccaggccagcgagccgtggccgtggcgctggcaccagagtccacctggagcaccgaggctgagccgttggtgggcacgtagaggcggccgtcgcggggggcagggtagatgacccgcagcccagccactggggagaccacgtcaaagctgcaggacaggttgtgcctggacacgccattgcccacctctgcccggacctcatagcgcccaggcagccgcagcccagggttgggcctcaggcccagcagcacggtgagctgttccgtggctgcaagcagccgcagggcacaggcagggcaggcccaagtgccctccagctgggctggcaagtggggcagccatgacgaggcgttggcggagaggtacggggcctggggaccagggtggccgggagccggcgagcagtgcaggagggcgccagggccagcgtcgtgctgcaagccaacgaggtcaccagggagcatgaggacatcctggctgtggagggtgacctgtggagagggaggcagggctgcatcacgtcctcacggtcatggcccgtggacccctgcacgacggatgagggtggacacgcagggctccccgcttcgtcagccacacctcagggagcctccccacagtgctcgtgacaaggacaggcaggacagttgcagacagggggacacacggggagaggacacaggccaagacctggcagacaggaaggagcggctgtgctgggagagaggaagaggaggcacagctcgtgccaagggcccaggcgagagcttctcccactgggagaggggcaagggcactgcagaggtcggaggttggaggtcggaggtcggaggtcagaggtggcaaggacgtgggaggggcctgcaggctgggtgtgcctgctgcgcagacccagaccctgggcagcagacaggaaggtggcctgaggagatgcagggaacagacccaggtcagggccacacaccgagtactgcgcggggggccccgcgggaacggagaagaggaactctctccatagcgcatagggggccccgagtagccctggccctgacgtgcagccattggcgcaggcctgggggtggcaggaggcgtccagcggcaagcagatgttggctccagggcaccagcgtccccctggcatgcacgcggggaccagctgggtcctgttgtccggggacctgctctcaggctcgctgccgttctccggggtccctgcgaggaggggagggtgttggggccctcattcgcccacgggccaccgtcagagatgcccaactgcctgcaccagcgagcctggccttgctgtgaggacaggtctccccgcccgggcagcactcccagcccagtgctgcgtccctgtctccggccagctgactgacccaggccggtccccaggcaggccccacccgatccacccccaggacacctggaatgagctggtgtctctggaacccctgctctgtccacctaagactgggaaccactctgatggccacaggaccagcagacgtgagagctcagagaggccaccccgagtcctgcggcgcccaccaccccagagtcccacctgctgtgctgaggagccggtacacctgcagccgcagctgggcgggccgccggagctcctgggtcccaaattcggccgtggtgaggaaggcttcacggctcagacgcaggcccgggaataccatgacctggtgggcagggggccgcctcagctccacagaccccatcccagcctgaagcccagactccccccacccgaacttcgcaggaagaggggagggaaggagagcgagccatcggacccccacaggcctggctcctgtcgctcgagaggaagactccgatggaaactgtccatggggggcaggacccctgacctgcctttcaggaataactcacccacactcagagaaaaggcctgggggtaatgtgagtaaacgctttcctctctgcactctggattttcccaaccatcttcactgggcacaagcaacattaaggcccccaagttttttggcgagacccacagtgggcagggcaggcgaggcctccaggggcaggcaggagggcaggttatagaacgtggggggccgactacctccacgggctcgtgcggggctgagaggccgtcctgccgtgccagaggcatcaggggtccctacaggtccccactgggcgctcccacgaggaggttctcggcatcctgcactgggcctggggtggcaagtgcacagtgaggcgccgggccagggcccaggacaccaggacgaacagactggggaccgagccgcccgagaacccccccaccagcccctcctcctcagcccaggctccaccgcgggcgctcggcaggcccctaaccacagccagcgtctcaggcccctgcctggcccctcgcacacctccaggccgcagctcgcagacgtagctgtgcggcgctgagcacaggtcggtgttacaccacccggtgggcccgagccggacgcagtgctcggctgtggctgggtgtggctccccgggcagccagttctggcagctctccaggctgaaggcctcgccctgcggcgctgggcccacctccaccccctgcacagtcgagaagccgatccacatgtctaggctcctgggggcgggtgtgggatggcagggggctcagggcactcctccatcctcccaccctcacagcagcccgctgggagccccgtcactgtccccctttccagatggggaaactgaggctcagagcccggagagcagggcccaccagcccaggctcacagcagcacccacccacggggcctgtgggcaccggcagggatccccgtgcaggccacctcccgtatggcgtgcccaggagtgtccggaggctgcccccagctcgcgtccacctctgcatctgcagagctgacaggaacggccccaccggccggcgccacctgctcaccagggccggcccagctcccacctccctcctcctgagactccccagccgcaggctctgccccactgcttcagagatctcccaacctatggcccctcggggggtggggcaggcacctggtgacccgggagaccaggaagcgctgcacggcgggactgtccaccattgccagggtggccccggcccaggcccgacactgctcctgcgcctgcagccaggccgccttctccaccaccaggcggtagcagtgcccattgccagagaagatctccgtgtccgaggggcagagcgggtgcaccgctggagaccagtgggaacgagggtgtcaacggtcagtgtgggcccaagacgggggtaccaggctctgccccatctggatggccctggggaggaaggggagtgggcagcagacactcacctcgggccggctcctcgcccagggccacgatgctgtaggcggcctccaggcctgaaccaccgcggttctggatgctgaggtcgaggctctcgtcactctgcaccgaggacgggcacacgagctccagggcggcaggtgccgcttccacctgcacgtctgtccccagcagggctgagccggtccccagggccagcacggccgtcacgtgatagcgcccaggcagcacatagcgatgcgaggcagccggcccagcggcatccacctcgggggagccgtctccgaagtcccagcgtgtggcagtgacagggagcggggcagcgatgtggaaggctgctagctggccggaggccaggggtccgtggggccccaccagggtggcccctggggaggcagggaagacgtgctggaggagggtggggcccctacaggtgggggcaggaggcggcggggggccggagcagagggacaggcaggcgaaggaggcactggagggctgggctgacccacacaggcaccagccctgctcggagagggctgcgaggccctggccggtggagaagcagaaggcgctgcaggcctctggctgaagcaggccttcgtgggcagctgaaaaggacactgctgccacggtgcctgagctgttgtcagggaggcaggcgacatactcctcacctagaagaggcagccactggaccccgggttctgctcctcctggctccaccccacacccccccatccgcccgccgcactcacaggctcccatgctgttcccttggcccggaggccccccccagagaggccttcctgagccctgcccagtgtctgcagggcccaggtcccacctggctgggaaggacagagctgccccacccaccggcactcaccacagccactgtccagcaaggggatgccaagcagaggctggccagccagggagccaggcccagcacacgtggctgcctcgggctgcaccacccgcacctgctgctcctccgcccatcgcggcagccacgccaggccacagtcacactcaaacgggttcccactcaggtttctgcggggcaggggcaggtgttggggaccaggtctggtgggaagggtctatgccagccccccactggcaaccaggccctggagccaccctgacagcaccgcctcccctgccccaaccaagccggcactggggggctccaagcaggtagtgaactgcccccaggatctggtctcaagcctggaaggggacacggaccaactgggagggcagaagggatactgggggcctggggtccagccaggaccccacccaaagaaccacaacttacatttcacttaaattaaataaattagcaaatattccttcttctaacgtagaaatcttgttgttgcttatatccctggaagagaggggggattcggcaaagctgacggaagcccccacagctgagcagcaagaggcggtgccgccagcccacccggagtgagccccgcatgctggcacgactgggggacactcacagctctgccagcgccgagaggttcgccaggagcccaacgtccagcgcccggagcaggttgtgggagacgtctctgaggagtgagtggccgtgggtcagggccagagcccttagtaggccagaggccatccctgggcccatcccacacattgccagcatccccaagctatggcctcccacccttgagctccccactcccagaggtcaggaggggcctttctgatggaagacccaaatgaacactcatctggggaaaccaagccgggagaggcctgggggcctcagccctctgcacccatctcagccctatgccgagtgccacctggacctgtccacccagggccaggaagggcacggacccccaacccatcccacgcagggccaaggccccccatcccctgtccacagtcccccacagagccaaggtctcccaaccctgtctacagcccccacacagactcgaggggcccccatctcctgttctgaacccaacagggtggtcccactgtgggaccacaaccaggtatgactgtgtgagaagcaggctcactaccaggctaccagggagcacagcggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagaccagccgacctaactccatctaaaatacacaacttctacgcaaaatataaataaaattagaaaacaaactacaatctcagaaaagcactagcaacttagacgacatactaaaggccaaaaataccctcctgacacacagctaataaagaaaaagtcaactattccagttaaaaagaagaaaaggaaactggctgtggtggcttatgcctgtaatcccagtgctttgggaaggccaggagtttgagaccaggatggacagcatagcaagaccccatctctacaaggaaaaaaagaatcagccaggcatggtggtgtggagctgtagttccaactactcggggggctgaggaggaaggatcgcttgagccagggaggtcgaggctgcagtgagctatgattgtgccactgcagtccagcctgggcgacagagcaagacccggtctcgaaagaaaagaaagagaaagcaagaaaagaaagatggctgggcacggtggctcactcctgtaatcccagcactttgggaggccgaggccggcagatcacttgaggtcaggagttcaagaccagcctggccaatatggtgaaaccccatctctactaaaaatgcaaaaattagctgtgtgtggtggcaggcgtctgtaatctcagctactcgggagactgaggcaggagaattgcttgaacccgggaggcggagtttgcagtgagttgagattgcaccgctgtattccaacctggacaacagtgccaaaccctgtctcaaaagaaaaaaataataataatataaagtgaccaggtgtgttgactcatgcctgtaatcccaccactttgggtcgaggcaggagaatcactggagcccaggagtttgaaacgagcctaggcaacagagtgagaccctgtctctatattaaacacacacacacacgcgcgtgcacacacacacacacacacatacaaaggcagccagactatgcactaggaactgccctgggaatccctttgtgttctcacaacaatcccatttcacatgaagaaacctaggcacagaaatattcagtaacgtgtccaggtgtggtggctcacgcctgtaatcccagtactttgggaggctgaggcaggcagatcacgaggtcaggagttcgagaccatcctggccaacatggtgaaaccccgtctctactaaaaatacaaaaattagctgtgtgtggtggcaggtgcctgtaattccagctactcaggaagctgaggcaggagaattgcttgaacccgggaggcagaggttgcaatgagccgagatcacaccactgcactccaacctgggtgacagagcaaaactccgtctgaaaaaaaaaaaagaaatattaagtaacttgtctgaggccacatagttaccaagacgtgggagctgggacttgaacccaggcagtctggctggattcatgcctgcagcctctgcactcctgctacttactgtgtgagaagcgtctgttctgtggaaggttgtgggctgagatctttccatgacttccactcatttacccccaaggctgttcttaaagacgggcatgacagttatgcccattttacagatggggccctgaggctcacaagggcacaccattcacccatttccacaaagctatagttagttagcagagggcagaattcggccgcctctcccctagcttgaaggctgtgattgacacagaggtttttttgttgtcgttgctgttgtttgttcctttttcttttttttgagacagggtcttgttctgtcatcccggctggagcgcagtggtgcgatgtcagctcactgcaaactctgcctccaagatgcaaatgattctcgtgcctcagcctcccaagtagctagaattacaggtgtgcactaccacgcccagctgatttttgtagagatggggttagtagagatttgtttaatagagacggggtttcaccatggtctctactaaaccctgtctctactaaaaatacaaaaattacccaggcgtggtggcacatgcctgtagtcgcagctactcaagaggctgaggcaggagaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaatcttttgtgtgtttttattgtctcgagacagagtcttgctctgttgctcaggctggactgcaatggcgtgatcctggctcaccgcaacctccacctcctgggttcaagcaattctcctacctcagcctcccgagtagctgggattacaggtgcgtgccaccatgcctggctaatcttgtatttttagtagagacagggtttcgccatgttggtcaggctgctctcgaactcctgacctcgtgatccacctgcctcggcctctcaaagtgttgggattacaggcatgagccactgagcctggcctggtgaggtaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcaagacccagagagggaggcaggcaggcaggcagggaccaagcttgggcacagccaggaaggcagagggcatggtggggccaatggaatcattacccaagacggggattttcagggaaacagcttagataaggccaggtgtacagtagctcccacctgtaatcccagcatttggggaggctgaggtaggaggactgcttgagcctgggagttcgagaccagcctaggcaacatagtaagaccccatatccataaaaaatttaaaaaaggagtttgtgttcctgtagtagcagacttgggaggttgaggtggcagtatcacttgagcccaggagttcaaggctaaagtgagctgattgagccactgcactccagcctgagcaacagagagatacgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtccagcctgggcgacagagaaagaccctgtctcttaaaaaaaaaaaaaaaaaaaaatcttagataagaggatgctgtgcctccctgggggtcttcagtcacccatagtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctggcatagccagatgacttccgtgcccctgttgcaataaccactgcttccaagtctctatagaccaccccttgggtatatctaatgtaagtgatatttattttatttattttttgagtcagtctcgctctgtcacccaggctagagtgtgctgatgtgatctcggctcactacaacctctgcctcctgggttcaagcgattctcatgcctcagcctcccaagtggctgggactacaggcatgcaccatcacgcccagctaatttttgtattttttcagtagaggtggggtttcaccaagttggccaggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggatgacaaggaagaagatagaaatggcatcagataataaacagtgtaaatgtttatcagaaagaggctggtggtcgggacaagtaggaggattgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctgggtgacagagcaaactccagtctcaaaaaaaaaacaaataataatattttacataaccaaccacttctaaagattaaaaaaacccctacgattaaaaacctcaggtccctcaggcaatcataccagatattgaaacaaagcaataacataaggactgcagtattcattttatttttatattatttatttattcttccttagtttcttgagattatcatccgctgagggtggaaggggagtgagcagacacactcaggaggtgtcttgagattatcatccgctgagggtggagctgagggtggaaggggagtgagcagacactcgggaggtgtcttgagattatcatccgctgagggtggaaggggatagagcaggcactcggcaggtgtcttgagattatcatccgctgagggtagagctgagggtggaaggggagtgagcagacactcgggaggtgtcttgagattatcatccgctgagggtggaaggggatagagcacacactcggaaggtgtcttgaggctcagggagttatcaattatagaatgttgttgagttggaggaggtggctggtggcccatcctgttttttaaagtttcagctgtgaggtagggccagtagggcaatcctgaagaatgacgatgctccactgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtgtcagtgtcataatatcacccttccactgagtactgccgacagctagggggtaaagaaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaatagacagtaagagacagtaagagaggcatgaaaagcccattgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcgcgtgtaatcataggactcggcagcttttgaaggtacagaggccacacaagaaccagcttagctgagcatcatttaaggccctcatttggaattgtccctgtgggtaataagttacattcactcttcactaatttacagtcagggcccatttgctattacaaatacggaacctctgacacttagaatattagatgggggccccactgggtggggatgaaggtgtttttgcgcaacacagttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgatctgaaaaagccaacacatgagaaattgaatgttgagagagtctaagggccgtggcatcatctgcatcagcactgaactatcctgcaactgcggggaggaagctccttactttgcatctgtagtagtcctctgcccgccgccgcaacgcttgcgcacgttgaaacatttccctatggattacaatcactttcatcagataaagcaccactttcaggatgattttaaataatctgccatgtttctgttatcctcacaactgtacccttacacaatctatctctacctagaaaacgtatttcagatggctagaagagtacagtctgagccggtcacggtggctgacgcctgtaatcccagcactctgggagggcgaggcggatggatcacgaggtcaggagattgagaccatcctggctaatacggtgaaaccccgtctctactaaaaatacaaaaaattaggcgggggtggtggcaggcgcctgtaatcccagctactcgggaggctgaggcaggggaatcacttgaacctgggaggcggaggttgcagtgagccaagatcacgtcattgcactccagcctgggtgacacagcgagactccatctcagaaaaacaaaaacaaaaacaaaaacaaaaaaaactgtacagtctgatccaaactgttgctatattgattcctcctcttgcttactgcctgctgacttctgagatgatagtttccttccccattctcagtatatccctaattcatccttcattgagcatcttttatcataaagctgtattctctttgtattaatatctttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtactttgttttctgttttgtgaactctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctccttttctccgtgctcacgttctttcatgcttagtttcctcagactagaagggagagaaatgcacacacatgatccaccagcacgtgtgggattccctctgcccttctggcatctgaaggctgattcaaagatcccccctgcaaccttcccacaaatgaaccaactgattctcacaaccgaaggaagaatggacacctcccattgagggacaaaaaaaaatcacactctggcctgctggcaagtcacctgtcatttccagctcatcttcatagttccatagttagtcctattctttagtaaatataaagactattaaaagcttctatgaggtgcactatgtgcgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaatatggtgtcattaaccccgcagttcactactgcactttgccatgattcaggactggaactcttgtcatcgactttaaagatcctgaaaaggcaatctgaatgctgggcgcatctattgaattagaaatgatcggaatggctcctaagtcaggatgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcctgatcctaaggatctcacctgatacttggttttataggaaggatgtgtaaaattcccagaacgctaggaaacagggacgaaatcacttcaaagagaaagttaatgaacttgtttctgaccacagggcatccttcagcacatgctgtctggagtggcctcaaacaaggtgtgtgtggtgaggtgctgacaatgcaatgggagcagggtcctgtccccacgctaaagaagctcacagtttaatgcaaatgagaagccagtgaggacagcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgatccatactgaagtccactggctctggttgagacccagaagagtcatgcatcagaatagaggtggacaggaaataccctggcctttgtagggactgagcctgcagagacgacctcaattgcagcctgtacggaggacccctgaccatcccccagaagtagactcccatctcttctgcagcaagataacatgctactaggcctcaatgcattgttaaatattttttaaaaagtatctcacatttaacaaaaaaagatcagtcatatggcagcaaaatacaatgtagtatgaccaaaacatgaaagactgtgaaaatgaatttggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggctgggcacggtggctcacgcctgtaatcccagcacattgggaggccgagttgtgcggatcatgatgtcaggagttctagaccagcttggccaatatggtgaaaccctgcctctactaaaaatacaaaaattatctgggcatggtggcatatgcctgtagtcccagctactcaagaggctgagggataagaatcgtttgaacctgggaggcggaggttgcagtgagccaagatcatgccactgcactctagcctgggtgacagagtgagactctgtctcaaaaaaaaaaaaaaaaaaaaaaattggccgaatgtggtggcacacacctgtaatccaagctactcgggaagccaaggcagaattgcttcaaactgggaggcagaggttgcagtgagccaagattgcaccatagcactccagcctgggcgacagagcgagactctatctcaaaattaaaaaaaaaaaaaaaaagcctgggtgtggtggctcacacctctaatcccagcactttgggaggctgaggcgggtggattacctgaggtcagaagttcgagaccagtctggacaacatggtgaaaccccatctctagtaaaaatacaaaaattagctgggcgtggtggtgggcacctgtaatcccagctacttgggaggctgaggcaggagaattgcttgaacccaaaaggcagtgagctgagattgtgccattgcactacggcctgggcaacaagagcaaagctccatttcaggaaaaaaaaaaaaaaagagagagagaaaggaaaaccaatgccagtactagcaactcctcttcccctgaaaaaatgacaaacaagaatgtaggaagggaaaggaattatacagcttaaactaatgaagcagaaaggacaagctcaattttgaacccactgaatttgccacaaatattgtagaaaatattctcaaggactttacagttgtctactttgattggcacatggttcatacaacagtatttgtgtcaaggcacatcttactgttctttggcggtcttcctctttccattgattttgtcatgacggttgacttttgttgtcaccttcatcttacggattttagctcgaactttggtttccacctgtctccataaagtaaagatgtcttccaggacaattttaattcctggaaaggaagaaactcttttctttgtgtgcatacaaacggacctcagcccttggtgagagtgaggagaggagaaggtgagaaacctgagggcaagaagctgttctttccctttccagggcaaactcatttccacactatggggactccaacagagccataccttcctgtctacggcagttggacctcctggctctctgctgtacatccgtggatccatcatgtccattttgagacgggaagatagtcttcaggaaagacacctaggaaataataatataagaatgacggctgggcacggtggctcatgcgtataatcccagtactttgggaggccgaggcagggtggatcacggggtcaggagttcaagaccagcctggccaagatggtgaaaccccatctctactaaaaatacaaaaattagccgggcatggcagtgggcgcctgtaatccgagctactcgggaggctgaggcagagaaccgtttgaagctgggaggtggaggttgcagtgagccgagatcacaccactgcactccagcctgagtgacagaatgagactctgtcacacacacacacacacacacacacacacacaacacaacacacaagaatgacatgaggctggcatggtggctcactcctgtaatcccagcactttgggaggccgaggcaggcggataacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaaggttgtgttgagctgagattgtgccattgcactccaacatgggcaacaaaattcaaactctgtctcaaaaaaaaaaaaaaaaaaaatataggccaggtgcggtagctcacgcctgtaatcccagcactttgggaggccgaggcgggtgaatcacaaggtcaagagatggagatcatcctgggcaacatggtgaaaccccgtctctactaaaaatacaaaaattagctgagcatggtggcccacgcctgtagtcccagctactcgggaggctgaggcaggagaactgcttgaacccaggaggcagagggtgcagtgagccaagatcccaccactgcactccagcctggtgacagagtgagactctgtctcaaaaaaaaaaaaaaaaaaaaatgacatgaatatacttcacacaactgaactgtacacttcaacacggttagatggtaattatcatcttgtaagtattttaccacaggttaacatgtttcacaacttgaaaaggaagtaattaattaccttcagctctctgagttctagaatttgtaacatttcaccccctgctccttcctgatctgcactggagcatctttcttctgtccctgctctactcagagttcactttcccttccctcacatcagcttcgttgaggctggtttgaacttaacgcaaaacattctcactaatgactgaattcccaccaagatttccatattatcacagtatgcttttaatcttcgaagatattaaatatttgttctcatcatagctaaaatgcaatgcaaatcccatctcagatgtgggtcagatacctatgaatctcctgaggtagtcattgaaatgacttttttcttgagacggagtgtcactcaaccatgctgaagtgcagtggcactaccttggctcacggcaacctccacctcccagattcaagcgattcttgtgcctcggcctcccaagtagctgggattacaggtgcctgctaccatgcctggctaatttttgtctttttagtagagatggggtttcactatgttggcccatctggtcttgaactcctgacctcaagtgatccacctgcctcagcctcccaaagtgctgggattacaggcatgagccaccacacctggcctgaaataatatctttcaaattctttgtagaacttgttttttcctgatttctgcacataggattaaaaaaaaatcatgtactaggatttcaagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatggcacccatgatgtccctgcttaggaggtaatggtatagatgactagatgacaaggacaaagatgagaggtgcaaagttgtccaagtccaacagctcaactgaactttcctaaatggaattgttaaaaagtggtaaatttaaaaacttcccctggctcacgtggtgactcacgcttgtaatcccagcactttgggaggctgaggcgggtggatcatttgaggtcgggttttgagactagcctggccaacatggtaaaaccccgactctactaaaaatacacaaattagctgggcatggtggtgggcacctgtaatcccagctacttgagaggctgaggcaggggaatcacttgaagccaggaggtggaggttgcagtgagccgagatcacaccattatactccagcctgggcaacagagggagactcctcttgggggtgagaaaagaaaaaaaaaaaagcttcctccaatttataccgaaaattctctgttcaggactaagtggcatagagaatgttaaatgtgcctagatatcttcataactcatatattttctgttttctacatatcttgaaaggcagtgccaaatgacgtgtaattatctaggcggtaaaactgaaacatacttcctcttcccttgaatataaaaaagcattgtggtttagtacttttatcttggatcattgttcagaaggaggttcagcccccacacaaccacatttttattgtcatgaatggcaagacaaaatgtagagctcaacttacgcaaaggataaaaggctcaaaagacaaattatgccacaacttagcagccaaattcttaccaagtatagacttttgacatactgatctcattccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctaccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagactttcccatttaagtgacgaaatctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaattgtttcatataatttattcttatttgtgattacaagtatacctctacagaaagttagtatactcacacaaaggtaacttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaaatttttttttttttttttgagacagagttccgctccactcagtcgcccaggctggagtgcagtggtgcaatctcggctcactgcaacctccagctcctgggctcaagccattctcctgcctcagcctcccgagcagctgagattacaggtctctgccaccatgcccgactaatttttgtatttttagtagagatgaggtttcaccatgttggccagtctggccttgaactcctgacaggcgatctgcctgcctcggcctcccaaagtgctgggattacaggtgtgagccaccgtgcccggccattttttttgtttttgtttgttgtttgtttttgagatggggtctcactctgtcacccaggctggagtgcagtggtgtgctctcggctcactgcaacctctgcctctcaggttcaagtgattctcctgcctcagcctcctgagtagctgggagtacaggtgcctgacagtgcactcagcaaatttttgtattttttgtggagatggggttttgccatgttggccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttatttttgttttgagacaaagtcttgctctgtcacccaggctagattgcagtggcatgatctcagctcactgcaacctccgcctcccgggttcaagcgattctcctgcctcagctactgagtaactgggattacaggcgcctgccaccacgctcggctaatttttgtctttttagtagaaacagggtttcaccatcttggccaggctggtctccaactcctgacctcatgatccacctgcctcggcctcccaaagtgctggcaatacatgtgtgagccactgcacctggccagtagttatcttttctttagttatttacttgttttttaaattgatgtataacattggatgcatttattatatatcacatggtaaaagaatccctctaaataatacttctctcttggattatatgaatctttgtcatttaaagctcagcataagtaaaaaaaaaaaaaaatacaatgaagagattacttcattcacaaataagtatcgaattttagttcttaaaaagtaacaaggtgggctgggcgtggtggctcacgcctgcaatcccagcactttgggaagccgaggtgggtggaccgcgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccaagatcgcaccactgcacttcagcctgggtgacagagcgagactctgtctcaaaaaaaaaaaaaaaaaaaaattaccaaggtggagatcatgaaaatggcatgaatagcgtgggatttctctaagattgttgatattaattccattagactcttatgtgagtgaagacgaagacttcccctgagtaagttcagacagcttctgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccgtacaacaatggtaatgatttcagaaacatggtgttgagcagaataaagcagacacaaaagagtacctatggcatggcatgcatctgtatacgcgaaattccagaataagcaagctaagctatgataagaaagagactggctgggaagagtgagagttcactttctggggtgacataatagtgtagatcttggctgggcacggtggttcatgcctgtaatcccaacactttgggaggccgaggcaggcggatcacctgaggtcgggagttcaaaaccagcctgaccaacatggagaaaccctatctctactaaaaatacaaaattagctgggagtggtggcacatgtctgtaatcccagccactcgggaggctgaggcaggagaatcgctcgaacctgggaagcagaggttgcggtgagctgatattgccccattgcactccagcctcagcaacaagggagaaactgtctcaaaaaaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggccgaggcaggcagatcacgaggtcaagacatggagactatcctggcgaacacggtgaaacccagtctctactaaaaatacaaaaattagccaggcgttgtaatctgagctgctcaggaggctgaggcaggaccattgcttgaaccccggaagcggaggttgcagtgagccgagatcttgccactgcactccagcctgggcgacagaatgagactctgtcttaaaaaaaaaaaaaaaaaaaaaaaaaagtcatcaaaccagatgacacaaatgaaatgacatttcactttgttttggtccgttttgtttgttagagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcagccccctaaagtgctgggattacaggcctgagctgtgtaatttcatgccgcgtgacacagcccagtaaaaaggaagaaaccccgcgggtccagcgtctactcacacaggtggactgatggctgataaatcccagcaggagccaaaagagcagccacagcacccatctactcacacaggtggactgatggctgataaatcccagcaggagccaaaagaggagccaaaagagcagccaccgcacccgcatgtcctggtcctttcagggcgccctgaggcagccaggacagaggtggaggtggcttagggcaggggggagggaaggggacggggaccgggcccgatctgagttggggagggggaggggagggggaggggagggggaggggaaggggaggggaaggggggaagtaagggaagggaaaggaggagaagggggctgttggggaggaggaggaggagaagaagaaaggggtctgggaaaggatccggttcaaattaagttctcaagcgctggtggaaggtttagctacaggtcacggagaagatcagggaagcaacaggacaggcggggcaagggagcgtgaggcttaggagcaattaggagacaaaggttctgctttccaccaaaccttcttcggtctgggccctcccttagcaaccctggggctttagactctctctccaccaatccctgatgaccccggtggtgcctcacaatggacattccaagtagcgcccgcatcatcccaatgacccctcccccttctcagtcccccacgctcctcccaaggccaggtcctctctggaaccttcacaaacctgatttctggtcctccccaaccagctccctgtccctgcttctgggtgctccttccttcctgagctcccagggttcctcaaggtcacttttggcgacaaaacataaaaaacaaatgatggcaggatggcaggaagaacctcatacccaagcagagtgccaggttttacagcctccgctcagccattcatatcctaagcaacaaaacatcagcaggatgcggaaggtcccgatagtaaaccatctccatcacatccatgtagccatccgtccatcaacctgtatctcaggaacaaatgtacatacattcattttaagcatgcatggtacatttacaaaaattaacctgacttattttgttccagcaaatctcaatatatttgagagcaatcaaatcacacagcatgtttctgatcataaaactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcacccctaacccacctagacattttaacatccgaaaccgagtgatgatgtccttatctatatcatcttactgcccgtgtgtgtggactttaaattctgaacccaaatgagggggagaaaaccaagctgactttcatgactgagctctcagggacgtccaaggaatctgtgcatttcaagaaacaaagttcatcagcttctctcctaaggtatttgcccacaatacccagagggcttggcagcatcatgtgtgatgggtggggagctccaagcaggtgggcaggacccaggggcctggtgaccaggacagacccccactgtccatcacctttcctggccctgtcctcagctaaacttcccacaggccttctgcccgatcacacagagtgtgcccaaactcaggcctctggcagctgaaaaccactgctttaaatccctttaccatttactatgacataaggttattgtaaacaggaaatattctattgatgctacaaatggaaagccaatgcctttaccataaatagaaaaacaaccctaagaagcaagcaaaacaaaaacaaaacaggggctgggggtggtggctcacgcctgtaatcccagcactttgggaggccgaggtgggcggatcacaaggtcaggagttccagaccagcctggccaatatggtgaaaccctgtctctaataaaatacaaaaattagccgggtgtggtggtgggcgcctgtagtcccacctacttgggaggctgaggcaggagaacagtttgaacccgggaggcagagtctgcagtgagccgagattgcaccactgcactccagcctaggcgacagagcgagactctgtctcaaaaacagcaacaactacaaacaaacaaaaaacagggttaacaaaactatggaattcaattctatttatatgctgcagccatgttccagccctagatttggctgggcatggtggctcacgtctgtaatcccagcactttgggaggctgaggcaggcggatcacgaggttaggagttcgagaccagcctcaccaacatgctgaaaccccgtctctaccaaaaatacaaaaattagccaggcatggtggcacacgcctgtaatcccagctactcaggaggctgaggcaggacaatcccttgaacctgggaggcggaggttgcagtgagccgagatcgtaccattgcactccagcctgggtgacagaatggaatgagactctgtctcaaaaaaaaaaaaaaaaaaaagaagaagccctagatttcggttgtgttggttgtaaaaggagagacccagtaagtgggggtcatgccgcagattgctacccacaatggacgggtcactgagcaggtccggccaactgggcgttccctcgctggagggccagcacaccagactgcaggtggcgcgggtcagcaaggtaccaggggatgtgtcacacacacagcccacccccgtccagtcacgcacggacaccctgggcttccgagcaaacctgctcccaggtggtgtgaccacatggagccacagacacccagcaaggacacgcagcccgcacacccccggtactccagacacagtgacctgcaccagggctcgaggtttctctagggaacccacctcttagaatcatccagaaacaagtcactcttcatctgtccagcaaaggcctgctgagaggtgcacagggtcttgagtccaagctgcgccaaggcggcaggacccccagtagagccctcacctcagcgtggaggcctgagaacgtgaggaaggagctgtccagcacggatgagtccaggcagctgtcgacgtccagcacctgctgcccggcaggtgtggggctcgggctcccagccacctgcaggacaagggcagtggtcagcgggcggcagctcagacctgctcaggacagggatgagaagccacctcctcagcagacaggacagagcccggtgccatctgacagaatgtcctagaatgctagatatatgggacatctgcaccgtccgtgatggcagcccctcgcgacatgtgccactgaacacttgacagcagactggtgcagctaaggaacagagttttaaatttcattttttttttttttagatggagtctcgctctgtcacccaggctggagtgcactggcgcaatctcagctcactgcaacctccacctcccgcgttcaggcgattgtccgtcctggctcagcctctttagtagctgggattacaggtgcctgccacgatgcccagctaattttttgtatttttagtagagacggggtttcactgtgttggccaggctggtcttggaactcctgacctcaagtgatctgcccgcctccgcctcccaaagtgctgggattacaggtgtgagccaccacacccggccatcgttccattttaattaacttaaatacgagcagccacatgtggcctctggttcctgccacggactcgggagcaacccctcctggtcgcggcttatgcgccttctctgtgtgctgctggggttagtttgcatgtaacctcttgaggaccccacgtgtgcattcctaaggggtgcggcctcccgtttccgtatgaatgggaagagttcccacctgctgtattcttggaaagagtctgtgaaggattggtgttaattcttccttaactgcttagaaaaattctatcgtgaaggctctgagcctgggcttttctttgtgggattttttttttttttttttttggagacggagtcttgctccgttgcccaggatggagtgcagtggcgcaatctcggctcactgcaagctccgcctcctgggttcatgccattctcctgcctcagcctctcgagtagctgggactacaggcgcccgccaccatgcccagctgtttttgtatttgtagtagagatggggtttcattgtgttggccaggctggtctcgaactcctgacctcaactgatctgcccgcctcggcctcccaaagtgttgggattacaggcatgagccaccgtgcctggccctttttaatgttttatatagatggggtcttgctatgttgcccaggctggtctcaaactcctggactcagatccgcccacctcggcctcctgaagtgttgggattacaggcgtgagccaccacacccggcccggccactgggaggtttctaagggactaactcggcctcttcacttgctatagatgtactgagattttcttctggagtgcatttcggaagcgtgcacagccgcgtgcttgcttcttctgagttatctggcgtgctgctgtgcagttgtccgtggcgtctgcttagcgaagtgccctcgttctttcacgattctggcttctgagtcttctctctttctccctggtcagtctagctaaggctgctcaagtgtgttgacccttcccgagcagcctttggtggacgcctttccctctggctgcagcactggaaagtggcggccctgggcatggtgccgaggcccaggctccattcccagtactcccgggtccccagccccagcccaccttgctccgggacatccggaagagaaagaggatggccaggtagacgggatagacaaccacgctggacaccaggccaacagcgactgtgtcgacgctcagcgggttcagcctggacacacgccccgtgctgtgtggaggagaggaggccacacaggtgaggctgaggggcaggaagggctgggcaggaagaggctgtcccgacccctacggcacccacctgtaggcagagtctccaacagccccgtaccacacggcgttggcgcccaggaagagacagatgaggagatcgcagcaggtggccctctggatgcgagtgaaacagctacgaggcggccggtcccatatggagagccagatgtgcttgtcaaagaagccacgctgcagctcagccaccagcaggcgccggaagcgcaacagggctgcgtgacctagaaggcagggagggccgcactgcaggaggccacggggcaggaccaccctgcccaacctcccacggagtgggaacacggaacgaggccttactcgcggccagcacctccttctccaccaggcccccgttggcctccgtctccaccgaaagccagtcattgaccaggaagaaggtgctgcgtgccgtctgcaggtccctgacgatgatgtgctgcaggaaccaggcagggctgagccctgcagaggcgcgggagggaggtcaggttcgcagggcgccccaatgcaggggcagaggggcagagcttggcagggtccatacagacctttgttgtcgtgccacactcggatcttccacatgctacccaggctgtgcggggtggcgatctggaagatgtccagactgttgcggtggaaggctctgtcgccgtccaggtgccggtggccgctccggctgtccaccccatacagcatgatgcccacgtgggccgtggtacctggagggcaagagggaggggtgggaggctcggtctgctgcccaacacgtgtggcatcccaggcaagtcatctcagctttggcctccgcgcactcaaggagccacacaggcagtcccggctttgcacagctctgctatacacgaggagctgcggttactgcaatttgtccaataaacagcaggacctcaaggacatgattaagttacatggaaagaactgtaacttgtaacatgcaaacatggctgcacacgcctcagtccacaccacaaccagtgacccgcactgcacacctgtccacacctcagtcacgccacaaccggtgacctgcaccacacacccgtccctcagttcatgcacagactgcgaagcgtgaagctgtgtcacctcctctcccagtgacagacccaggtgacagtattttttttttttttttttttgagatggagtcttgctgtgtcacccaggctggagtgcagtggcgcaatctcagctcactgcaagctccgcctcccgggttcacgccattctcctgcctcagtctcccgaggagctgggactacaggcgcctgccaccacgccggcctaatttttttgtattttttagtagagacagggtttcaccgttagccaggatggtctcgatctcctgaccccgtgattagcctgcctcagcctcccaaagtgctcggattacaggtgtgagccaccgcacccggccgacagtttttaaaagtaggtaatcaaaagaaagaactgggaaatgaagatgaaagcagcatggaaataaaaaatgggaacacggccaggtgtggtggctcacacctgtcatcccagcactctggcaggccgaggcaggcggatcacctgaggtcaggagttcgcctggctgacatggtgaaaaattaactgggtgtggtggtgtgcacctgtactcccagctactcaggagaatcgcttaaggggaatcgcttaaacccaggagctggaagttgctgtgagccaagatcacgccattgcactccagcctgggcaacagagcgagactccgtctccaaaaaaagaaaaacgaaaacaaaaagggaatgccagaagggcaattccaaagaaaggaaaatggaggtattgaagaaacagccacggggagggtgctggcgcctccgtctgagagacgagctatgcagtcaggatcgcgggtggatgcatggtctcccacagtggtagcgatgctcacgtaacttgtggggctacgctactgtgtagaacgtgggctgcccaccctgactgactggcacctacttccagctaggagctgtcctagtcctcagggacagtgagtgctcacgaggtcattcccaggatgaacacacgagcccttcacacagcactgcaaaaactgccttgttctgacgcctgcgacgagactcactcccagagggtgcaaccagcacagccagtgagagcaggggaggccctgccaccccgccgcgcccctcacctgagccccggccccagcctgtcttgacgaggatctcgtacttgaagcggccccgctgcccacagaaggggatggcgcagccccggctggcatccaactggtccagcttgtgcaggatggcggccatgaccatgtaggtcaccaggcacacagcacatgtcagcatgacgatgtagtttacatccgctgttggctcctgtgaagacacagccgccaggcccaggaggtcacgtgcaagctgtgccttctcaggatagagccgagcccacccaggccctcctcgactctgcagaggctcccaggagcacagggtcactcacaggaaacacaaagcggatatggcttgggggcacgaagaggctggtgccgaaggcggtgaggtggcgggtgaggcagacggcctggcggggcgaggtctcctccaggggcagcagcccctctgtccgccacaccacgtcctcctcgctgaagtactggcacagggacgtgtacaagcccacggacacctccagcgccgaccagcggaagtggctggagaggttcagacggtaactccccactgggtctctggtcctgggaagggaaggggcagtggacgtgagcccaggctccgccaggttggatgtcggagtcccagagcccatacccggtccagtcccctcgctgcctgccgtccccacggggcccgtaacccgggcaatgctgacccatgatgccctgccctgccctgccaggccggcccgcagagctcaccccggggaaatgaagaaggtgtagggccggtggtcggcaccctggagggactctgggcggatcctcctgctagccgagcagttgcgctcattgggccggggctccgagtgcaggtagactgccaggtagggctcgggttcctcagacaggtagcggcctggggcagaacgcgcaggtcacacgcctgccgggaagctcaaccacccgggggacacccacgatggccctcctgagcccaccctctgccatgggcctgaaaggccataggagcctctgcaccagagctggcacctgcttctccgtggcccccagctcctctccggccaggcccccagcagcccatgaaacagaaagcaaatttcaccagagacacccatggaagccctacgagaaacgccttccccccaagaacaaggccagggggccgcgtgtgccccaaccgctgcatgcaccgtccagcagcgtatagttgagctgcagatgcagcacggccgcagggttgctgctgtccagggtgaccacagcaccgacggaggcctggggctggaccacaacggagttggcggagctgcggtggccccgggcagcccagtccgagttgttgggcaccttcacggtgaggcgcgctctgaggccagccgctcgatggggatctgggcgccggcctgtgtctggaacgccatcgaggccaccttggtggagacggtgtagttgctgatatagccaaagggaaagggattggagtccaccagaaagatgagctgcaccacgtcactgaggttggccggggccctgctgaaagcctaggggatggagaagtggcagccaggccctggggcgccgccatagcacagcaggctccgcgggtccgagcgcttgccctgggccacgatctcctcacccgccagcgtcaggggctcctcgttgagcacgcgggagcgcgtgacgatgggcgtgagggcagaggtcaggttgtaggcctgggacgccaccatccgcgatggtgactcggctcccagctctgagcgctgtggtgcccgcacgtctgagctggccaggtggatgaggtctcctgcagacaggcgtgaggtcagtgcagagacagggaggcagagggagggtgggggcaggcaaaaagggggagccggagggtggggactgggagaaagggggaacctgagggggcagagagcgaggtgcaggcagaaggaagagggaagctggagagagagtggtggagggggagggggaaggggatggggatgaggacgaagatgagggggatgatggggagagggaggaaaaaggaaggaaaagggtagagaaaagagaaaggggagaagaagaggagcagggggaaagggaggggaaggggataagggggataagggaggggaagggggataagggaggggaaggaggataagggggataagaaagatgaggggaatggacaaaaggacggggaggatcgggggggaaatggagaaaaggggagagagatggagaaaagggagggatgaggtgaggggaagctctaggggaggggaggaggggaagggctaggggaggggaggggctaggggaggaggcaggggctaggtgaggggggaggggctaggggagggaagggggaggggaggggttaggggagggaaaggggaggggaggggctaggggagggaagggggaggggaggggagagtggagggcacagagcagcatcttcttagtccctccccacatctgggcccctctttacaccctgggtcccccgagaggcaccctgcgttcacacaggacagcagaaaggctgaggctactgaagcaggtcagagaccgaggaacgccacggcaggaaggagcccaggctggaggctcagctcctcggccaagctgcccgtctgccctggggggctgaacccagtaccctggcaggcatgcggggcggggtgagcatgtggggccatcctaccatgcactgggccagcgcagcagcgatctgctggatgtcatccacagtgtggaccctcagggacaccagagtctccgtgatgttcttgcgtatctgggctcggcgctgccgctcgtgcttgggctctgccgccacgtccagggcccgctcgtactggggcaggcagggggcacagcaagctgtcagcagggcaggaggccggcaggaggccagcagatgcccacgactcccggggtgcagttacgtgctagatgctgtgtgatgtgggcactgacccgcaacactgagctgtttcttcatgggcaaaacagggtaagcacatgggccctcctgggcgggggctgcattgtggaaagcagacaccggagagggcccggtgggtgtggctgctgggagcggaacgtcggggtgctgcttcagggtcactgggatttatctctggggcccgggatgagccctccgcaaagctccaggcaggggaacaggtcttggtccccagcacgcatgcagcagatgtgaggtcccctcccaggctgcactcacctcgttcagcacagtgaccagggccagcgagtactcgatgacgtgctggggatcggcctgccgcagcagccccgggagcacactagcggtgagcccgtgcagccagactgtgagccccattgcgctgccgttgggctctgggagggtgatggccagagacctatgagcagagggggttggtgagcaggtggcagtctcgggggcgccctcccacggcctggctcacctgttgagggcgaccacagcggctcccagctggtcctgcaccaccacggccaggcccacctcgaagtgtggcctgaaacccgggggcagcacggctccgtagccggagaggctgctcttgtagacacagaactctttgcagtggccctggcaacagcgctgcagcagcagggcgtacaccagcggggcgccagcatcctccgcgtcatgccagcctgagggatggtccccacagcatcacgggagggctccgtgacgtcacagagtcgggggatcccgctgctccccctacgcaggcctgcactcacccgtgcattcgaagtgcaccttggtggtgagggcgtgcacagcgcccagtgggaagaggcggcaagagccctccagcggcgggcggttgggggacagggggatggaggcacagccctcctcctcgccagagcggcccagcaccgtcagcgtgaaggtgtatccctcgccgtcccgcagcacgccccgccgcagcaccagtcacatgcctgcgctgcccgtggatgtggtggtctcatccagcaccagtgtcttgttgctgaacgtacgtgcagcccaccgctgcaggcagaagggatggtgaggggtcgcaaccctctgccctgtcagccccacttctgcctgcaggccccgtcccctcggccatgggacccatccccaacccgcccacaccccgctcaacactcacccctcgcttggagccgctgctgcaattgaggcagcggccctccaggtacacgtaggagctgcggctcacttcgtacacggcctgtgccttgcaggacacacactccaaggacacaatgggcacccggccactccggatcagcacctggcgtgggagtggggttacctccaacacaggtctatttggcctgctggaaggtctgggggacccgtggaggatgctgctcccaaactccaggtttcccaggggcctggccactgccggtgagctcaccccctcccaggatactcatccggtttgccaccttccaacctgggcggcggaagggcatacacagggcagaggacactggggtgtgtgttctggtgtactggacccagctggaccctggcaggaggcaggcaatgctcactgagggcccctggggggatgcgtgtgggaacagacgtatgtgtgggtgtgaggaccgcagttgccacgtaggcctgactcacagactcctgcagcccttagccagggcctgggtcaggaggctgagccgggatggaacctgctcccacaccctcccctcagacgacccctctgggcagacccccaatcaggcccgttgaggaaagcagggactggggaacagacacccactctggggcaccagcaggccccgcctgacagcagcaggagcagccaccatgggctcagggtcaccaagcctcctggccggtccagagtggggagcatgagggtgagaaccggcccaccacatccagcaacagggacatgggctggggacagtggctgcctctggggtgggaaggggctcttcctcactgttggtattgctgggggactgtgtagcttttgtcactagagcatatgtggcttgaagactgtatgtggaactgtggcaggtttggaaggaagcaaagctgaagcaggctgtcgtgttacatagaatttgcatcagaaacagagaggggagagcgcgcggcctccaccagcactaaaacacggaaaacagtagatgagcagggaggctgggctgtccaaggcaagtggccgaggggcgggcggcacccaccgtctggttggtggcctcctccttgcggccggccttccacacggtgaggctgaaggtgtactccacgccagctgccagccgttcccgtggaatggtgaccgtgctgctcccgcggggcccaaagttcagcgcacacccgccagcctccctctgcaggccgagaacaaggggcgacgtggcccgagaaccccatccagttttaaagcagagcccggcccaggagacagtgcgggagaccccctccccatgctgggacggggcccaccaggcactgaggacgggccagccctggtggcaagctgggtgttctctgggctcatgggtgtggacgggtgaggggcagggaggacggccctgccacgcactgacctgtgtcgaagccacacaggcccactggaaactgagcggcgtctggtcgccgtcctccaggttggggtcgtaggactcgctcccatccagcaccaggtcctgtgtgtctgaccacacgcggtaggagccaccctcagtgatgggcaccaggcgctcgggggccaccgtcacattggcctggatgctccgtgccagtggcgtgtccccaaatgacacgacaaacacaaagcagtagtgccccacaggcagcgccagccacggcagcaccagctgaggccggctcacgtccacgccgggcagggccacacgcgccgggcgccccggccgctggcagctggcggtgcggtacacctcccagcggtactcagtctggtaggtgacacagtcgcgcaggtcaacgtaggcatccaggcagttgcgctgtgatcgtcgcatcagcacctgcaggggcaggaccacgtccacctccggctcccggcaggccagcacctggacggtcaccgtggcctgcgccacgaaaaagctcaccaggttggaggcgttcacctgcacgcggtagtccccaggcctcaggtaggagtgctcggccctgggctcatctgtgtcctgccctggggacccatccccaaagtcccagtggtaggccacgcgccgggggctggggctggtggcggcctcaaactgcgccgagcggttggtgaagcaggggccgctgcgcagggccacatactggacggcgtcctgaacctccagcaccagcgtgcggttctcactgcccagggcgttgaaggcacgcacctggatctccaacagccccgcggccacggcgtgtaggtgacgtcgcggcccgacaggatgaacagagagtcgccccggaccttctgcagcgagaagtaccaggcgtaggcgacccgagagccgcgctgcacgcgggctgtgaagttcctctcagtgcccatggcgatgccaggctcacagcagttgggcacctgcagcccgctcacggcctccagcaccacgatgcgcacctgcgcctgggcccagctcacgtggtttttgccctgcacgctcaccacgtggtctccgatgcgggggaagctgtgggagaaacggggcccagggagcacttcggggctggccccgccgacctgcaggcggaaggtgacagctgagccggcagccagcaggatctgaaaatggacaagctgcccgggcgccaccaccttgctgctggcccacagcaccaggcccacgatgggctcctccaccgtgaggttgtacgtggctgagacccagctgactgcgttggaggcattgagccagatgttgaaggtgccagcatccgggaagaccatggtgacatgagggccacgcttgctgctgccgccgggcacagcccagcaccagctcacattggtgcccgtggccagctgcccccaaaagggcacagaggacccggccgccacgaagctgcctcccggctcgctggccctgatgctgaggccactcacaggcacctgcacatccacttccacggtggcgttggctgagcccagcgggttccctgccgtcatggtgaccaagtgcaggccgggtgtggggaagctgtgggtggtaaatggctcgggggtctcccagctcagcccctcctccaaggaccaagtgtatacgacaccactgccaccagccagctcggcactgagggtgacgcttgtgttgacggcagctgggttcggggaggcggccaccatcagccaccccacaggctccacgaagtccacggtgcagtcagcccaggcgctgcccagcatgttggtggcccgcagctgcacatggtaggagccggcctcgagcgcggtgagcgagaagcctttgccgctgccggccagggccgggcccctgtccctccaggcagtccagctgtaggagatggtgccgtccctgaccacggcctgcagctgtaccatgtggttggtggggaagtagcggccaccgcccaccacctgcagcccctctatgagctgcaggacatagacgaagatgctgtcctgggcggagcccacctcgttctcagctgtgacgatgatattgaaggtgcccacggagcggaaggtgtaaagagatggcaggacccccagagatgggcgtgcagcggtcacagagcacccaggaatagcgcacatcactgccggcctccagcgaggtgctgaagctcatgctcccattcaggggcaccaccgtgcagctggcattgacgatgagcccccgcacgcgccgcttcaccgtcacattgagccaggcctcgctgcggctcacctcattgcagccggccaccctaacggtgaagtcacctgtgctgttgtaagcgtgggtgacctccggaccctcgagccgcccaccgtcccccagatcccacaggtagctggcggggcgcccacggcccacagcagagaacaggtacggctgctgcagctccagcccaagggagccattgaccttgatgctggtgaccagcacgggctcctgcacctccaccagggctgagtcattggcagcggagatgttgttggacgcggtgactgtcacaagataggagcctgggtctcggtagatgaacgtcacctcagggcccccgacacgggcggggacggcttcttcggtgccaaagtcccaggtgtagcggtaggggaacgggggccaggcacatgccaccagccgggcctcgtccccgagctgcacaaactgcctctctggctgcagggtgacgttgcccacctctggctccacgcagatgctggtgaagtaacgcgccctgttcacgcggctggacagcaccagcgccagggggaacgtgccgctacgcgtgaagttgtgtgtcaccgtcgggcacccccgcatggtcgtgttggaggagccatccccaaaggtccagtcgaagaggtagcgggccgggttcccggtgacgtaggccgtgagccgcgcgtcaggctgagtggggatgcaggcggcgggctcgacgcgcagcacctccaggacgaagaccagcacgtgcaggctccgggccaggtggccggcggggctggccgcacccacggtcactgtgcagttctgtgcccgcaggtacacatgctccactgtggcctctgggcccgacagcacggtgccgtcccccatgtcgaaggtccacgtgatgttgtcgcccgtctgcaccgcggcactgaccaccacgggggcgccctgctccacggccaggctcatgtccacgctgagcccgcggagctcctcaaagacgcgcacatccgcctgggccgccgcaccgctcaccgtgttgttgacctccaggcgcacgtggtagatgcccctcgagggataggtgtggttggcagccggctggctctgggtcaggacaggggagccgtccccgaagtcccacgtgtaaagaacacccccaggcgagggcagcagatgcgggtagaaggtgacgggccggccggccaccaggacgccgtcactcacacccacagcctcggagggcagggaggcgcgcacgctcacaggcacctgctgcatccggttctcgaaggcattagatgccagcacggtcaggacgtactcacctgtggggacaggcccaagtggggcagccgcggcacccccacctgctccccacccgctcggcagaagccccccgcctgaggagcccggggtgaacggctgcacctgcggcccagccttaagggtcccaggctcccaagccacgtgcgggacggagcacaggtgcagcagcactgagggctgcctggtgaggacggcaccgcctccaagtgcagctgcactcggggcagcagagcagcaagagccaggccgcggcggggggcagttcagggggcccagcttccctgtccactccccccacgcctggcccctccctcaccccagtagggacctaagccatcagcccaggtgaggtcacagtgagggctgttggggaggaaggggggcagcttgactgggggactgggggtgccccgtgctcagagcctgaaaggcagtggccccctcaccccctcatccctcacctggggcagcgtaggtgtgcgtgacattgtgctccaccagcacctgggccaccgaggggtctggaactgggaaggactcgttgtacggaggctggaactggtggagggcctgctccccatccccaaaggtccacctgccggggcggtgggaggcagtgagtgaaccgggacaggggtgcgcagtggcggggcacaggtgcgcggtgggggggcagggggtgcttgggacccagctgaggctccactctgcagtcacgccccgggcctccattcagggcccacccggctgtgctgaggcctctcccggctcccgtgcagcctcagggctcctgtgcacccagtacctcccaacagatagggaaaccgaggctcagaaaagcaaccccctgatgtggggtccctcggctgaggctggggccgggacaagagcctggtgcccaccccaaaccggcccccgagtcactcacaggaaggccacctccacagccgagtccaccagcacgcccgccgtcagtgccagcgtggcattgggggacagcacggccggcactgtggagacccgcaggccctgcatcctgttcatccgctccacggtgatgttgtagttcacggtgacgttgctcacgtggttggaggccgtcagctgcagggataggcatcagtgggcccaggtggcaggtgagaggcctggccctgcttagcgtccctccctccactcacccacagccatggcagcgtcctcgggcagcatgaagcagaggtgaaggtggagcccgccccgccccaccccatcccctcccctccccacccccgcccacctactgagagcttgaagaccgccgcgctctgataaatgacattgaagaccacgttctggaaggtcagggactgcttgtcgttgatggtccaccggaagaccatgtccgagccggcctccaccacggggctgtacctctgcggggggactggtgtcagcctgggctctgtggaggactctgcccttagcctgtcgcctcctggacacacctcccgtcaggctggagagtcccacgcggggcacagaggagaggaggtggccggggctctgcatgccatgggagccaagcccgggctgggacactgactgtccggctctccagccagccatgtagtactactaatgcctcaacctctctgtgcctcagtttccccatctgtaaagcaaacctagtaccagctacaaagagtccacctctctctgagtcttctcagaccctcccggggctcctgccccagctcctcagccagagagctcggagcagtgaggggaggcacacgggcctcacagggacagcacctacactggcttacagaacccaggacaggctgcacaggtcacgccatttctgatggcccctcccaaggcccctggtgaaggggcaggtacccgcaagacggagacagccctgtcccccatgtacccagcatggtggcaccgcgggcagcccgcagtttcccatcaggggttcagactccacctcaaaagccactcgctttagccaggtgagaacacagcagagggcgtgagagactcacgggggctcgtgtgaggtcagggagcggagttttaaattcatttcatgaaatgagacggtggaatgagttagcggagccgctgtcagagccgtgactttccaggaatttaaagcccaccaggtagcctgaggagccagccagcaggacctgcccggggccgacgtccccagtaactgggctgctgccctcactgggaagccaggcctcacgccctgtgtgagcaccctgtctgcaggcacctgcctgggggctggtggtggagcctcggccatactcaccactgggactccctgcagtacacgggcctcggggctgggcgtggcgcggaggccacagatgggctcctccgccgtcacccgcaggctgaggttggcccggctggcgctgttttccaccacaacgtccatcacgtgctccccctcaccgagccacggcagtgctaccactgagaacagggtatcattggtctcccaggggcagccgggcacgaaggtggccaccagggcagggcaggcattctcaaagcgagcgctgacactgcccccaggccagcgagccgtggccgtggcgctggcaccagagtccacctggagcaccgaggctgagccgttggtgggcacgtagaggcggccgtcgcggggggcagggtagatgacccgcagcccagccactggggagaccacgtcaaagctgcaggacaggttgtgcctggacacgccattgcccacctctgcccggacctcatagcgcccaggcagccgcagcccagggttgggcctcaggcccagcagcacggtgagctgttccgtggctgcaagcagccgcagggcacaggcagggcaggcccaagtgccctccagctgggctggcaagtggggcagccatgacgaggcgttggcggagaggtacggggcctggggaccagggtggccgggagccggcgagcagtgcgggagggcgccagggccagcgtcgtgctgcaagccaacgaggtcaccagggagcatgaggacatcctggccgtggagggtgacctgtggagagggaggcagggctgcatcacgtcctcacggtcatggcccgtggacccctgcacgacggatgagggtggacacgcagggctccccgcttcgtcagccacacctcagggagcctccccacagtgctcgtgacaaggacaggcaggacagttgcagacagggggacacacggggagaggacacaggccaagacctggcagacaggaaggagcggctgtgctgggagagaggaagaggaggcacagctcgtgccaagggcccaggcgagagcttctcccactgggagaggggcaagggcactgcagaggtcggaggttggaggtcggaggtcggaggtcagaggtggcaaggacgtgggaggggcctgcaggctgggtgtgtctgctgcgcagacccagaccctgggcagcagacaggaaggtggcctgaggagatgcagggaacagacccaggtcagggccacacaccgagtactgcgcggggggccccgcgggaacggagaagaggaactctctccatagcgcatagggggccccgagtagccctggcccctgacgtgcagccattggcgcaggcctggggtggcaggaggcgtccagcggcaagcagatgttggctccagggcaccagcgtccccctggcatgcacgcgggggccagctgggtcctgttgtccggggacctgctctcaggctcgctgccgttctccggggtccctgcgaggaggggagggtgttggggccctcattcgcccacgggccaccgtcagagatgcccaactgcctgcaccagcgagcctggccttgctgtgaggacaggtctccccgcccgggcagcactcccagcccagtgctgcgtccctgtctccggccagctgactgacccaggccggtccccaggcaggccccacccgatccacccccaggacacctggaatgagctggtgtctctggaacccctgctctgtccacctaagactgggaaccactctgatggccacaggaccagcagacgtgagagctcagagaggccaccccgagtcctgcggcgcccaccaccccagagtcccacctgctgtgctgaggagccggtacacctgcagccgcagctgggcgggccgccggagctcctgggtcccaaattcggccgtggtgaggaaggcttcacggctcagacgcaggcccgggaataccatgacctggtgggcagggggccgcctcagctccacagaccccatcccagcctgaagcccagactccccccacccgaacttcccaggaagaggggagggaaggagagcgagccatcggacccccacaggcctggctcctgtcgctcgagaggaagactccgatggaaactgtccatggggggcaggacccctgacctgcctttcaggaataactcacccacactcagagaaaagggggtaatgtgagtaaacgctttcctctctgcactctggattttcccaaccatcttcactgggcacaagcaacattaaggcccccaagttttttggggagacccacagtgggcagggcaggcgaggcctccaggggcaggcaggagggcaggttttagaacgtggggggccgactacctccacgggctcatgcggggctgagaggccgtcctgccgtgccagaggcatcaggggtccctgcaggtccccactgggcgctcccacgaggaggttctcggcatcctgcactgggcctggggtggcaagtgcacagtgaggcgccgggccagggcccaggacaccaggacgaacagactggggaccgagccgcccgagaacccccccaccagcccctcctcctcagcccaggctccaccgcgggcgctcggcaggcccctaaccacagccagcgtctcaggcccctgcctggcccctcgcacacctccaggccgcagctcgcagacgtagctgtgcggcgctgagcacaggtcggtgttacaccacccggtgggcccgagccggacgcagtgctcggctgtggctgggtgtggctccccgggcagccagttctggcagctctccaggctgaaggcctcgccctgcggggctgggcccacctccaccccctgcacagtcgagaagccgatccacatgtctaggctcctgggggcgggtgtgggatggcagggggctcagggcactcctccatcctcccaccctcacagcagcccactgggagccccgtcactgtccccctttccagatggggaaactgaggctcagagcccggagagcagggcccaccagcccaggctcacagcagcacccacccacgaggcctgtgggcactggcagggatccccgtgcaggccacctcccgtatggcgtgcccaggagtgtccggaggctgcccccagctcgtgtccacctctgcatctgcagagctgacaggaacggccccaccggccggcgccacctgctcaccagggccggcccagctcccacctccctcctcctgagactccccagccgcaggctctgccccactgcttcagagatctcccaacctatggcccctcggggggtgggggcaggcacctggtgacccgggagaccaggaagcgctgcatggcgggactgtccaccattgccagggcggccccggcccaggcccgacactgctcctgcgcctgcagccaggccgccttctccaccaccaggcggtagcagtgcccgttgccagagaagatctccgtgtccgaggggcagagcgggtgcaccgctggagaccggtgggaacgagggtgtcaacggtcagtgtgggcccaaaacgggggtaccaggctctgccccatctggatggccctggggaggaaggggagtgggcagcagacactcacctcgggccggctcctcgcccagggccacgatgctgtaggcggcctccaggcctgaaccaccgcggttctggatgctgaggtcgaggctctcgtcactctgcaccgaggacgggcacacgagctccagggcggcaggtgccgcttccacctgcacgtctgtccccagcagggctgagccggcccccagggccagcacggccatcacgtgatagcgcccaggcagcacatagcgatgcgaggcagccggcccagcggcatccacctcgggggagccgtctccgaagtcccagcgtgtggcagtgacagggagcggggcagcgatgtggaaggctgctagctggccggaggccaggggtccgtggggccccaccagggtggcccctggggaggcagggaagacgtgctggaggagggtggggcccctacaggtgggggcaggaggcggcggggggccggagcagagggacaggcaggcgaaggaggcactggagggctgggctgacccacacaggcaccagccctgctcggagagggctgcgaggccctggccggtggagaagcagaaggcgctgcaggcctctggctgaagcaggccttcgtgggcagctgaaaaggacactgctgccacggtgcctgagctgttgtcagggaggcaggcgacatactcctcacctagaagaggcagccactggaccccgggttctgctcctcctggctccaccccacacccccccatccgcccgccgcactcacaggctcccatgctgttcccttggcccggaggccccccccagagaggccttcctgagccctgcccagtgtctgcagggcccaggtcccacctggctgggaaggacagagctgccccacccaccggcactcaccacagccactgtccagcaaggggatgccaagcagaggctggccagccagggagccaggcccagcacacgtggctgcctcgggctgcaccacccgcacctgctgctcctccgcccatcgcggcagccacgccaggccacagtcacactcaaacgggttcccactcaggtttctgcggggcaggggcaggtgttggggaccaggtctggtgggaagggtctatgccagccccccactggcaaccaggccctggagccaccctgacagcaccgcctcccctgccccaaccaagccggcactggggggctccaagcaggtagtgaactgcccccaggatctggtctcaagcctggaaggggacacggaccaactgggagggcagaagggatactgggggcctggggtccagccaggaccccacccaaagaaccacaacttacatttcacttaaattaaataaattagcaaatattccttcttctaacgtagaaatcttgttgttgcttatatccctggaagagaggggggattcggcaaagctgacggaagcccccacagctgagcagcaagaggcggtgccgccagcccacccggagtgagccccgcatgctggcacgactgggggacactcacagctctgccagcgccgagaggttcgccaggagcccaacgtccagcgcccggagcaggttgtgggagacgtctctgaggagtgagtggccgtgggtcagggccagagcccttagtaggccagaggccatccctgggcccatcccacacatttccagcatccccaagctaaggcctcccacccttgagctccccactcccagaggtcaggaggggcctttctgatggaagacccaaatgaacactcatctggggaaaccaagccaggagaggcctgggggcctcagccctctgcacccatctcagccctatgccgagtgccacctggacctgtccacccagggccaggaagggcacggacccccaacccatcccacgcagggccaaggccccccatcccctgtccacagtcccccacagagccaaggtctcccaaccctgtccacagcccccacacagactcgaggggcccccatctcctgttctgaacccaacagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagaccagccgacctaactccatctaaaatacacaacttctacgcaaaatataaataaaattagaaaacaaactacaatctcagaaaagcactagcaacttagacgacatactaaaggccaaaaataccctcctgacacacagctaataaagaaaaagtcaactattccagttaaaaagaagaaaaggaaactggctgtggtggcttatgcctgtaatcccagtgctttgggaaggccaggagtttgagaccaggatggacagcatagcaagaccccatctctacaaggaaaaaaagaatcagccaggcatggtggtgtggagctgtagttccaactactcggggggctgaggaggaaggatcgcttgagccagggaggtcgaggctgcagtgagctatgattgtgccactgcagtccagcctgggcgacagagcaagacccagtctcgaaagaaaagaaagagaaagcaagaaaagaaagatggctgggcacggtggctcactcctgtaatcccagcactttgggaggccaaggtgggtggatcatgagatcaagagatcaagaccatcctggccaacagggtgaaaccccgtctctactaaaaatgcaaaaattagctgggcgtggtggcgggcaccagtccaggctactcgggaggctgaggcaggagaatggtgtgaacccaggaggcggagcttgcagtgagccgagatggcactgctgcactccagcctgggcaacagagtgagactccatctcaaataataataaaaaataaataaataaataaataaaagacatcactcacacctgtaatcccagcacttcgggaggccgaggcaagcagatcacctaaggccaagagttcaagaccagcctgaccaacatggtgaaaccccatctctactaaaaatatttttaaaaattagctgggcgtggtggcgcgcgcctgtaatcccagctactcaggaggctgaggcaggagaatcgcttgaacccgggaggtggaggctgcagtgagccgagatcacaccattgtcctccagcctgggtgacagagccagactccgtctcaaacaaaacaaaacaaaagacatcagctagctggtccaagcacagtggtgttcacaacgaattgatcacagccaggtagaattcttcattctttctccagttccactgctttgcttgaccagccttaaagacacacatatacatttttgtctgggcgcgctggctcacacctgtaatcccaacactttgggaggccaaggcaggtggatcacttgaggtcaggagtttgagaccagcctgaccaacgtggagaaaccccgtctctcctaaaaatacaaaattagccaggcatggtggcacacgcctgtaatcccagctactggagaggctgaggcaggagaatcgcttgaacccgggaggcggaggttgccgtgagctgagatcgcgccactgcactccagcctgggcaacaagagcgaaactctgtctcaaaaaaaaaaaaaaaaaagtatatatttttaaaagacattggccgggtgcggtggctcacgcctgtaatcccagcactttgggaggccgaggtgggcagatcacgaggtcaggagatcgagaccatcctggccaacacggtaaaaccccgtctctactaaaaatacaaaaattagctgggcacggtggtgcatgcctgtaaacccagctaccaggtactcgggaggctgaggcaggagaatcacttgaaccagggagtcggaggttgcggcgagctgagatcatgccactgcactgcggcctggagacaagagcaagactccgtctcaaaaaaaaaaaaaaaaaaaaaaaaaaagacatcaactaattgcagtgtgtggaccttatttggctcttaattcaaactattaaaccaaaaatgtgaacacaccaggccttcggtggcatgaaggaattgtctgttgtgttaggtgggtctgcggtattgcgatgccctccaaaatgcttgcagataaaagggtggctggaatttggttcaaaacatgggtcagggctgggcgtggtggctcatgcctgtaatcccagcactttgggaggccgaggcgggcggatcatctgaggtcaggagttcaagaccagcctgaccaatatggagaaaccctgtctctactaaaaatacaaaattagccaggcatggtggtgcacgcctgtaatcccagctactcgggaggctgaggcaggaaaagcgcttgaacccaggaggcggaggttgccatgagccgagatcgtgccattgcactccagccttggcaacaagagtgaactctgtctcaaaaaaaaaaacaaaaaacacatgggtcaggaggggaagggtcggggcagggagggcagggcaggctctggggtggggggtctgtgagtcagccacggctctgcccacgtctccccacgaagcttcgagccatgcagagcagcacgttttgcagtacgccatcttttccaaaagccaccacctctcggcagcatccttaacccaaggcaggctgtggcctcagaagccccggctgtcctccacctggaactggacacagctgtccctgctgagcttcagcagccagggagccacaagtggagaggcacctgcgtgagccccccaggaaggctactggtgacacccagacagcaacgctcctggacccttgaacacctgccagcagctgtgatctgtgtccttcacctctcccagcttgacccctcttccctggggaaaacccagccgtctccccgaggaggagtttgcagggtagacagcaaaatggctgggctgccccacagcacagagggtggcctggggggccagccagggccttcacatccttcctagggccctagtttcccatgggtcccctcaccccaccttccagaactctcccagcggcggccccaggtgtgtacagaacagcacccacctgcccacgaggtcaccctgtgccctgttgcacacttgaggggcctggcattcggaatcttgccagctcaggctgggacaggccaccaacccccagggtccccctcctccaaaccccaggaccagagcctaagaggacaacacaaggcaggggcgggggttccactgctgtgccaagggcctggagaacacgggccttgctctccgctcagcagccaccagcgcccttctctcccggacagctcccgaggggctgctctcatggacaccatcaggtgctgggaagcaggaaccaccaggacctggacagagtccccagtgaccggcctggcagacagaggagccctcagctacagcatcacaaacaacgggtggggtaggtctgatgcaattctgtgggtgctgttgccaggcaggaggaggccatctccacagagacagccgcgagacacacgcgtccgcagtcagggagcgcaggagcaatgtggccccgaggggcacgggctccattggtccaggagaacccattcttctcccaccctcgagaccacccagcaaagccccaaggacacacggctcccctaaggaagggtggccacaggcgggagtgacccagaaacgttacaaaaccaaatgccagaacccatccaatgtttagaaagcctggggatgtgccacgtcccccagggatccagcacgcacccaaagagacactgtcccggcgaggagcctggagcctgggaaatacaaggcatcagactggtaccaagactctccccagcgctggggacaactgtctgcttatcttagtcccctgcgcccttttcaatccaaccctgggtcctgggcacctcatagttccaaacccctgctatgcacatcccggctgtgatgcctgggacaggtcctgtcctggctgtgatgcctgggacaggtcgtgtcacctctccaaacctgtttcctcatctgtgaaatgcaaatctccacggtccctatgcctcggatggtcagagtcaggattccgcatgacgacccccaacaggagcctggcacagacctggctctgggcagcgtctccataaaggccacctgttgtttttatctcccgaaagcgaacatgacaaggctttaaccccccacggcaatccgccctcacccctgttctcaggatagccttggaacccaatagcagagcgcctgaggcccttcatgaccccagcccacccgcgagcccacctcccaccctgcccctacccctcacacctcccgtggccagcctccagcctcacggtctttgctcacaccgttcaccccccttcttctggacccacctcatcgccccttcctaagcatcagcccaattcttgcacatccatcaaatccttgtccagacacctcctggaactcttccctgcagccccctacagccatccccatctctccgggtaccccgcagccccaggccgaatcccaattcctctccaattagcgactgtttgtcctcccagctgagcgcggcctccgcgccccgcccccgctggcgtccgcagagcccccgggtgggacgtctgtctccagacccggggtttttcggctccccggggccgtgccaaccgcggctccaggcgttccttatttagcagggccgctgtgccgcgccggagcctcgccctgggagcgtcctggcccgcgtcctgcttcccgtcccgggccagggaacgcgcccacgcccgcccgtcccgcggcctctcccgggtgccgctgggcccgctactcacagcgctgtggcgtccgcggggatgcgcagcgcgggaccgagcgtccgcagcccgcggcccgcggcccgagcagttgacgcggcaggcggcgccgggcgctaggccgcagaggcaggggggctcgcaaggcccgcagccgcgcccggggccccccgccagcgccccgagccacaggcccaggcccagggccagcgccaggcgggcgggcgcggcgggcggcatcgttagggcagcgcgcgcatggccccgccgtccccaggcccgcccgcgcgcggaggccgcggctcaggcggggccggcggacggcatggcgggcgcggggctggatggggctgcggccgcgacctgctgctgagcgacgcccgctcggggctcggggccaggccgctccgggagctcggccgcccgctcggacgttggcgctgcagtgcgggccccgccgcggctcctcctcctcctccccgcgcggcgcagggcggacggggcgagggggggcggggcgggtgcaggctccgcccccttcgccacagcgcgaccgggccagcgatgagggactggcatccggaggcttcaccctccgctccacagggtcggcagcagggcggggcctccggaagctccgccccacgctttcccggggcgcatgcgacgtggggcggagcgtctggaagctccgcccgtcgc

SEQ ID NO: 1523 - DNA, 3491052 bp, Homo sapiens; identical to SEQ ID NO: 1521

SEQ ID NO: 1524 - DNA, 55 bp, Homo sapiens
gactgtccttggccaaggcctcctagccttgagtaggggccccggccagcagtgg

SEQ ID NO: 1525 - DNA, 62280 bp, Homo sapiens
ggcggcggctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgaggtgagcgcccgccccgccgcccggcgccgagtcgccgggccggtggttcagcctctctgggccgcgctggcctcgtctctgacaccgggcggtgtggagtccttggagcccttacctcttccgaggctatgctgtccgcgggctccctgcagcccctccccagtcgcgctggaggggaggttcttatcatggggtcgtctaaggactgaggggtgccagacctcaggttcttcaaaaccccgactccagatccccggaacacagaccccagatcctcaaaacccagaccctaaattccctggagcccagactccatttctttaaaacttagacctgagatctcctcgaatcagaccccctgaaactcagatttccccaaacccacattccagaacctagagaccacatgtcttatcccccaaactccacagcccagaaccccccgaagttctaatccactgctcctccaaaccccgcggcatgattttaaagagcatcaattcccatcccatagatactgacctagtagatcagtattggcaaccctggggccggaaagctattttttatttctccggctcccctccacttctgaaaatggagagttgccagctgccctgattgccttaatgagtagttaatggaattaccctagagatttgtgctgaaggttttttttttttttttttttaattaagttgtaaagtcctgttaaatgtttatcagcccggtgggattatgacccagaaaggttcccgtaaagaggaaagggatggatggaggtaggggcagaatgtcatttgtcccggtagatgggaggggaccagagcaaggcctgggcctcatttttgggaggggatttatggtggggtaggacaaggaagaggaaaagagcgggtgcctcggaggtaatttaggagaaaacgaaggaagaggctgggaaatgccaaagagagggattggggaataagaccccaaagatcgtctgaaagcacctttgagctgttccagggctggcagtgaagggtgaagctctgtgttctgcaaagcgggctgctgaggattgggggaggggtagggagtcagttccacaccccaccagctctgcgacctgcccttgctctaggtttcagtttttgtacctataggatggtgttgggagagaaacagtggaacccagcagatacatttctttaacaagcggatccgtgatcttcttcaaggcccccttgtttgctgctttttcagactgaagaggtcagaggtcaggcattgaatgaatctacccactggcagcggcagggctcctaggatttcctgggtacatgtttctgggtgcccatgccacctcctaggtctgcactggggacaggacacgttcagggtggtatggctgtagacggcacagggcatttcagaagctgaaatgcaagaggccgctaaggcctcttgcaacttgtagtttccaggggttctggaaggaaggaaaagacaggcacccccctccaccctcaccctcatactaatagtgaccttgagagcagagaacaggttttgtgacccatttcaaagtgtgttccttaagcccaagggctgcctgtccagatggtgtgggacactcattctttcataagtaattcagattctgaaatcagacatttcatactggccatcttgatgtagattacattgccatcctgtgtcctgattgtactttatgaaagatgtagaaacaatcatgatatttcacggttatttcttgattgtgttttttgtgttcctatgcaactgccgccattcttctctagctttctcccatcctgagtgtttttacatcgtgttcattgagtcaacaactatttactgagccccggcacatactgaagccttgtccccagtgtggatatagcagtacagtgaacagaacagacaaaactccatactctcatgagactgacattttgttctctaacagggaccttactgttaaaaaaaaaaaaaattatactggttgctaatactttaacaatcagcaggtttcacattaaaaactgggtgctttatttctctggaaagccagccgatctttaggctgccacacttggcttgggttttgtagtgatctgaatccttttggatgaatgtcccttgatgttgcctccctaaccggtctagtctggtgaatttccagtccctgccttaaatgcatgcatctgaatctctttgtcacctgtagcaaattcactgagtacctagagtaagctagacactgtctcaggcactggggaatgaagttgtcactgacctcagagaactttacatacaggcttaaccttatttcacacgagtcctttcccaaatgttcaaatgttcgttttatgagttagtcactttgtacatcatcttagctggtgagattcgactgtttcatagcggctcgtgtcatggtttgtttcatggtcatagagcattaacattttggaggtgaggcttttaggtgcatcagacccaactgcttccttttacagacatggaaactgagcctcagagtggttgagctgtgcaggtacatttaggaaattttccttgagcccagtatgttccctacgtattacactgtgttgcctttttcttcagagagagatattaaatagtgatacaaactgctttttccattttacttattttattttgttttattttgaggcagggtctcacactgttgctcaggctggagtatagtggcaccatcatagctcaccaaagcctctgactcctggcctcaagcagtcctcctgcctcggcctcctgagtagctgaggctacaggcacgtgccatcatgcctagctaattttttttctagtagggatgaggtgtggctgtgttgtccaggctggtctcctgggctcaagtgatcctccttctttggcctcccaaagtgctgggattacaggcatgagccaccatgcctggccgcaaactgatttttctttgaatccatattctgtagcaggtgcttaatatgcattgatgtgaatctgtacaaccacatgaaaaggagtggctctatgtctgcacctgaagaaaccgaacacgagcttgcccaaggccacgcaacacgtggaagactcagatggcatttgggcatcttactgggttaacacttcgtgtctggtaatgctcagaatgtaagagttttagagagtccttgaagagaggacagatattaaatgtctttttagtctctttttcttcggagaatgaaagtaatgagaaaattaagtttctagatgaatgttgctccaagtatttgaaattattcagagttagtaaggaagatttctggccctcattgcagacctttagttgagaaatagaggtgggccccaggaatttgcaatttattttactttattttattattatttttgagacggagtcttgctctgtctcccaggctggagtgctgtggcatgatcttggctcactgcaacctccgcctcctgagttcaaacaattttcctgcctcagcctcccaagtacctgggactaccggtgcctgccaccatgcctgggtaactttttttgtatttttagtagggacagggtttcaccttgttggccaggctggtctcaaattcctgaccttaagtgatctgcccacctcaccctcctgaagtgctgggagtactggcatgagccaccgtgcccagccaggaatttgcatgttaataagcaccttactaatggcaaagtttgcaaatttgttttagacccggaaacttacacgagcaacctagaggcagccactaaaataaacagaaaagcattgaaaaataaggcattgtaataggctgtaggtggtttctaatctgaaaaacattgagtcacatgatttgggagagagtttgttgatttccctctgtccccagtaatgccccgtgttaaaagctggcatataataggtcctcagtgaatgtatactgactgagtgcattcaggtgtaacatgtgtagttaattcccaaaggcaatgttatgatttctgttttccttccttcctttccagataaagctgtacaccaagcatgggactttgaaataccagacagactgtgcccctaataatggttactttatgatccctttgtatgataaggtaagaggggactgcttgtcacttatgatgggaagtcactagtgtgcctcaccaggctgcattaaccatgtcctttcctacactagcaaatgctcatctgttttgtaaattattagtggaatatgataatcctagccacatttggagggagacaacttacaaactgccttgacgaatacagtggctctctctgtgtttaggaccatttggcaatgtctagagacgtttttgttgtgacatctgtggctgtgcgctacagtcacccagtgagtagtggccaggcgtggagctaaatgtgctacagtgctgcctacgacagcccagatgtcagtagtgccagggctgagaaactctgatttcatggaacccgttacttgcaagcagcttaaagtattgttaaaaaaattgtacaagtaatacatgaattcatgaactttgtgaaaaagaaagtcaaggtctttagaagtatgtgaaataaatttgtacccttttcgctccaattttacctccctctgtagtgataacctctgataatctgataaaggttttttttgttgtttttttttttcttcttttgagttggagtctcgctctgtcgcccaggctggagtgcagtggtgtgatcttgcctcactccaacctccaccccccaggttcaagccattttccttcctcagcctcctgaatagctgggattacaggcatctgccactacacccagctaatgttttgtatttttaatagtgatggggttttgccatgttggctaggctggtctcgaactcctgacctcaagtgaaccacctgcctcagcctcccaaagtgctgggattacaggtgtgagccgatgtttccggccctcttataaaattttgatgtgcatcctaacagattgctttctatttatagttattcagatatccacgggtacacatgcatatgtatatatggaaatacacacaagcacacatgcacatcgatatgtatccacaaacacctctatacaatcccatcctcccacatataaaccttttatttggaaatacagattcataggaagttgcaaaaatagtcaatacacatagttttgattttgatatattttttaatacaaatgaaatcaaacaataggatttattctgcagtttcattttttcccctgtgttaatgctttcaataccagagggacatttggttttttcctcttgcatgctttcaacattagcatagatagatctactgacttttttttttttttttgagacagagtctcactctgtcagccaggctggagtgcagtggcgcgatctcggctcactgcaacctctgcctcctgggttccagtgattcttctgcctcagcctcccaagtagctgggattacaggcacccaccaccatgcccagctaattttttttgtatttttagtagagatggtgtttcaccatgttggccaggctggttttgaactcctgacctcaggtgatccgcccacctcagcctcccagagtgctgggattacaggcatgagccaccatgctcagcctactgacttctttttaatggctgcatagtgtgtcagagtcaaacccaaactgtaatttatttaactacttggacatatagactttccccaattttaaaataatagtaattttaacataacacaccaggaaatattcttgaacttaactcttcatccagaatgcataggattgatttctagagatggactagctgggtctgtcctgaaatctatttaattaatttttaaatagtatcagtatcagtctcaagaaaccaggaggctggacgtggtagctcatgcctgtaatcctagcactttgggaggttgaggtaggtggatcgcctgagctcaggagtgtgagaccagcctgggcaacatggtgcaaccccgtctctactaaaatacaaaaaaattagccgggtgtcacgtggatgcctgtagtcccagctacttgggaggctgaggcaggagaatcgcttgaacccaggagacggaggttgcagtgagccaagatcgcaccacttcactccagcctgggcaacagagcgaggctccatctcaaaaaaaaaaaactaaaacaaaaacagaaaccagggttgataagtaaaatctagttttatttattgaattaatgagttaacgtattgtttagagacaggatccccttccgctgcccatgctggagtgcaggggcacaattatggttcactgcagcactgacctcctgggctcaagtgatctttctgcctcttcctcctaagtagctaagactgtaggcgcctgccaccacacccagctaattttttaagaacattttttgtacagatggggtcttgctatgttgcttaggctggtcttgaactcctggcctcaagtgaccctcctgccttggcctcccacagtgttgggattataggtgtgaggtactgtgcctggccaaatctagttttagggggtgcctttagttcctgaagatacatgctaacttgtgcaactgtaggcatgtgagggcttaatgggagactcaattaatagaattatagtatgtttagtattaaaagacagtgagtggctgaacctagtgtctttagaactcatgaatgggcttcagcactgtcttctgattgtttagatgaaaacttctggtgttcagcttcagcttgtagcttctgaagagaatcagtgctcagtaccatgtagaagaacaaggcttactcttagaatttcatttccggtgtaaaaaaattttagattaaatgataacactaaactaaatttagccagagtcacaattctcatttcttgaaattacattttctttttttccttttagggggatttcattctgaagattgagcctcccctagggtggagttttggtaagttaactgaatcactagacattctttgtaaaagattagatgatatgccgaatattaatttaggctagcagagtgcataaactattaaaatattaaggatcatttccagtatggaagagggtttgtattcctcccctccttgcccccatcactctggtttagttcggatttaccttaatctacctcaagactttctgtcacctttgaaaaatagacatcttttcttctacctttctggaaactcttcccttgcagtttcactcattacgtggccgtggaacagtatagaaatcaagagtggggacttggttcccatcccaggatggcttcttttttagccccctcagttttttaagtttttatggaattaattgaaacatttaaagattgtgagatttgtcataaaaatccagatttatgtcccatgagatgagaagactgtcagccttataccttaccagttaaataactttgggcaagttacttcccccgtgtcagcctggctcctcactgtcgagcaagggtagttatagtccctgccccactgggtacttggaggattaataaaccaatactgagtgttcagaggggctggcacgtaattagcaagtactcagtattcagaaacagcccttctgcacacatcccaacaaaagctccaaactttcctcatataactgccttcaagcatagctggggagttggggatggggttgagatcagaagagagggtctgttttgatgtagtttacatttttgaagaggagagactcttgatgtttcagtagagcaggtgtgggtgaccccagtccatggcttggggagaggagtagggatcaccgttgttgatatcaggcttgctcgtgcattagacaaggaagaatttagcacctgccatcaccaaggctaaaatgaggctcaggcagctgacagctaatttggctctgtgagagcagctcttttatcagtttatagtcaggggtagggtcgggggtgcctggctggtacgttccagaaagctggagaggaatgcagccctgctcatggccaaagcagaagtccagattggtggcctggaggagtgttgtgtttgccaccccccaccctacccccaactggtgctgttgataagctttttaattgaattatactttcagaaaagtgccttggatgaattttcactaagtgaacacacccatgtatccaccatccagataataagatagcacttcaccagcaccccagaagtccccatcctgggtgctcattagccatcccgccccaccctccaggtgaccaccaccctgaccttctacaaattagagatccatttggtctgttttgaactttatacaaatgctatcatgcagggaactttttaatatccggtttctttcactcaacattatgaactttatctgtatcatttgtagctttagttcattctctttgctgttgagaattctgatgcataaatataaaattatttatattttataaaatacttatattttattttatttttttcttttttttgagactgagtctcgctctgttgcccaggctggagtgtgatctcagttcactgcaacttctgcccgggttcaagcaattcttgtgcctcagcctcctcagtagatgagattacaggtgtgcaccaccacacccagctaatttttgtatttttagtagagatggggtttcatcatgttgacccaggctggtctcgaactcctgacctcaagtgatctgcccgctttggcctcccaaagtgttgggattataggcaagagccaccacgcctggcctatatttatattttatattcatattttgtatcagtgatctcttctactgttgatggccatttgagttgcttaccgattttggccactaagagcagtgctcctgtgaacattcttgtatgtatattttgatacatgtgtctgcatttttgctgagtatatcacaggagtaaagtcgctgagccatagagctgatacatgctcagctttaggtgtttgcaaacatccaaagtggatgcaccagtttgtgttctcccagcagtgtacaagggtttccattgctccacatcctaacctacacttgatatcgtcagttttttttaattttagcccttctggtgggggtgtggtattatctcactgtggccttgatttacattccactgatggccaatgaggttgcacactttttcgtatgtttatgtttgtttgccatgggctagctatttttgtaagattcctgttcaagtcttttgcccattttttattggagtctttgtgtgtgtgtgtgtgtgtgtgtgtgtgcatgtacgcgtgcaagcacgtgtgtaattcatcttaactgaaaatctcatctcatggttttccatttttttctctactcattactccatattcttcctaacctttcaaaaactcaaccttaacccctattatgatgaactcttcagttaaaaaatggagttaattgctgatattgaaaaatcaagagatggtatataaaatccagatttccagtttttcggagaagttggaagctctggcaaagcatggtagtggttggcagacttgagtggcagttgtctcctttcaatttgccacagtccccctgaggatgctccgctcacttcgaacccatgaggcccctgtggccctggagtttgtgttcctggtttaacatggctgagctcatgtccttggtcagagaacagatccagagccagacttttagggttgaattggggctctgttactcagaagctctgtgatcttgggagctcctttaacctttctgtgccttaatttacccctcagtaaattgcagctattactgcctgtctcttaagataattgtgaggattaaaggcactcagctcagtgcctggtcggtgatgagcattcaggaaataaaattatttggtgctcactgaattttcactggaactctgagatataacttagctgaaaggcgttgtaaaattattttatactctaaacacgaattccctctggggcaggaaaccaggaggctagggggataggggtgagagggagacttttcccagaatactttttcgtacctttggatttggaaacacaacgagtgtattaagtgttcaaaagtaaaatgaaacctgaataataaaaatacgttctacttaggttcactgtaccccaaaactaagcttgcctttgtgtcttgtgccccggtttcctcccctgcttcgttcctcagagccgacgaccgtggagctccatgtggatggagtcagtgacatctgcacaaagggtggggacatcaactttgtcttcactgggttctctgtgaatggcaaggtttgtctttggaacttgattatttttcctgttcactctataatgtatactaaatccttttttaaaaaaatgcaggatattttaacctggggactttgatcccacaagggacccatggataagtggcaagtgagcctgtgaactctgtacttcatccgtgtagaacacagcaggtgtatttaggaatgagattgaggttgctggtcatcccctctgctcccagagcataggctgttggtgtttttatttttttattttttattttgagacagggtcttcctctattgcccaggctggagtgcagtggtgcaatcttgactcactgcagcctccacctcccaggttcaagtgattctcctgcctcaccctcccgctccttcaccctcccgagtagctaggattacaagtgtgtgccaccatgcctggctaatttttgtattttcagtagagatgggcttttgctgtgttggccaggctggtctcaaactcctgacctcaggtgatccgcctgcctccacctcccatagtgctgggattacaggtgtacgctgtgcacccagccgctgttagcgtttatgtcagggatggccttttacagggatgccgaattggaaggacacactctctaagccttgtggcatcttgctgtccctgtgggtgaattgaagtcagcttctcccagagagagcgtgcatctgcttctgacacttacgtaggaggattcctattatttaagttctgagatttttttggaccgccacggtggtgtgaatttagagtcctaacgggtgtgtgcccagctcccgtgattcagattctcaggggagagtcatttctcctccacccgccctgtgcctgcggttgagatgtgcttccttccttcctgtccttctcttcatgatggacttctttctcctctacctttgcggtgacggggaggcccttccatcccagctgtatgtgtgggcttcttgttagagatggggatcttgggtagttttttctttatcgatggtttgcaaaataatggtgaacctttttttatttttatttttatttatttatttttttgagacagagtctcgctctgtggcctaagctggagtgcagtagcgcagtctctctcaccacaacctccacctcctgggttcgagcaattctcctgcctcagcctccccagtagctgggattacaggcgtgtgccacctgacccagctaatttttatatttttatttttatgtacatttacttttttttttttttttttttttttaagatggagtctccctctgtcgcccaggctggagtgcagtggcgcgattgcagcttactgcaacctccgcctcctgggttcaagtgattctcctgcctcagcctcaggagtagctgggattacaagcatgtgccatgacgcccagctaatttttgtatttttagtagagacagggtttcaccatgttggccaggctggtctcaaactcctgacctcaagtggtctgcctgcctcagcctcccaaagtgctgggattacaggcgtgaaccaccacacccacccagaccaataatggtgaatctataactgatgatgtcttagattcattgaaatagagtcttattttactgttactgttccctctcctacctcatccccaggaaacatatccatgatttatagcatcttttcaatgggattcttgacccaaagagggttcctgggctccacctgggagttgtaagcaggactgccagtgctttgagaggagggtgctttgctgggtgggccctaactttcttctccatggcaggtcctcagcaaagggcagcccctgggtcctgcgggagttcaggtgtctctgagaaacactgggaccgaagcaaagatccagtccacagttacacagcctggcggaaagtgagtagcgtcctgtctcttagtgttgccttagagccgggctctgacaggggtcatggagctgggtttgggagtttggattcagggagttctgggttcagatcctgattcagcctcttaagtttgggtgagttcatgcccgtcagagtgctgagttccccacatgtgaaatggaatccatttgacccatcttgcctagcattgatgagatgattaaatatgagttcatactggccaggcatgttggcttgcgcctataatgccagcactttgggaggccagtatgggaggatcacttgagttcaggagttcgagaccagcctggacaacatagggagactcagtctccacaaataatttaaaaaattatatcaagtagagtcccatgggggaagaaaattagctgggtgtggtggcatgcttctgtggttgcagctactcgggaggctgaggcgggaggattgcttgagcctggaaggttgaggctgcggtgagccgtgatcatgtgccactgtgctccagcctcggcagcagagcaagaccctgtctgaaacaaacaaaaaaagagttaatacccataaagcacctgcttcaaggcctggggcttagtgggtcttcatttagcagctcagcctggctctggagcctgccagcccgggcttgaatcccagctcccccatttgctggctggttgacctagggcaagttccttaacccctctgtgcctcagtttcctcttttgtaaatgaagataattgtggaacctatctcctaaggtactggaaagatgaaattaatattattacttcaagctgcctggcatattagctcaaataggttagctcagttatgattagaaaaaatcattatcattattatatcaaaactgctttgtagttggaacagatgcctagctgaccttgctgagtcagatttaaagcatttatttaatggatgtatatagttgagttgtaaatgttaacagatatgccaagattaataccagaatagttcaaactgataattccgaaagcgttcaaatcattactaactccgttaatatacaaactgagtaaattgcaaaatagaagtttataatgagtctgtcagtaagttattcaattttaaagttattattgttgaaactagttttcatttttgaaataacatttacttctgcttgactggtgcctctccaggcctggtgtgtagcaggaatatggagctgtaattttttttctgggctagtaatttggtgttgaccttactagaaaaaaatagtgtcttgagccttctgaatacctttcatctgcactaactgaaacaatgaaacatgtagcactgggctattatgaaaatgaaatagaacctcaatcttaccaatacttgtagtaatgtgatttccaagacctatccagttattgcaggcaagatttgacacaataaaataccacagaagaagaaatcaaatgcgttttctagttcatttcaccggacttagccttctcatttgtcagttgccttacaaatttgaagggataaacatgttagtatactggcagcagcatttccagctttagctcggctcactctggtgttagtctgtctatggctagtagagtaattttcatcagctgctggtttcttatctcagttgctttgtgcaaaaacccagaatgacttatctgtgtttctctaaagccttttttctgggattcaaagcttatcatagtttaccctgccctgtgtcatttgcatcatcttgggtcagcgtccccctcagcctgtgcatctgttctgttctttttcaccccacttctcccttcccatgtgtttccttggacacttctgtccccttctccttgtcagttcatgcctgtcacctctgtcaaacccagtcgaatgttctgtgactggtccctgctgtgctacaaggattggttttatgccagaaatccttgagattaagggagacgtaagcactcctctttccgatcagcacatggagcacccctcttggcacacagtaagtgctcaataagcgctcttttatgcagatttgtacagtgaaggattgaatttcattcatgctcatttaacaagctaatggaagtttgcgataattccaacattgttttcttgtgctgccaacattagtcatagaattagaaatacttgggttgtttggagaaagttaaatggttattttttatgtcttaggtttgcattttttaaagttctgcctggagattatgaaatcctcgcaactcatccaacctgggcgttgaaagaggtgagtgacagctacgtctatagccatgccaataatatgctggtcttgggacaaatgtagggcttttcaatttaggatatgaaaagaatttatggttcctccaggactagatgaagaaccaatggtgctgttgtttagtttggtagttatttataaggtgtaactcctcactgtagcagatgttgcttgtgttagtttcagttttaggtgacagtgttgtcttcctgctgtgaaatagatctgttttattaactatagctattttaaactaaatcaacaacagaaggccctgacgagatttatttgttgttcttttttcagcctgaaacagaaatctgtaaatatactaaacattctagaaactgtggtacgcgtgaccaaggagaatgtatgagaatgtttattgcagctttgtttgtaatagcaaaatattgtaaacaacctaaatgccttttaagagaagaatggattggggttccatcatacaataggctgctgtatgtcagcagtaatgaatgaaccagagctacatatatcaatgtaactacatttaaaaacagagttgaaggaaatatgattttaaatacttgtgataatcatttatggatacagtcttttttttttttttttttttttaaagacggagtctcgctctgttgccaagactggagtgcagtggcatgattttggcttattgcaacctcggccttctgtgtccaagcgagtctccggcttcagtctcctgagcagctgaattacagggatgtgccaccacgcccagctaatttttgtatttttagtatatatgggattttgccatgttggccaggctggtctcgaactcctagcctcaaatgatccaccagcctcgggctctcaaagtggtgggattacaggtataaaccagtgcactcggccagatacagtctttttttttttttttttttttgcaacagggtcttgctctgttgcccaggctagagtacagtgacatattcatggctcattgcagcctctggttcctggccttaagcgatccttcaccttggcctcccaaggatctggaactgcaggcatgtgccactgcccctagctaaggatacagtcttttttttttgagatgaagtcttgctcttgttgcccaggctggagtgcaatggggcgatctcggctcattgcaacctccgcctcttgggttcaagcgattctcctgcctcagcctcctgagtagctggggttacaggtgcctgccaccatgcccagttaatttttgtatttttagtagggacagggaggatacagtcttatgtagaaaaattataaagacatgtatgggaatagcagacgctgttcaaaatgatactgacttctagagaaagagggaggagggggacttcggggtacgccagcatcttgaattgtatttttttaaatttctttagctggttagaaggtatgtaagtgttctttagcatatctttttttgtttgactgaaatagtttatagtcaaagatcaaaaaaggaactccacctagtaggtgaggttctgtaatagccgtgaaagaccaaattgaaataagacttaagggacatcttgacatgttagcttctgtgttagtattgaagctgtatctcatttttgctaaagaagcattggaatcagtatttcagcttctactctatctgttttattattatttttactctgtaggttttacgcacttataattgatgatagtttcacacctagatgtctcttcttactgtttgtgacttttggttttgggggtttttctcttctgcagcaacatttaaaaatattttattcgaggctgggcgcagttgctcatgctgtaattccagcattttgggaggctgaggtgggtggatcacttgaggtcaggagttcgagaccaacctggccaacatggtgaaaccgcatctctactaaaaatagaaaaaaattagccaggaatggtggcatacacctgtaatcccagctactcgggaggctgaggcaggagaatcgcttgaacctgggaggtggaggtagcagtgagccaagattgcaccactgcacttcagcttgggtgacagagtgagactccatctcaaaaaaaaaaaaaaaaaaatttattcgaaatgaaagagcttacacatttataaatagaagagattttaaggtttacattgtatgttaattgtctgcatagaagaatctgagtttattaatatgagattgggattttcaagtaaagcatgttgttagaagtcaggataatgtttatcttcctggggtgttagtgaccggaagcaagtgtgagggcacttctggcttgctggtgctattctgttgggtaatcagtgcccaatttgtgacaagccctgtgctgcgtgcttagaatctgtacacttttctctgtgtttattgtaccttaacaaaaatgtttaaaaatatacacatattgtgaaaagaacaacttaaggcaaattaaacagagtttaattgagcatagaacaatttgtcaattgggcagctccctgagccagaataggtttacagcgactgtggcactgttgcgtgattggaaagggtttatggacagaaaaagaaagtgacggacagaaagtggaagtgaggtacagaaacagttggattggttacagctggacgtttgtcttatttgcacatggtttgaacagttggctgcctgtgagtagttgaagggtggctgcttgaattgggtgagacttggcaacacgtaagagaaacctttaggccaaacttaaaatatgtaaggaggcagctttaggctaatcttcagttaacactatatatcattaaaaatagaaaaaaaggcaaaatatgctcattaaaaaaattggaacatatagaggaatataaagcagtggaaacaaattttggaagctggaaaagtatacaagtaaaatagcaccatatagacaaaatcattattgtttacattttgccacatttcctttcacttcattttgggcattaaaaaataatgataagccaggcacggtggctcacacctgtaatcccagcactttgggaggctgaggcgggcggatcacctgaggtcaggagttcgagaccagcctggccaacacggtgaaaccctgtctctactaaaaatacaaaaattagccgggcgtggtggcgagcgcttgtaatccccgctacttgggaggctgaggcaggagaatctcttgaacccaggaggcagaggttgcagtgagccgaggttgcaccattgcactcaagcctgtgtgacatactgagactccgtctcaagaaaagaagtgatcatactgaataagcaattttatagattacgtttcccagttaatattttagcttcagcgtgtcctcatgttgttaggcactttgcaagtgtttatttttttacaggttaaaatctttttctgttacaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggtaagcaaagaaaagaacaaaagagatggtgtgaagggtaggagggtgggggattatagaccagaacgtactgttttaaaaaatgcaggtctgagttgatttatcattttaacacttaagaatatcgtctgtctcaggccgggtgtggtagctcatgcctgtaatcccagcactttgggaggccaaggtgggtggatcacttgaggtcaggagttttagaccagcctggccaacattatgaaaccccatctctactaaaaatacaaaaacattagccgggcatgttggcacgtgcctgtagtcccagctgcgtgggaggctgaggcagtagaatcgcttgaacccaggaggtggaggttgcagtgagccaagatcacgccactgcactccagcctgggtgacagagtgagactctcaaaaaaaaaaaaaaaattcaagaatatcatgtgtctctgttgactcacaagacattgcacatctacactgggaggcagtggtatgtgatggaaagtacacaggctttgaaatcagacctgggtttaaacaaatctcagatttaaacaaattcctcttcctagctatgcgaccctgggccggtcacattaccttcctgagcttccgtttccttatttggagaatggtgacccatgataaggaaggacagtcatgtcatctttcccgggaagactgtgccagtttttaactttgcaacttgaatgtcaagatttttgttccttttatctgtattaatgtttcttagatttcagaaatacatatattgacatgaaacttaaaaaaattttcctataatgtggctaattgatggtattcagaacatgtaaatggaaaaggaagtcttgtcttttttaccccctggcataggatgtcctgggctgcaatgtctcaccagtgcctgggttccagccccaagacgagagtctggtgtatttgtgctacacggtctccagagaagatggctcgttctctttctattccttgccaagtgggggctacactgtggtgagtgaagcagatttccgttctgtttatgtctgggactctcatgacacagtaaaagccaatgctgtttgggtgttaaaggaaaagatggttggcctgcagttctctgaacatgctgttaagcagtaacttacttaagatgagacactcaccccttcgtaatagctacaaaaagggcaaggcttcctcttttcaaatctgcaacagttatgatgaatgtttctcttggtctgtctgaaccccttgtcatttgtgggctgctagatcgattattaatattgctgattgatcatgttagtggttcttagtgattaagagactcttccttccagattccgttctatcgaggggagaggattacctttgatgtggcgccttccagacttgacttcacagtggagcatgacagcttgaaaatcgaggtaaggcttttctgtcttctggagggacaggtgtttgagttcccatccctaggcacaggtattgcaaacatgttttaaaaaaaaatcaattattttatctggaagggctgttggaaaaaatgccatctggtattatattcttacccatgatgtccttatcgtagagagctggattcctagttaaatctactcattcaatgaaatatatttattgattgccagtgacatgcatttcaggcaccattccaggactggggatatagcagtgaccaaaagaggcaaaaattcttgtccctgtggacctcatttttttttttttttttttttttaagacagggtctcactgtgtggctcaagctggagtgcagtggtacgatctcatctcactgcagccattgcctccagggttcaagtgatcctcccacctcagcctgttgagtagctgggaccacaggcacgtgccaccatgcccagctaatttttgtatttttgttagagatggggtttcaccatgttgcccaggctgttctctaactcctgggttcaagtgatctgcctgcctcggcttcccaaagtgttgggattacaggtgtgagccatcgcacctggctagacctcatgttctaatgacaggaagggtcaatacatgtatagatgtataagttagaaagtacagtagaaggtgataagtgttctctagaaaaataaaggaagaaaggaggtagtacagtatcagggtggagacaggggttgcagttgtacatagggtgtttttgggaagtcctccctgtgaaggtgacatttgagcaacaacctgaagggaaagaacaagagaaccatacttcactcctgcaggaagagtgtgtaagactgagggaacggcacgtgcaaaggtcctgaggcaggagtgtgctgaagggtttggggcatcccaaggaggccagggtggctggagtggagggaatgagcaaggaaggaggaggcggaaagagggtcagggaggtgacagggcagattgtgcagggcttggtgggctactttgcctataactctgggtgagaattggtgccactggaaggttcctagcagaggagtggcgtgatccttctggcagctgcattgaggagagtttgcagggtgtcagggtggaagtgggagaccagttgggatgccatggccgtaaaccaggtgagaactggcagagcttggaccgtgatggtaggaatgggcagtgtgatacatggcttgataaactgcctagaccctcacataaatggtaaatgtatttttcatctcacttacgtctcctttaattacagaagtagaaaatggttactgtagaaaattggctagctagaacaaatcccaaaagaaaataacagcctctcctaagtggaccacccaatgttagagttatcgaagcaattatattttaatcattttcttttaataattacatttgaaagtactgtgttaaaatcgcttaaactggcagaagcggacttttaggtcatatgcacagtggggtgcagactctgcattttaagattcagtggagtgtttgaccgttctgctgtacactggaggggaaagagaagggtaagaagatgaagcctttactttgcttctcgtagcttgcagagaaggatgggggcaggtgagcagagacagctattcccagattacagccaaatacatattttgaaaatgatgaatggaatttcagggaatggggccctgtaagttccctgaggtcaggtactgtgtcttattctttactgttttcctaacatgtgatttagtgcctggcacatagtaggtgcccagcaaaaatatttgttgcgtacatatgtgaattaataagtaggtaatgcatggaatgaaacatgtctttttggaaagatcaataaggactacctgtcatgtgagaccatcactaagaaaccatttgctgaaaaaaaaaataaaaaaataaaaaagaagggctccctgcataaaaaggaagtcatttaattatttaaagcttcatctcaaatgctgttgcacacgtgcgtgcacacattcattcattcaggagtcagttattgagtgcctgctgtgtaccaggtgactaagacagaaaaagtccctgtctccatgaggtaacatgctagtgggagggagacaactaagaaatcgaacgaggacatttcagatactggtaagtttgatgaagatattaaaataggttagcagtggtgaccttggggatacacagatcagggctggaactcagtaactgcagagaaagcacagctgtgctgctcacaggcgagtggggcacagacacagacacagacacatggagcacgggaccacgtgtgagccagtgatggtggtggaggagggtggtctaggtggatttctttttttttctttgagacagagtcttgctgcttcacacaggctggcactatcttggctcactgcaacctctgcatcccgagttgaagtgattctcctgcctcagcctcccgagtagctgggattacaggcgcccgccaccacacctggctaatttttgtatttttagtggagacagggcttcaccatgttggccaggctggtcttggactgctgacctcaagtgatctgcctgcctcggcctcccaaagtgctgggattacaggcgtgaaccactgcgcctggcctaggtggatttcataaggacctgtgttcaggtcgtggtggaaagacaggaggggacacgtgagaccttgcagaggtggaatccacaggactgatcgatgctggaggagcggggcgggtcatccaaagtgatgccggggtgtgcatgggagactggaggaagacgtggttcaccaaaatgggggcatctggaggggaggagatggcacaggggtaagggtggggggcttctagaagcttgagtcagtgaccttttaacgagggaagtaagtctctagacttttcttttctgttgtttgacactcagcagtgtgttgggaacacaacagagaagacagatgtgggtaaagtgagagggagcccggctggcacacaggaccggggcactgagtgttgggaggtgggcggcaggagcagacatggtaggtggtggccggcgcagcagaaggaggctttgtggctctggcacaggagcaccttcgagcaccttcttgttctttgttttctagcccgtgttccacgtcatgggattctccgtcaccgggagggtcttgaacggacccgaaggagatggtgttccagaagcagtagtcaccctgaataaccaaatcaaaggtgggctgacacagcagccccaggctgatggccagcgctctttttggatcacagagagaaatggagaggaactgatgactatatgagaacatggcagcttttggtccaagtattctggtgtacatgtaaggatacactgttgtttttggcttatcttctgtttgtgtgtttttgttttacagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggtaagcttatcgtgtggatttggaagcaccagtaaatatgctggcagccagtgtagaaccaaatgacctgtgatctgtgtgtctttgccgagcttaagaacttaagaaagattagtactttttttttttttttgagagacagagtcttgccctgttgcccaggctgtagtgcagtggtgccatctcgactcactgcaacctctgcctcccaggttcaagtgattctcctgcctcagcttcccaagtagctgggactacaggcgtgccccaccacacccagctaatttttgtattttttagtagagacagggtttcactatatgttgtccaggctagtctcaaaactcctaacctcaggctgtctgcctgctttggcctcccaaagtgctgggattataggtgtgagacactgcacccggccaagaaagattagttctaaatcttacaaactgaaggtactgacatgtcggatgcttaatgaaaagtcccttgcttcaaattaaaatgggcttgtgaaattaaaaaatctttcatgtctgactttcacgatctttcacaggacccctctttgcttaatctttgaggatttttggaagatggtattgttggttgagaaagcttattggaagatgcttcaggtcattggtgtagttcttcctgcttgtagttactcattatactataagtacaggcagggacatcttgtggttgaattcatgtggttttaccatcatctgaagcaagattgtgtagtgccaagaacttgggctttggagtcagatcccagatccacctgtatgtaacctgcagaacagctttagacataacaggtgctcacaaaacagtagcttagaaggagactgcagggtctgcttgggagaagcgcggcatgagcaaagtcaggcagtctcacagcagcatgaggtggctgcgggtgtaaagctgggtgctactggagcagaatatactggcaggtgaaggtgatgatgaggccaaccccatagcacctcctcacaccccaccagggcgtaggggctttctcccactggggccaacgggccatgagtggttttgagcattaatataacaagctttgatcattgttttcaatagggcattctgaaaacaatggcatggagtagagtggctttgaaggggacaggacttgggcacaggaggtctgaaagcagagacgacaagggcttgccttgtagggaagtcagggacagactggtgagatatttagggtgcccagcttgagaggtgtgatggctggggacagaaagagaagccagttaggtgatgaggtttcagatttggccacattggtctgtaggaccactaggtggagctcttcaataggtacttggatggatggtaaatcctgaagatttggccgcaggtggcagccaggacctcaaatatgtatgtgcaagtagaattagaagaacagtaggccaaaaacagagtgccaggtggcccagggggggacctagggagcctgaggtcataggagctaagaaagtaagtttggggtaggaggtagggcccaacagggaggtgcagggagctgggccctggtgaacacagtcccctggcttgatcactgaggaggccacagtgactcttttctgtagacagatggaggtcaaggtcaaggagtccagtggtgaatggaagacagggaagcaaattaccctcagaaagtaattcttggatttaagtctttcccaccttccataaacactttgtgcaattactctagatgaggcactgaaaaatgcttcatacctaataattaatcaaactagtgttccagagatggggctttcaccctaccagggagacagactgaagacaaatacatctgtggccaggcttaatgcctcacacctgtaatccatcccagcactttgggaggcagaggtgggcggatcgcttgagcccaggagtttgagaccagcctgggcaacttggcaaaacaccatctctaccaaaaatgcaaaaattagctagtttcataacctggtctaaaaataaataaagagataaaaattaaaaaataacaagatttttaaaaaagacaaaaaagacaaatacatttatgctgctaaattatggcaaatgttgtgcagggaagagatcagggtgctgcaagaagagctaatttagagtgggagctctgcaaggctctctgggttgcagagaccttagtaaagactaaaagttagctaaagaaagatcttccctagtagagaagcagcatgctcagaggcctgcataggataggaaggacctgaaaggcagtctgcgcagctggaggaggtgggtgaggtcagggagctctggggccttgtagccttgctttgggattgggctttgctccctaatgcagtggaaacccgttaggagttgtctgttggttggccgggcacggtggctcacgcctatgatctcagcactttgggaggctgaggtgggcggatcatgaggtcaggagttcaagcgcagcctggccagcatggtgaaacccggtctgtactaaagatacaaaaggttggcggggcatggtgatgcgcgcctataatcccagcaactcaggaggctgaggcaggagaatcgcttgaacccgagaggcaggggttgcagtgagctgagattgcaccattgcactccagcctgggcgacagggtgagattccgtctcaaaaaaaaaaaaaagagttatcagttggcaagggagtgatagggatcatggtactttaaaaagtttgtttttcttcctggctgctgtgtggagaatggattggaggaaagccatggtgtgaatggaggggccagatatgaggcagtcatggttgtctggaggagatatggtagtggctgggcccaggcggctggcaggcgagggagcgaggagtagatggatttggtaggtcacatggagaacacacccacaggcctgtgctgttgaggttacaggtttcttatttgagccactgggtagatggaggcggtgctgttcacggagatggaggaaatatatttattttctcctttaaagtagagtatttgggtcaaagaaagaaaaatagcatttgttgaacatttttggaaaaatctcttttttttaattggccgatgtagtacatttgcctttttagcacactgatacttcttactatttcttttcctttttattttttgttgagccagggtcttactccgttgcccaggctggagtacggtggcgccatctcggctcactgcagcctccgcctctcgggttcaagtgattctcctgccccagcctcctgagtagctgggattacaggctaatttttatattttttagtagagatgtggttttgccgtgttggctaggctggtctcgaactcctgacctcaagtgacccacccgcctcggcttcccaaagtgctgggattacaggctgagccatggtgcctagtcttcctttaaagtaaaataaaaaaattactcaatttattgtaaaaacaaactctttggcttctgtccaaatgactgtgaaaatagatttctctcaatatccaccaatattacctgtttctgtccatatatgtatttaaaccctgttgaaagaatttattgatacaaatcaatttttaagggcttcagtataacggaacctttttctaccacccttttggtttatttttccaaactaagccagtatagatttgaggtttagggaaaataggcacttctttttaataagaatgtgggctaaaacagatcttatggttcaaatatttacaacttaaggaggcaaagagatttgataggaaatagacaaggtgatgtgtcctctgacaggtacacaaatcaagagaatatgacaggtccttgggaatgattgtgtcagtgttcgcttcccatccttttattctgaaagttcacagtaggggaatgtgagaaccaaaatgcatatgctaggtcagggactgggacactttctctgtggagagccagagaataactattttaggctgcgtgagccatacggtctctaggacaacagctgagatagacatttgtaaatgaatgggcagagcgcaacacaactacatttttggacaccacagtttgcatttcatgtaatttttacatgtgaaatattatctttcttttgatttttttttttaactttaaccacttaagagtgtaaaattctttttctcggcttgcagttcatacacaaacgggaggggggtccttgggtggtagtttgctgacccatgctggagatagtgagctcatatggctgggcagtcccttcactctgaagaaatggctgtgtttttcataattcctagatttcacatacacaatcttccaccatttccttgtgttttccactgtttttttatttgaggcggagtggtggttccaacatttaatgtacccctaattgtcagaatccaacattcttgattatctttatgtcagaagtaactaatttttatctaaaatgattcttgaagattctttaaaatgaacagttgaaaagacaactgtgacccccagctaggatgtactattacactttaatacaccagctgcttcagaaatgaagaccagcactccaaggatgatggtcgttgtaggggggcctctcgtgtgttattcgagggatgccttgcaacaccttactccttatttagaatctcaaatctgaatcattaccttaatagggcttttcagttataagttacattgtggctcctacctcccaaggagttcaattttagctttgcattttttaacttaattaccttttctgttccaatctcccagtttgctttcatccatgtattatatataatcacaagcaaggaagacgtctttgataatcctgacttatttgatggcctggtaatgccacagtttcttaggcagcttagagctcttgcttttaagggctagcccacattctcagtccaaggccgctctgctgtcaacgatccaattacctgaaacgtttttattatctgcagattttcttaaaattgcctctgcagtgggggattgccagatgtcacccggaacacacaaacagccccactacgggcccctgttctgtagaaagatgcccagtcttgcttctgaaggttgctttttaaaaccagaatgaaggttgctttttaaaaccagaatcatctggattgcattctgtctcttcattaagattagactattctcaggaacaagggctgggagagggctgcatcttttttggtcgataagagcctttcctgttataattgagtcctcgtgctggaatgaatggtcttctctttgcaggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgcgatgcattgttttaaatttaaaatgttttgagaaaaagcagtgatttttagaagggttattaggtcgaatggggttagagaaggagcattccagtttccaacttcttgtttttaagtctttacaatcctgcaccagtagaggagagtcagataggcatccagctaaaaaataatgccatctgcctctcttttttccagtcttgatgtttattagtatcaggctgccagtcactcctctaccttcaggcttctggctgctgtagaatgtcgatgagtccaagaggacaccaaaaatgaactctactaatggccgctcaaaaatggccatagtgcgtggcttctgggaccccaggccaaaatggagcttcccatttcctgctttgccttgacttcaagatggctaggcagggaccacgcgacttatccattcaagcaggccgagaacggggagacggtctggcctgtggtctcatcaccatggtgaaggcccaagccacagctggcccaagcaagcaagagacaggacagagcagaggtcagcccaccatgcctttcagtgcagtggccctgcccttggggagagactgtttccgtgggctgtcacccatcaaatcagcagctgcccttcctccctgtggaagagcaaataacacaaagggagagggccgagaaggttccctgttagactctgctgtcctctagggcaaagtggggtccctccctctgtgggaaacagggtaggagattgcgttctccctgcttccacagaacagcgtggtgtgtgggttgacagctgactttattagatggtagctggcttcttgcgaagatgtccacattgacaagtctttggaagccctttcggaagcatgatggacttctccaaggaagggcagtgtcgtctttactagggatgaaagagttgaccgctgctaccttcacctgttcctcttcttagcccatgaaaggcacgcacaacaataggaggaagaaaatgacttaattccaccaaagtgtcatccacatagtgttgacaggttcagagcttatgctacaagtgatccgaagccgggaaaagtgactgggatgtagtatggtttctagtatgtaagtgaggcgtgtccgcgttgcgggcctgtggggaattaggccagatagacttttgttcatacacatcggtctgttgaggctaatttttcatctgggtagaaccgtgcttacttcacacaagttattcgtggatttgttgtgattgtaaaatcagcctggaaacgaacctttggccttcaaaatctctttagccttggtcccagatgaatgttctagcgccctgtaggtcagggggaagatctccccgaatgcagcctctaacgttccatccacgtttccgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttgggtaagatatcactggaaagtaagaacacatagtttcaaagaagtcagccggtaggagtgggatttgggaaactttttgttttgcctttgttgtttgctactgatcacctgcgtgcgagggaggcttcttggagtcaggtgggtacatgttaacttgaaagaagcgctccgtctgcctccggccactgcctcttaggagctcagcagtagcaagaagctattacatagggttaggattcgaacctgtgctgaagccttataaggggtcacatggagccctcccttcttttccctgcagacacctgtggtgacttgctggtgactctacagtccctgagccgccagggtgagaagcggagcctccagctctccggcaaggtcaacgccatgactttcacctttgacaacgtgctccctggaaaatacaaaagtaagaattggaatgcaacatcctgtggccctcacacacttcttgtctttgtaaactttctaaaactcaggtctcaaattgtatcacgaccatgtacctttccttgttttaagtcgtctttgcctcgtgaccttgactgcattatttagcgttggacaagcatggaggagtccaggccctgagctgaccgccaccttgtctgcacagcccactggcggcttctgttaagggagggtgccccgacgtatggcattttatttctaaagcccagagaaaggagtgtgaaatagttccactgatgtgttctactaacttagcagtactggtgctgagtactggccatggcaaggtacttgacctccctgaaactcagttttcccatctgtaaaatagacataatagaacctttctgcagaatataagactaaaagaagtaaagtttataaagcccgttgtgcagagagccagctaagtagctggtgcccacaaatgttacttcccttttccttgcccttcttaagaagccacttcttgcctgtatttctgctttttcagaaatcagcttggggctgctggcagtggatagctcataaaacagactgctttttctggaattatattaatattttctgttatggcagggcttggcagactacaaaaactgccttttataagcgtagtttccttagaatacagccttgcccatttgtttatggattctctatggctgctcgtgtgtaacagtggccaagtcgagtggttgaggctgacaaagcatgtggcctgcaaaactgaaaagagttacagaaaaagtttgtggatccctgaataccttacttgcagcctgatcttacaggccccattagatttctttcttgatgtaatggaaattggttccagtttttctttctttttttttgaaatttagcctcgctctgtcacccaggccggagtgtggtggcgcgaccttggctcactgcaacctctccgccttctgggtgcaggagattctcttgcctcagcttcccgagtagctgggattacaggcatgcaccaccatgcctggataacttttgtatttttagtagagatggggttttgctatgttggtcagactggtcttgaactcctggcttcaagccatccactgccgtcggcctcccagagtgctgggattataggcatgagccaccacgctcgactccaggttttctttagcagtaatttattccaaatactgctagttataaatatatgtatgtgtatatttctatctttatgtctacatacacacctgctttttaaaattagttaattcatgatcattgtttctggtggcgtgcagggaggtggtgtgctccacgcccatgtatccgtttttggtgtttgcttttgcagtaagcatcatgcatgaggattggtgctggaagaacaagagcctggaggtggaagtgctggaggatgacgtgtctgcagttgagttcaggcagacgggctacatgctgagatgttccctgtctcacgccatcactctggtatgtacggcttatggagtctcttatttggaaaagcgcttgccttgtggatgtcaagaaagactaacatcccaggaatattgtaaacgtaggcaagtcagatttccttttctgcctctgcactcacccacctgttacgcaacgcataatcaggaagcatttatactctctcagtggaaggacccctgtatttaggaggtttccttgtcctggccctacactaaatctgactggtgattcggggtgacctttggtacagtgtagagcacactggctttatattattagtaataatagctttgggtaaattcatttactgcttctcagcctcagttttcaccgaaaattgagatcttaatacctacttctcagggttatggcagggcttaagtgaaccctcttaggtatcaaagtgtccttggtgtacaccgctctgtactgccaagtgagtttctctgatatatatatatatatatatatatatatatatattttttttttttttttttttttttttttgagatggagtcttgctctgttgcccaggctggagtgcagtggtgcaatctcggctcactgaaacctccgcctcccgagttcaagcgattctcctgcttcagccccccgagtagctgggactagaggtgcgtgccgccatgcccagctaatttttttcttttttttttgtatttttgttagagacagagttccaccatgttggccagactggtcttaaaactcctgacctcaggggatccacccgcgttggcctcgcagagtgctaggattacaggcgtgagccattgtgccccaccttctctggtgtatttgttccagtgcaggggaagaagctgtaaacaggatcttagcttcttgttgactgtggtctctgtggcctgaaaggcagtgtgaaatgggtttcaggagcacctctgtagatcccttcgtgaattttctataatgttttgatgtcgagcggcggcagatgtcatcgtcaggtcttagtttctctgtagagaaactagaagaattggaactggtgtttcatgtgccaacttactcccctaactgcttaattacaaaaactccacaggtcgatttgttataggagatcgattaatatccggttcataataagtgatagatatttaggaaacctttcccttccagcagtggagtggatttccagctctcttgtaataagatccttttttttttttttttttgacacttccttaaccccttctttatctcctcccactgtcccctcactcgccgggccccagccacagtggtcctctgcagtcccacaccaagctcactccctcctcggggcctttgcacatactctcccctctgcctggagtgctgtgacttctccagaaacacgtgttgttggtttttcctcctcattcaggtgcagccctattgttcaggagagatgtgccctgggaccagcgagctaaagacccctcggtggggattgttcttctcttgctttcctgtttattttcacagcttcgttactgaccagttgagatcactaatttatttgttgttgcgttgattttgtcttcctgtattagaacataagccctgtgagagcaggagccatggtcatgactcccaaggcccagccttgtgtctgtcacatagcaggtgctcaataaatattagttgattgaatgaaaaatagcacacttttgttggaagttttgggaggtttttaattttcctgtggcacccaactgctccaatgattaatgggcaaaacagatgactggtttggaaagagaaatattattaatcatcttggtgtctccatctctcttagtaagtcattgtattggctttgctcccttaggaattttatcaggatggaaatgggcgtgagaatgtggggatttataacctctccaaaggagtcaaccgattctgcctgtccaagcctggtaagtttggaaggattgatgtgccatgaattagaaaaatggaaaggcaccagaggatggttttgaaggcatttttttctaccttggttctgtttgcatcaagctttcaatttctgtgtgttcaacctgctcttgtttttctgtctgtcttgggtttgagttgggtagacaccactgggccctttcacctccaaaaatataccattggccaatggcctctctttatagagctgttttaaaatttgaatcatttcccactttgcttaaaatctttcagtggcttctcgctctttctcattttttttttctctttctttttttgagatggagtcttgctctgtcacccaggctggagtgtagtggctcgatcttggctcactgcagcctccgcctcctgggttcaggcgattcccctgcctcagcctctcgagtagctgggattacaggtgcccaccaccacatccggctaatttttgtatttttagtagggatgggtttcaccacattgtccaggctggtctcaaactcctgacctaaagtgatccgcccgcctcagcctcccaaagtgctgggattacaggtgtgagctgctgcacccaaccctctctctcttttataatggctttttttggaggcagaatttgcatatcataaaactcacctatttaagatgtacaataaaatgatttgtagtaaatttatcaagttgcacaaccatggccagaatccagttttagatttgttcatcacccacaatgtaagatcctctgtgcccgttgacagttaatccctgtttctagccatggccagccactgatctattttctgtccccatggattggctttttttggacgtttatcatacgatgctggtattttgtttggcttcttttatttaacatgtttttgaagtttatctgtgtcatggcacatatcagtagtttgttctgttacattgctgtgtagtattctggtgtgtggttatatcatattttgtgtatccatttatcagttggtggatatttgagtggtttccagtttgacgctgttatgactaatgttacggacattcttatacaagtctttgtgtccgtatgttttcgtttttcttgtttcgatacctaggaatggaattgctgcattgtgtgataagtttatgtttaaccttttaagaaactgtcaaattgttttccacagaggctgtgtcatttgatattcccaccagcaatgcacgagggttccggtttcttcacctccttcgccaacatttgttattgtctgttttattatagtcatcttggtagatgtgaagtcgtgtctcattgtggttttgttttgcattttcctaatgaataattcagtggctcctccgtttggttcccaagataaaatacaaactccttaacctgatcttagctcctgtgtaacccagccctgtctgccactgtctctactccagccactctgtccttctgggtgtcagttcagctgcctttggctacatgtaacaaaatccatacagcagtgccattggcaagtggtagtttatttggctcaataaagaagtgtggcagtgcgtggctgccagcatgggttcagcagctggtagatgttaggggtggtgtctttgtgattctttaggcctttcccttctattttttgccttgtattttcaagatggctgtggttagaaaacttatgtttaaaggaggaagtcaaggagagggcaggcaaacatttccttgcgccccctcctccagtaagctacttgtctgtattattggccagaaccgtgccacatggttacttctagctgcaagggaggctgggacagttggatgtgctacccgaggctgagcacgttgccaccctcaacataaccagggtttgttctcaaggcaggaaggatgcctgttgaggaaacaatgagccagcctgtgaggcagatgctgttctctgtggacatctcctcctgcccctcctagctggggccttcttacccatcagttcagtattgcttcctggggaaggatggcctccagggccacttaggcctgcctcctacactcttgctctcagcactcacttctatccccttcttgcatgtgccacaattgatatgtttgtggctgtcaaatgctccccctctctgtggatggtaaactccatgaagacagggaccactgctctgtcattccccactgtgtaccagtacctagcataatacctggccaggaagagatgctctgtcgatatttgttgaatgaaagaccaaacaaaacaaacagagaaacctgatttttttttttttttttttttgatggtaactactctggggcttgttgagtgcaatgaaaacagcagggtggttttagctaatttcaggtttttgtaggaagtgtggccaaaatactggttaatgatgatttgggggaaatacattgttattccttgtatcttcctgaaattgactgtgttcctctggcaagtgatgaaatgtacccctactcggagtgtcctcccacacagactcacacttttctggggcttcccttactccttacctcctttttaggaatatttataggaagaaattgaggctgtggttatctcttggatccttaatagaatcttttaagtaggaaattatcctcagtccaatttgcagtagaaacgtactttctgttccttctcgtgcatgggtccgttcacctggtctgtgcagatttaactactgtgagttgttaccttatggaaaatgaaaatcatgcgcctgtgatcgggccattgcatggatcgggtcattggtaagacgccttcataggcagtgaaaacgatgcctgcccagtatttctgatcccattattgcagatctgcgatacatttgagttttcacatgcaaagagctgccactcgatttcagatgtcggaattgctcagtgtaatagatgccattctctgaaaattacttttgatttcctgtctgtaggtgtgtacaaagtgacccctcgctcctgccaccggtttgagcaagcgttctacacctatgacacgtaagcctgggaattgaatgctttgtggtgtttgtatacattccgtggaggattcttcatttacttcagagaacaaaaggagtttttctgttttttttctgaaagaggcaaggttaggccttcaacagcatttctagataaggattttaagacacttggattagttactgaggaaccggagacaggatccctttcccaagaattctgtaaccccaggatagagggctgtgtttttgaagtgccttaaatagaagctttgtcaaatctcccagccctcaccgatgggcatctgtcaagttcaagtctgccatttttgtatttttacagacgtgtgtgggtttcactgggaattggaagcataaagttgtggagtggagaattagtttactctttaaaatacttctctggatctccagagttattttaccccagactaaaagcaattttctgtagtatatttagggtgaagaaggatgcccaaaaagggtattgctgatgatcttctgagaatgagtaggttctagcgtttcctctgctttgatttgtaggtcttcacctagtatcttgacattgacagccattcgccaccatgtccttggaactatcaccaccgacaaaatgatggatgtcactgtgactatcaagtaagatgagcgttctgcagtgggccgagagtggcgggagagggtgtggatgaggcctggggagtctctaataggctctctggaaattagttttgatttcttatctctagatgtatatacaaatggccttccctctcttataggacattgccgtcaattcccagcagccttgatcctttccatttctgattcagaaattacctgtgggtgaggaagagcgttgcgacagcttgtttcagtgtcttcaatttctgtttgaactctttgtacttctcatctttgctaaggaaaaaaaaaatctctggggtttgtgcattgtatttcaagtgttttagcaaattcaaattgcctatttttctttagacttttgcttgaaggcttgggaaatagagatggcacctggtataagagaagggtcgtgagagaggaagtatttgaaaggcaagtccctcaccgaaggtcacgttcatgtgaatgtcacctttcagggaatttttgcagtgtggtgaggtacctgtgacgccccaattttcttgagaaatgaaagagttttggcaacatgaccgtctctgtcaagtagaatgggcattgcagtccctgtctccctcctgcccctggttgaagtcacctttccagctatgtttccatctttctgtccaccatctgtttatccatccgtcatccctgcagagtacatgatgactgaaaaactgagagtcttcagtgtttaggcactgggcttatgaggccacagcccctacacttatgggattgacagtctcatggggggaacagtggtcagatactcacatgcagaaccgtaaaatgacaactgttctgagtgctttgagcttgaccttgggggcatgcaggacaggtaggctgcggggggccaggccatgttaaggtccatagtctttgtcccatgatgcaattgacatgttttacatagaggaatgacatttttcttcctgaaggtccccctattggccgagtggagaacagacagaagaggcctgagagtgggaggtggtggaggcagggggaggcaatgggggccccagactagtggctgcggagatggagagcgacggactggtcggagagtcgttgagggactgagttgatgagacatggcactaaagtgaccactgggttagggcgggagaaatgtcagggctggccctggtttctggtgatggggagccaggtttttagctgggggtggatttgccgaaggtctgttgctgtcttttactatcatttactgtctccctgcttggaaagtatgaattactgataggactagcaatctaccttcttaccagtagtaactgcatgttacctcctttcagcttgattacattcatttttgtaacttcacaagggtgtttgtgttgcttgcttgtgccggaggttgtatggaatgcatcttccagctagacagagccactcggattcccctgggaatcgtgtactcagcagacccaaaacccgactgctgacagttgccctccatgagcccctctgtggtcttttctgattcagatatggcagctcccgctttctccttgtttcttgattcttatttcccttgaaccctaggcccagccaattccccaacaaagccttggctttacaatcaaaatacacccatcatctagtccctttttaccacttggccctcagccttggtctgacccccctctggggtcactgtagcagcttcccagctggccttcccttcttaccacgtggccctcagccctggtctgaccccctccgggatcactgcagcagcttcccagctgggctttgcttcttaccacgtggccctcagccctagtctgaccccctctgggatcattgcagcagcttcccagctggccttcccttctcaccacgtggccctcagccctggtctgacccccctctgggatcactgcagcagcttctcagctggccttcctgtttccgccattgctttgtgtattttccatgaaggagcaaacgatttcttttatcataccattcctcgactgaaaactccagtggctccaggtcggcaccaagcctgtgaagcctcagtctgacatctgctgccccttggacctctctgttggatatgactcttccgtgggcccctgtgccccaggctggactggtgttgccattgcttgaacatctgagtgagctttctctccaaggactttgcacttggcatcgctttgcccaagctactgtttacccagagagctgcgtggcgcattctctcccttccttcagacctttgctcaatgtcaccttatcagaaaggccttgactgtccctttaatgtaaaacagtgctccgggctctccgtcttcccacactgctttatttttctttattgcacttttcctctggtattatttttctctttattttcagccccttcccactgaaacgtggattccacaggggtaggaagtgtggtctgttttgttgatgctgtatccttggtgcctagttctctatcagagcagttctcagcgaaggtagaatggagaacagaggatggtggtgtggagaaaactccgtgtcctacatggaagctacaagcttatatccagtcgccataaaatcaaccgtatttcattccagcccagatctaccagatactgccaccatcactgcgaagctcagttgttattttttgtgaaactactagtttatttaaaacagaagactccgccactgtggtgtcatgataagatgtccagtttgtaactcgcaagtccatactcgtagaaaggtcaaattcccactgaccacaaggatacgcaaccacgtcctaggggccgccatttctttcttctaggtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtaagctctcttgtgcgtttccctacagtgtcctctgttttgtggggataggacccgccaaactgaagtatattaattattttaggtctggagagaaaatcactgttacaccgtcatctaaagagctgctcttttatcccccttcaatggaagccgttgtcagtggaggtaaatgtcaactcagcgagcgaatgtcacacacacctttgcagttgttcccttgcctgcatttacaagtagatttgtgatgttatagtgaagccatctttgtaagccaccttacatcctctctggcacacagatgttactgttggttggatggatggatggatggatggatggatggttgggttggatggatggatggatggatggatggatggatggatggatgaatgaatgatttagataaataaaagtaacttttgctgttagaattgagttgatctttttggaaaaggacttggttttctttgacattatcaggtcgacaccagaaggtagatgaagcacaaagctgccagtgatgatctttaatgatctttctgttgtttggcagagcatgatgggagggtctttttttggggaatggatgactgaagtgatcacttgtggagtatttgtcttttgccacttattatttttttcccagcactctggcttcgttaagttgtgggtgttatgtggttcgcgtttggaagcagagggtgttgaagagcgtgacttctagcaggcaggctgtttggggcggtctttctcagtgggtcctccagaggctgagcagcacggcctcctgtctgctgtaaagtgttccctcctgatctgtggcctcctgagaacctaggaagagtagtagtaaaaacccagccttcagcgttttttgattctcttgctaaagtccttcacactgagaaaggcctttcagggatggaaagaggcttgggctgtatccgattattgagctccccggggtgttaaataaccgcatttggaactagcttctaagatctgttttagccacttttgtcatgggaaacccccaaccaagaagctcctgtctctgctaccaagccccatccttgtgtttatttcttcccctcttagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacaggtgagcccgggatagagacacatttgcctgggatcagcgtgggagtcctctgaagaaactggggcccacatttccttgggcttggtaaggcttcctgcagggtgtgaacaaagccgttgctagcattctgctctctcctcttcagtgttggccccctgcacagtgacctggagtacacggtgacctcacagaaggagggctatgttctgactgcagtggaaggaaccatcggagacttcaaggcctatgccctggcaggcgtaagctttgaggtaactaacactgtattttcaaaaggcagttatactgaggtataattaacatataataaactgcacaaaaagggtacagtgtggtagtcttgacctaggaatacacccatgaaaacacctccacaattaaaatagcacatctgtggccctcaaggtttcctcctgccccttggtaatccctccctgccacccttccgctgagctgatgatctgcttttcatcaccattggttagtttgcattttcgagtttttataggttggtgcaaaagtgattgtggtttttgccattgagaataatggcagaaaccgcaatcacttttgcaccaacctgtatataaatggaatcaaacaggatatactgttgttttttttttttttttggtctgacttctttcacgtagcataatttggagagctgttgactttagcatgtttgtgtaccttctgggaagtagttaaagctgtcatccataactgttccattttgaaggacacagaatgttcttactgaggcgtttgctgcctagctcccttccaccggtcctttctgggaagaagcgtgctgcgattgtacagagtgggtctggagatcgttgagaatgaatatttataaactataggccaaaggaaaagagtgacagattacatcgcataaaaatttaaaattctatattgctgaatacatttggaaccaaactgaaagatattcaaactcggaagaaatgtttgtatcataaataatatccccattttacaaggagctcctaaaattggtaagaaaaagacaacccactagaaaaaaaatgaacaaagattatgaaaaggaaattcatggaagtaacgcaggtgactaataaacacagaaacacaaagcctctgtagttactgaggaaatgtgctaaggaagttacagtcgaaacactgttttgcagggattagatttgctgtaattaagacaatctctattttttggtaagtgtgggttttcccaagcataaataatttatgggactgtaagtggttacagccactttggaatgcaattagatagtatctttctgaatttaaagtgcatgtatccaacaattctacttctaggaatggattgttcaggaaataaaactaagtgcctagagatacatatttggggatattccaattgtctcttgtgtaccacaagagtaggtgctgtggtttgtcaaaccctgccttagaatgctatgcagtagttaagaaacaggcagatttctattggctggcagaagagaaccaggataaattgttgaggaagagagcaagttgcagaactgtacatataacatgccatttttatttcacctcctccacccactcaatgaacttgccagtctgtgaacaataatatgtaatgtttataaaatttgtgtgggcatagaaagagttctgggcggggcacggtggctcatgcctctaatcccagcactttgggaggcccaggcatgtggattgcttgagcccagtagtttgagatcagcctgggcaacgtggcaagacccgtctctataaaaaatacagaaatgtagttgggcatggtggtgtgcgcctatagtcccatctcctcaggaggttaaagctgaaggattgcttgagcttgggaggcgaaggttgtagtgagcccaggttgtgccactgcactccagcctgggtgacagagcaagaccctgtctcaaaaaaaaaaaaaaaaaaagttctagaaggctacacaccaaacttacaaaacttacaacagtagttacctgtggggaggaagattaggtcccctgtcctcctttgagtaacaataaaagaaaaaaaccttgaaaaaatgacctcttgacttgtggaactgttattttcatagttagtaggagtttaaccttgctctggtctcaccttctcatccccagataaaagctgaggatgaccagcccctcccgggagtcctcttatccctgagtggtggcctgtttcgttccaacctcttgacccaggacaacggcattctgacattctcaaacctggtaacgtgttctgcaatttaccacctgcctgtcttccctgagagagagccaggatgcagcatgcgagacttatgtgttgcttgacaacgtgagaagagaaggccaatgtggagtggtttcagtttcttgggggcccacggtcattagagtattgctcttactcgaacttaatgctgctgattcatgttcccttccacacgcgcttcttgttttctgatcacccgcttgtcactaagacagtgtaattaatttccctggccacaacggctgctctcttaggcgtcttctcgttttgccacagaatcatgtttatgatgctgagtcttgtttggtggttagcttgcgtttcttctgaaaagacattccacttggtgggaagagagcagcagtttttctttcaagatgcagtcggaggccctgactggtggggattcaggaagtgtgtgttagttggtcatcttgtcagtcatggtgacaaagtggctgtggtggggctactggagaccgggcagtgggggcatctgaagacaccactttgcagtgatgcagactgctccttacttgctgtgtcctatcaggcaagttactttgcctctctgagcctcagtttctttattcattaaattcaaatatgagccaggtatggtggcccacgcctgtaatcccaccgctttgggagggtgaggcagtaggatcgcttgagcttgggagtttgagaccagcaacataggaagaccccatctctacaaaaaataaaaaaattagctgggcatggtggtgcatgcctgtggtcccaggtactcaggaggccgaggtgggagatttgcttgagcccagaaggttgagactacggtgtgctgtgatcgtgcactccatcctgggggacagagtcaggccctgtctcagaaaaaaaaaaaaaaaagaaaagaaaaattaaatatgacttctacctctctgagtcattgcaggcaggtgataccatcagctgccgttgttagagttgtgattgccactacctgactgtgagtggtgattatagagagagggttactatttttggctgccagggaagccatggcgctcccctggtgtaattctggtccatcgtgacattcgcccctcacttttaagccatgcctagatgtggctgctgaggctcagtgtgattatcttggcagagccctggccagtattacttcaaacccatgatgaaggagttccggtttgagccatcctcacagatgatcgaggtgcaggaaggccagaacctgaagatcaccatcacggggtaccgaaccgcttacaggtaagtgccctggccaccccactctcttccagggctgggctggtgaatcacattcaggcctctgttgcctggaaacgcatcccaggcttcacactgattttacttgggagggaagggagatgagatatgagggcaaaggagttttgactgctgcccttctctcctaggagctcaacctggtggttcagtctcaaatttcctattttggaattggcttgagagagcctattgagttgctaaaagcttttatttattttttattttttgagacggagtttcattcttcttgcccaggctggagtacaatggcgcagccttggctcactgcaacctctgcctcccgggttccagcaattctcttgtcctggcctcccaagtagctgggactgccaccatgcatggctaatttttctatttttagtagagacaagatttcactttgttggccaggttggtctcggactcctgatctcagatgatctgcctgcctcggtctcccaaagtgttgggattacaggcgtgagccactgcgcctggccacttttattttttaaaagagtttcaaacctgaattacatcattaaaaggagaaaatgtgctcagttgaataaaacttcaaaatgctgaaaagagtatagtgtaaaatttcccctctgtctcgtctcctagccacccaagttcctcttctgggagacaaccagtacttccagtttttctgaatgctcccagctgtagatagatagatacacatgagtgtctggcaaggcacagtggctcacacctataatcccagcacttttggaggctgaagtgggaagttctcttgagtctggaagttcaagaccagcctaggcaacatagcaagaccccgtctctacaaaaaaataaaaatacaaaataaaaaagatacacatctatagatagagagatgcatacatatatacatgtatacacacagatacacacatatgtgtattttttgtagacttatacagaatcactttagaggaagagtaattggaaagattgggtttagaaaaatggaccattttctactgaatatatggaatgaaagaggaagtgagttatttccatgttattgaaagctccattatttcaaataaagcctagaaagaataaaataaagctttagccttcttaaattacaattttccagagcatccctcaaaatgtatgagaaaagaaattgatggcagcttatccctccggcaggaaggtgtggtttgaaagtgggccggccacaccgagttgcctgggtcattgaggcacagttctcccctgaactattttgccccataattgttggtaaacgggaaacacttgggtccttcagataaccatgagaatatctcattcgtgcctgttcttgccatactagttgctatggcacagtgtcttccttaaacggagagcccgaacaaggggttgccatggaagcggtgggccagaacgactgcagcatttacggagaagacaccgtgacagacgaagagggcaagttcagattacgtggattgctggtgagacttggaatgtgttttctttggggacttttttttcatcctgtgtccagaagtatcttgtggtggccccaagactgctaggagtgggttgggcgagagggctgggggtggggctctggagccctcccagttcttacctttaattggtagagtttgccttttttctagccaacaggtcagatcaaggatctgtggcacaatggagttggaaaaccatgggtttggtagggcttttccctagcagtatgtggccatggcttacgccagggctcaagccaaacgcctatggagccagaagagcagtatgaacgggggagaggaggctgtgcgaaatgatagggagtggtgagggctgtggagtgggcacggcctgtggaaagggacagcctgtcacttggttccagcttattgtagccatgggggaagacagagtcagggttgccagatccttgaaattttaaaaagagaagtcagaaattcccacttcccagaaataatacccaacacaagcatttgggaatgcttatggtggacattccagatatccatcaatgtgtatatacgggtagaggggaggggtggatggagaggaaaaacatcttagaagagtaagagcacatagtatgcttggaattttgaaataagaaaccaaatttgatttattttggggtaggagaaaatgaaactgagttgggatggaaggagtcgcaaaatttcagatgtttcaacactaggggtgttcttaaaggaactctggactcttaaggttaacaggccacagattaggaaatgaggggagagaaatgctcctgtcttaatgatctcgtgcagccaaaccaggcttggaccaggcacgatacgacaagccccctttctagagaactgactcctgagtttttttgcagccgggatgtgtgtaccacgttcagctcaaggcagaaggcaacgaccacattgagcgggcgctcccccaccatagggtgattgaggtaaggcattcagtgctgccgctgcacctgggtgtgggtgcctccctaatcagaagtcctcccgtctcctctggctgtctgcctttcatctgtggcggggggaactttcatcctaattaagggtcctcttagaatagtgtcatcttcacaagcagaatcttatgtgggtttttagtgaacagcgttgctgtcatgcatccagaaaggaaattggaactgttgtatcctccccgcgacttgccctgtaagctctgatcattattctgcaagttaaggaacttaaggcctaagcagcatttcaaatcaagggacaataatagcacatgggcttaatgggtggcagggccacgcagttatcttaggttcagatgacctttttcctgctcccattttgtgggcagagtcttttgatactcaagatcatgacctagctaaattaatccctaaagaggacatccttcgagtcacagaatgtggcctgggaatcatttgaagtaaggcttttctcttactgagtaactctcattgggaagactagagggcttaggtagggcaagaggggctgcctcttagtggctttatttaggtggcttcattatgcatgaagattgtgagggaggatagaacttttgacctaggaagtggattttcttttttttttcttttttttttttttgagatggagtctcaccctgtcacgcaggatggagtgcagtgccgtgatctcggctcactgcaacctcctccttgtgggttcaagtgattttcccacctcagcctgtagctgggactacaggcatacaccatcacacccgactaatttttgtatttttagtagagacggggtttcaccatgttggccagattggtcttgaactcctgacctcaggtgatctgctcgcttcggcctcccaaagtgctgggattacaggcatgagccaccgcaccgggccggaagtggatttccttgacgtctttacggtgttggcattttaaatggctgggatgactgcatctcacaccaaaatgctttgcatgttctcggtgtagtaacttaggccaggatcactagcataatgtggactgtggccgggcaggtatgaaagggaagggggccggccctctgggatctcgcaaactccatgtacagacctcacgcagagggggtgctgtgactctgcccctgctctaacaggcaagagcatccttctcctctttttttttaagagaagctggaaaatctggcttcatatatgaaatttcttaatttttaacatgttggcaagtaattcaaacgtagaaaaaaaatactgtgctttcgaaatgaaatgtgtctatgggccagggatatgcccctgctctaacaggcaagagcatccttctcctttttttttaagagaagctggaaaatctggcttcatatatgaaatttcctaatttttaacatgttggcaagtaattcaaacgtagaaaaaaaatactgtgctttcgaaatgaaatgtgtctatgggccagggatagccatcttctgtcggtttgtgaccttggacgtagggtactcaatgacaaacttagcttccttaatgtaagaagcaaagtttgccatgaagcagctctcaggccatcggacagctggcatagaagttcctccaccagctttctcattactggcattccctctttctctctctaggttgggaataatgacatcgatgatgtaaacatcatagttttccggcagattaatcaatttgatttaagtggaaatgtgatcacttcctctgaataccttcctacgttatgggtaagtccagacttttaagctccaagtattgtgttccctttggctttgagacaagtacgaatgggatgtttttggttttgtgcctgtctcgtgccttaggtgtgacaggtggaggtgctccagagtgccgcctgctgagggttgaggttgagatttaagaaccttggaccacaacacgtatttgggagagtgattgccagttgtgggagagaatgtggtccagtttcagataactgtctgccatcagttaatcttccaaagaattatagtagaagcctgatcaatgatcaatacaatatggaatctaacgtggaaagccaattctaaagaaagcgccttgtaacttaaaattttctctggagtggaggtcgtattaaacgttcttgcattggtttaaagaaatgcctgaggctagataatttataacaaaagaggtttcattggctcctcgttctgtaggttgtacaggaagcatagtggcgtctgcttctggggaggcctcaggaggcttccaatcatggcagaaggtgaagtgggagcaggcatgtcatgtgggagaagctggagcaaaagagagagttggggcatggtgccacacacttttaaatgatcagatctcacaagactcataacgaagacagcaccaagccacgagggatccaccccaaagatccgatcatctcacagcaggccctacctccggcacgggggattacaattcaacatgagatttgggcagggacaaatatccaaacagtatcagaggtggtggacggtgggctggagagcaggtggtctgggctttctcttgtctccagtagtgactcaccttgctgcctgggccagtcacttcatttccacatgcctcgacttcgtcctctgcaaaacctagattttggactcagagacctcttataatcttgttcagctctaacaaaatctccatgttaccattaatgaagaaatgtttataaaataccctgcagaccctctgcggatgttagtgatttgctctgggggtacattgttaagatgcgcttgtaattttataagcagttaagtatttggcatgggtgagaaagtgtgtgtgcgctttagtccactctgtccagggcttgcaggcgtgtgcttgtagggaccaggcaggtaatgtcagagagtgcagagggttgggtagggtggggggcaaactggggaactcctgccccatccatgaggggcacaagggaggggaagaggcagagaggaggggagggcgccactctcttgctcctgagtgttgctgtgctagaattgaggctcagggttggtgtcacttcccagttttccggagaagctggaaattagaattatttgaaatcacctgatttttaaatatagtcggtgaattcagatttacttaagatgttatagaagaaaaaagaacacataagggatcttcaatgcgacccataaccttcagtctgtgactttcattttaggaaaattcccctggtgtgttatgtagaaaggtgccagtgtgggcccagggaggtggtcctggcattctcttgcggcaggtgcactgtggcatcctcacagcctttgccatcagccagggctgcaccttaaccctgctcatgccccatcccgtgtgggagtgagaacaggcaacaaccccagaaataaagccagaaacaaagtactccagtgcctcctgaagcagcgtggagagccacgtacatgatggaatgcgttttgagtttaacagattggtggagttaaggtgacatcatatgatgaggcagtgcaaggcgggaaggaccctcaggagtcgtcagggggttgagtcccaggctctaccatgtgtaagttgtgtgaccttaggtgactttggctctctgggtctccatagggataataacaatacctgttttgtagtcaggattggcgataatgtagataaaatatctggcgcctgcctggcatattacagatgttcaacacgtgttagaagctatttttaatattactattatattaacttatattactattttgagcaagaacatgggtagtcagaatctgatttgaatcttaatttctgtgcatgatacataactggatggagtctcagatgacagagggatgtgtgatgtctatggagggagctttctttttcaaatatccatgtttccaaagacacctacccagagagcggctgtcctgaggatgtctgctatgaaatattgattgtgtttcagtttcaaagcatgtctgactttgtttctccctccaggtcaagctttacaaaagcgaaaacctcgacaatccaatccagacagtttcccttggccagtccctgttcttccatttccccccactgctcagagatggcgaggtaatgcctgtggccggattctaccttctgcctttgttttaataattctgctgtttagtttaaggaagcacagttctctccttttctccctaaataccactctgcagaaatgcgctctctgaatcaaaagaggttgggttctgtagggattattttttcttcattgtttttctgtttacaaaaagaatacatattcatggcaggagattttgggaaaaagaagacataagcccatcatccagaaatagccactgctaacatggtgattggtatcctttgggtcttttttcaggcacgtgtgcgcatgcatgtataaatataaatagacatttattttaataattcaaaactgacactgttttgtacattgttttgtaatccatgctcttcaatgaagaatttatcacaaatctgttcctcatcatcaaatctttcttttttttttttttttgagacggagtctcgccttgtcgcccaggctggagtgcagtggcgcaatctgggctcactgcaagctccgcctcctgggttcacaccattctcctgcctcagcctccgaagtagctgggactacaggcgtgcgccaccacacccggctaatttttttttttgtgtatttttagtagagacggggtttcaccatgttagccaggatggtcttgatctcctgacctcgtgatccacctgcctcggcctcccaaagtgctgagattacaggcgtgagcccccgtgcctggccaaatctttcatactatgatttttatggacagtagtccataaactaggaaacgcgatgatttatttaaccaaggcctactgttgggcatgatcgactcttgcactttgaacatatcaccccatgctttcctgctaagaagtccacttttaaaaatgccttgtaatttttaaaaattcctctattttaacattctgctattgagtttagggaaatacagtttcctcatgatgggggatcccttgaatgagatgagttgcttttctcttgctgctttgaacgttctctctgtctttgataatctgattataacgtgtgtcgtgtagaacacttgcagctccaccttttcagtgtcctttgggttccatgaatctggatgtctccctccttggaactgggaagttttcagccattattctggccgtcatttactgattataaagtgcttattatcaattctatttggacagagctaacttgtagttggtgtggggagtgcaaactttgcaaagaatttggttcttttctggtggtcttagcctgaggatgtcaagtgtgagcctagagggtgacgtttcctctcctggctccttaccacctgccgtgaagatgatctactctggcctttctctgtggaaaatggctgcgaaataatgaaacaggctgtcacggaattttctcctcctctttctccaggggtgttgaaatagtcacttcctacagcgatgcggaaacatcttgggctttggggtcacacttcccctgagttcagagccttcatagatgtgtggcagccttcttagctgagtgaccttgggcaagttactcttagtctcttcgtgcttgactttcctcgtctataagacggggtgatgatcccgaccttgccagtggtagaaagcaaagcagccgcgggcctcatgcaatgtgcatggtgcctggcagctggtcggtgctcagcacacagagctgtgacgggcctcatgcaatgtgcatggtgcctggcagctggtcggtgctcagcacacagagctgtggctgcccctggtgccgttccagggatgctgtatttttaggatttgccagcttacgagcctctcaagcatcgtcccttagaagtcagccccgttgtggatcctcagttgtatcacgtacctccctcatcagaattggctcataataattttttgtgtttcataaagtcagatcctcagaggaccgtaattgtcaaggttgggtactcataaaaaggctgcaggctctgacagccttatcagaagccacagtctcagagacactggggacacatgcccgccactgatggaatagcccgctgaggttgatactttgaaggcagcaaccttggtttggatgtgtagtcttggggatttctttaaaaacataaagttctttacatcacagccatacgttaggttttagttttcatttgctttgccagagctgtccttataaaaataacttcttcccatgtgtgcacagaactatgttgtgcttctggactccacactccccagatcccagtatgactacatcttgcctcaagtttctttcaccgcagtgggctaccataaacacatcaccttgatttttaatcccacggtaagtaaaagagggagttaaaaaaaaatccatgggctgggtttggtggctcacgcctgtaatcccagcactttgggaggccaaggctggtggatctcttgagcccgggagtttcagaccagcctaggcaatacggtaaaaccccaactctacaaaaaatacaaaaattaaccgggcgtggtggaacgcacctatagtcccggctactcaggaggctgaggtgggaggatcacttgagcctgggaggttgaggcctcgatgagccatgatcatgcccctgcactccagcttgggtaacagagtgagaccctttctccagaagaaacaaaacaaaacaaaacaaaacaaaacaaaacaatccatggggtggcaaaagaaggcatgtccatacaacctgtgctccaggtcgcaggttgcagggcagatatttaaagggctcctggcattgggtcactttctcattctgccttctggattctgggcttccccagattgtttttagcttttctgagcactgatgcctgcgattccctttgaggaggaaactggtaataagagcagtgtaattgtttagatcggtggctcaggaatgattttgggggaggagggacaccactatcgctggtgtggcgtgtgcttctccatgagggagcacatggtacatggccacgcaaacccctagaaccaactgctactttacaggaaatagggaggacccaggagcacgcaaatgactccacagggatgcaggacaaccacctggagcctgatttgtttgacaaataaattgcaaggaaaaaaaaaccaacaacagatggacagaatacctgtgggttaaaagaaacttaacttatcgcttaattcattgcaatatgtggcccttactatttgcaatatgtgtatctgttgcatacggtctgtcctgtatccgataggctggaacagtggaacaaacaaaacatacacgtatcttttaccttcttgataaaattgtttagtgattcctaaagctcagatgcagtattgtcacctgatgattaaacagacacatcagcaatagcaaaaacagagtccagggctcagcctcaggactgctgattctgaacttgacggggtgaaagtgtagcacaggagtctgcattaaaaacaaaaatctggcctcatagctactgtgttggttgttgcttctaggccttttcagtgggcagaataagaactttattgttttcaaaagatgtaactgtaagtggaacaatatcctccgatcctcctttttccttttttgataacgacacagcattcctctgtgtggatataccgtgtgtcttaggccatttgggctgctattttgtatcttagactgggtaacttataaacaacaaacatttatttcttacagtactagaggctgggaagtccaagatcaaggcattggcagatttggggtctggcgaggacttgctgtctgcttcatagatggtgccacctagctgtgtccccacaaggcggaaaggggcaaacaagttccctcaggccactcttacggggcattaatccctgacttaatcacctcctaaaaagggtgtcctcttgacactatcacattatggattagggttcaacctatgaattacgtaggcacagacacattcagatcctggcactacatgtaggatattcagttagcccctggttgaggggcgtttgtgttgttactggttttctgctattacacataaccctttaatgaattgccttacgcatgcatgtttttgagtgttcgtcagtctctctttggaatagactcccagaagtggaattgctgagtcaaagggtaaatgcatacggaattttgattgatacggccacttcccatccatgggggttttactgttttatattcccgccagcagtgaatgagtacccttttttccccaacagagtattttgtcaaatttttcaatttttgcaggcttatagatgagaagtgatattatctcactgtacttctaattgcatttctctcttttcatgtggttaagagccatttgtattttctgtgaactatttaacctatttttctatagaatttttggtctttttcaaccattttcagctctttgtatactaggaatattaaccctttgtaatgtttgttgtacatatttttcccaatttgtcatttatcttttcacttggtttctgcaaagatttactttatttctgtgttaaatgtgttgattttttcttattgcttctggattttagagtcataggaaggttttcttcattcccagcttttacaggaatttatcgtgtttttttcaggcagacttttatagtttctgtttttacatttaaatctctctatccatttggagtttttcctggtatagatgtgaagtatggctccagattgtctttttccacatgctatccagttaccatttcatgcttttcaaacgccatcctgcatggaaggtggacaggaattacctttcatttagagatgagaagatgggaacctagaaggagatgtgagcagcccaaggtcaccagctcacgtggagcagtgctagggcttgagcagagctctgctgctgattctgggcttctgtgaagagtgattcatgctcagtgagcctgtaaatatgatcttacctgaacaagagagtttttctcatgacccacgaggaaacacttccttgttactcacagtagagacctggttagaaagtgctggagagggctaggtgtggtggctcacgcctgtaatcccagcattttaggaggctgaggtgggcagatcatttgaggtcaggagttcgagaccagcctgggcaatgtggtgaaagtgaaaccccatctctgctaacaatacaaacattagccaggcgtggtagcacgcacctgtaatcccagctactcgagaggctgtggcaggagaattgtgaacctgggatgcagagtttgtagtgagctaagatagccccagtgcactccagcctgggcgacagagcaagactgtctcaaaaaaaaaaaaaaaaaagaaagtgccagaaagataagcatatacaagaaccacttacctttgcttggggctgcattgtggcccagttgctgggagaggcttctgtgaaggccgttgatagctgcaggcagtgacattctcaggggcccctagcagacaactcatccgggctcagggacacacctgggagccagtggcaggaatgtggagacactgcttggtggtggccgagcagcccagcctcgtagctgctgcctgtcacttctgagaatgtaagaaactgtgccctggtgtgtgatgttccccttcctgtatacctatgtaactaacctgcacattgtgcacatatatcctaaaacttaaagtataattaaaaaaaaaaaaaaaagctgtgcctgctggggcttggattcccgagcagggccaagtgttgaatgaagagagcgcccactctgtgccaccccgtacagggccctcacaggttgatcctcacaacaagccttcaagcaggtgtgccattcctcccattttcacagaagcccagaaagattgagtcacttactgagtgttagcagaaccaggactcaagtgaggcagtttgtctcaagccacatggtttccacctcgttctgccctccgcgtgatgagtggctcagcattgcatgttcacgggggctttgtaagcacattggtttccttctttgttgatgtgactgcccacagcctcgcgactggattttactcagtattccatgccctgctgagcatttcacatactcctttcatcaagtttcacagcatccacccccagtgggtgttgttcatatgatctccatgtcatagttgagtaaactgagtctcaacgtggttgcctgagtttacccagtgaggcctgggacctgagcctagactgaatcactcttaattcctgctgaattaaacttttatttatttattcattattatttttttctgagacagagtcttgctttgttgcccctgctggagtgcagtggcacgatcttggcccactgcaacctctgcgtcccgggttcaagtgattctcacctcctgagtagctggaattacaggcatgcaccaccacttctggctaattttgtatttttatagagacggggtttcaccatgctggccaggctgttctcaaactcctgacctcaggtgatctgcccacctcagcctcccaaagtgctgggattacaggcgtgagccactgcacctggcctgaattaaacttttaagtaagtgtttacttcagtggaaaaatgggttgggttctaagagatgtccagagatacaggagtaggcagttgttgatggaaatctgttcctgcccttattctttcatttatgaaagggcatcccaggtacagcggcccccacagtcactctctagcccagcagttctcggatgggttggttgcaggacccctttatactgttaaaaattattgaggattttaaagagtttgagtttgcatggattatctctgtgtatatttatcatattagtaattaaaaccgagatgttgaaaacgcaagaactcacaagctacacattccgttagctgtgggcgtgatgacatcagggtgcgtagtctctggaaaagtccactgtgtgcttgcgaatgaaagagggcggaaaaggcacatcacatcttactattggctgaaaatagctgtggcctcgggaacctctgcgagaggagtcccggtatcctacactgagaacactgctctggctcattaacttgtttttatcattattgggaagttctccttccatttatttgcttcctttatgagagtagagtgggccaatgggatataggttcacttgatgctttagaacccagcatttcaggggctttagcaagatggaaatgtctgtctcatgtcaagtgtccaggagtgaccagtgcagagatagtctggtagctccaaggcgtcaggggacccaggccccttctgtctcattgtgctgttccagtgcattgcttttctccaaaatggggcaattggccaaatgctgtctacccagcaaaagggagggcacaccacttccctagggtccagccagggtgtggcacttaccgcttctgttcctgtaccattggccaaaatttagttccagggctgcgcctgctgcagggaaggctggaaaaggtgatctatattgtcggtggcccagataaaagttgggggttctattgggagaaagggagaatggccacagggatgctagtagcagtgcctgctttgcttcctcactagaccgtactggctgggaatagctgcccatcactgtgtgccctgggtctagaactgtaggttcttgatacatccttgtaggactaagtccctgcatgttgctgggactcaacaaactgagacccagttgcttttcaaccaccaagactctctgatagctgcatctcttcatttcctcagttgggaggagggtccagaggctgaggaatgccttgtcattggaatctctttgtccctgagtttcagaagcaaatagtgaagctttgggcagaagaggattcatgggaaaatacatccaaatcactttggttccttcctttggatagaaggaatttggatcatgagggcccctgggtgtcctcaagtggccactttggaaggctgggtgggtggtggctgtggcattgtggatgatggacaagcttgtggccttggtgaggagtgatggggctctcggtgtttgcagaggaagctgcctgaacaggacatcgcacaaggatcctacattgccctgccattgacgctgctggttctgctggccggttacaaccatgacaaggtaggaaatccagaggcctcaggagatggcgggcatgtcagggagagcgagtcctcacagctgcaggagtgatagcagagggatgtccagggtcacagaaatcacatttcccggtcgggagggcccgtgaaggcctcaagtccagacttaggtctcctttcaaggctgtaaacttctgtaacatctcctaatccttaaacctggaacacctctagggacatattaggcccggagagaggccagcccatccctggggactcattagtaagaggcctgcctcgtttgaactgaaacccacccattagcacgtggcagctgctgatcatgtctgaagaaggtgtgttgagaagtgaggctccgctgttcatctggcaaaagcctcctctttgtacccctctctctcacactttctctcttttctagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 1526 - DNA, 258471 bp, Homo sapiens
aactagcaccctcgctgtccttgtgcagtggaacgtccccaggtctgagaatgcacctcccgccgtgtccaccccggccgcgtctctcctgaaggcagatcttggaggtgcagccaggactcctagaggagcctcctccagtcaccatcgcgggtggggcgagccgggtctcctgctgggcttcccagccgcttcgctccggacctgcctggagcctacaaaaaacaagggctcgtccttgcactctcgccccccatggatcacccctagaaggtgctttccccaaccctcctggtgccaaggagagcaaacctccccggggatttgcccaaagtggtgggaggagggttaatatttgctttgttattcggataaggggaggcaagtatgccttgggtgtgtgtgtgtgtgtttgagagagagagaaagagagagagagagagagagaggtgtttttgcagcgggaaacaagcaggaagaggcacagaggccggcgcccctgctcccctcggggcctctgagagcggcacacaccgtaattcccttcccagagcctacagattcccacaaacaatgacatcactccgccgccgctggcctgattacagctggggggattttcctgggcgcgcggcgggccaggctgagatgggggagctctccggtgctgaaaggggcgggggcgcgggctcgctgcgctgcgctgcgctgcgctgcgcccccagaaggcggaggcggccgggccgggccgggccgggggtgggcgggggcgggcccggggcggcccagggcggggcccgccgcttcccccgccctcattggccgctggcggactcacgtcacccgagctggtgctctcccccagcccctagggaattggagctgaggaggagctgaaaatgcagatttagcatcaagcacagacctacactcgctctttctctccggtacacacagctccccacattcgcacccctgcccgcgcgccgggccgcctgactgcacggcttcccctccagccagatgctggagaacacacactgattcgctgctttccaagaccctgttcagtctctttctctatacaaagatttttttaaaaactatatataagaattctttatttgcaccctccctccgagtcccctgctccgccagcctgcgcgcctcctagcaccacttttcactcccaaagaaggatgaagggtggttgtgtctcccagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccgaaaggtaagctctcccatgcatttcgcatgttgtttcaaaacggggggacgggggggcagccctgcgcaatctcattgcagatttgcaagttttctctctttctcatgcgatgcagatattctgccatgggctctttaacacgatattgcctccggtgatctttcaccggttatgtaattaaaatgtccttcatctgtactagtaaggtcatcaaaataatttactgctctttgacttgatggcgaaaataggataacacctttcacaggatgccatgctccggggatgctgtccgaggtaccaagttctcgaggctgcctggggatggagggatgaagccctgaacagctaagcctggcgttggctacttggccagggaagtctcccccacccccatcccccggagaaagaatagtttcctacagacgaggctggacgtttggacactgcaattcacctcggtgtttctcccaccccgcgccgggaggacttccctcccagggacttcggtccctgctcctctccgggaacaacggcttcctgactctagatttggaaagaaactggtctctaaaatcggggcggaacttctgcgccctcacccccgcccacgaccgcccacccctggagcgcacttctggttggctccctagttctcaactcccggctacaggagctggagaggtggattttgagggggattccctacggagaagtcgaggtgtcctctcctgatgcgtgggcggccagcctggctttcccactagagcgtggggatccccattccaagaagttgccagagttcgacagtttgagcagataggtgagcctcccagctttggacaccttggatctcctttggagactccagggtactcatcctgggaggacagagagaagggcgctgggtgggggctgtggctgacctgcgtgtctctcctgcaaaagatgtatcagggttctccagtgtccttaggggacctggcgcaggctggggtggagtgtgggtgcagagagaaggtggggcgaggggaacccaaaggacagagatgtggctaccagagggctgggtggaggtccctgagattttaggctccatctcgctcctgatcccaggaagagagaggagtgagatgagcggtgggtgcttttggttattggttttgccttgaagggccgcgcagaccgaagctcttattagtctcttctgtcctgacttcccaagcctcccgcctctctcccagccaccgccagggctcctccaggtgtgggggcctctccctcctcctaagggcgtaggcagtaccggaatttcgaccccagaagggtctggcgacgagtttgacagaggtctgggaagaggctctgggtccgccggtggcgcgcgggcgggtcttgcggaaaggaacttgttgctctggaaagcgtgggtggagcaggggaaagaaggcgccggcggagggagcaccccgctgtggttttggcccgtggcctgccggctgttttgagagacaccaacacaataaagaagccgaccttccttcttcactcccccccaccccaaacttggcaagacccaggacccaaacgccattataaaatataatagtgattattattagttatacggaagcttacgtgctggagtccttacatagatttttacttaatcttctcaacatctctgaggaggctactatcattattgagcctatggccccgttgaggaaattggttcagaaaagggtgcgagataaaaacaggcaagggcttcaatccagatctttcagaagtgaacccatgctctttactccttagtacccacccaagcaagctaggtgctttcaggggatgtggggcattgagataagttgaaaagggattttaattcttgagtgtgatcttgctgcagaaacctgtggctccctccccctcccccacaccttttcatgggtgcgggggagtgggagggagccataggtttctgaaaaccattgttctcagtggttttctcttctctttgctgccccctttgaaaatgtgcccttaggatcagagatcagataactaggcctctttgtccttcattctttcttggagaggagcacactgattttgcatcacaacctgaaacctgcagttcccatctgagagacctctctccttacttctccataacctctcaggtagtaccccacaaccaaatccagtgattttttttccccttttacacgtttaagtaacagggactgcctggtgcaacatctgcctagaataaacctccttttggatccatgtcttgtccattcttcaagacctaaattcaaacctttcctgatgctacagaccacagtgagctttccctcctccaaatttttatgcgactgataggcaaacactgcactacataagctaataaatgccatcacttttcctcattatttcaggtatataagtaaatatgggttcagttgttgtatttctacttaaaaggtaaatattcagggatgatacctcctatatttctcatttcctccctgtaaccagcacattactgttttgccagccttgaaggaaacttccttgtctgtatttattatcccaggtttcccagacaccgtcctatcttgctttcatcatactgttttgtacttttgccaacatttgttattgtgcatcttagaggcccttatgtccttctccttccttgctctgatgcttagcatgcttcccaactccctactgctccctgctccgaggctcagtgtcagacacaaaagattctcagtggttatttattcatccatatgaaaggtcagcaatggaggctagaagaacatgctttcttattaaattatctcattctaagctcacaaatctatgagagaaattactggcatcagctgtaattctcagatgaaaaccttaaggccttgagaagttaagtatctgcttatatctgagaagtaaaagaactcagacttaaaaccaaatttgcttaactgaaaaataattgcttttctacatcatgctgcctccaggaagccttccctgactgccaagaactcttcccttgagacacaattttagagctctgctattttcccttttctttttacttttattatatttatcatttattttctattaacacatgaacatgtcattagctaatgggtacgtgtatttatgtcttcaggtagactataaatcttccaagaggagaaatgacatactatatctttatatagtctccatatctagcatggtggcctgtatatgaatatttaattgtttgtcaattatttgattgattcttataagaccatgaacaaacatttgttttctctctaaaatgaaataaaagcacctataactttacctctgaaaaggttatggagattaaagctttctattttatcatgacctggccctggcccaaagacctatgtctatcagaaaagatacttaagtctaggagagtgaatgagtttacagtaatgacaaaagcattattccaaagagtgccttaaaattctcaaaatgctactaattttaattgatttgaaacagaaaacaaaaattatttattgaagcaacctgttgaagattaaccaaaaatcaagtgagagttagggtttaaaaagaacctgatattatcctaggggtttcattgtattatggtgtgttttatgttttatccacagaggacagatgctgaaatgattacacaagtaaaatcatgtgaccatttttataatgtgtgagaattttttaattttgaaaacaacctaataatcattatgctgccaggtagtaaaaaattaataaatttctggtcgcttcacttttattaaagtataatttaggaaagaacacagcttagggaattttcacaaactgagcacacatgtgtaaccagcacccaaatcaagaaataaaatattaccagtatccctaagtccttttctcactcacttgctttgttttcaggttttagctattataaatatagcttttgtggatattaaagtctacgtattttggcaaacacatatatggccttctacagggaatcctagaaatggaattgttgagtaaaaggatatgcatgcatacagctttataagaccatcagttttctattgctgtgtatcactaaaaaacttagtggcctaaaaccacacaagtttgttatttcacagttttcatgggtaaggagtctggcacattttagttgggtcctctgctcgagtcttcacaggctgaaatcaaggtataggctgctgggtcccatctagaggcatgaccaagaaacaaccctcttctgagcattttcacggctttaaaggaattgagtttcttgtggttttagacctgaagtctttattttcttgctggctgctgggccaggaccactctcatcccctggagacctctccatagccctctcacacctcacccttcaaatatctgccttcaggaagagcccactctccttgcaaggttaacctgattcgttcaagcccaccaggattgttttccttttggttcttctgatgaactcagagtcaactgatttaggactttaataacatttgataaatctcttcacctttgcgtaatctaatcacagaagtgaaatctatcatcttcacagtcccacctaggctgtccacactcaaaaggaagatgattacatagggcatgtacatcagggagcagaaatcttgggggccatctcagaattctgccggctacagacaaacagccacatggctttcctaagtagttataccaatttacattcccttcagcagtatgtgagagttccagctgctccacattctcaccaacactagatattttacatctgttttcttttagccattctggtggtatgtagtagtgtctcatcgtgactttaatttgaatttccctgattatcaactgaagttaaacacctcttcatatgcttattgatgatttggatatcctcttttaaacacatttgtttcagatgctttgtcctgaaaagtttttcttttgggttgtccatcttcactttttatttgtaggatttctttacctatgatggatagaaatttttggtcagatatatgtattttgaatatttgataccacccatttaatgatatcgtaatgtcacaacaatgttcaatccagattatatgcttttacttctactttgtcaggcagccaattgtaagtcaaaggaagaattatcttgcagtatttccacatcccctatcccaaagttctttagatcaaaattgacaatatttggaggaaaaaaataaaaacagcatatagatttgatcataagcattccctgaaagatttcaatctaagaagactttaagggacagttcttctggaactaaaagattttccacagtagctaagggaaaatagcaacctgtaaccttgcttccctagacatggctgccattcatgttgtgccttagatcgaatccaagctaatccctcaagacctgtctggttgacctagaccacagtgttctctatccatttggtgctttgatgatgtataatcgattcctttccctgataccagtcatagccatcagaacgctcactgtccccaatacacctcttgtggctgaagaaaatgaggaacaataatgttgaaaggtaaagatgacaggatttggaatcagatagcactggaaacttggctaggttactaaatctctcagaggctcattgtcttctgaaaatggttaataaaatatggtggctgtgaaaaataaataatgtagttagtgcatgtaaagttctgggcacagcactgagtgcataggataaaatagctattactgcagtagtaacaataagctggttgtgcactagtgacactcttttcctcaaaaaagtagctgtgggttatacttgtgagggagtgacaactgattgagtaaggaataggaacccagcccagcagcaatccacccatgggctagtcatgacccatgagatgacctggcccaaattcagtaaatttaattcattatagaccatggtaattatctcagccaattatactggattcctcaggaaatctgactggctagttgctctagagaggagaatgcagtacagttaccatgagaaagcccattcaggccatgggaaactcagacattttatctaagtttctaatagctttccaaccccagtttccagcaaaagacgcctgtaacaggctgaagagctaagcaccagattcattgctccttcttcatgggctgcagcaagaccacatttcccagcctgccttgtaaataagcgtgatcatgtgacaattctagcctgtgtaatgcaagcagaagtcatgtgtacttcttccatgcctgatgcataagaattctctatcgattgtttctctgtgttctgctctcctctggggcttgatgtaattgagaacagtacattttgacaccaaatgccaaagcagcatcacaagatgaaaggagcccaggtccctggtccgtgaattagaagaccttatatgagtgagaaataaactgctattacattaagacactgagatttgggagtactgcccaaactaatatgctgtcagtaaatatccctttgcttaagttgctagagtgaatctctaaacctcgaaggcaaaccgagccagatcacaacaaaaattgttccaaagttctgtgagagcacacatattttcacaatatactaccaaacaacttttcaaatatttgtgatttgtcttctccagcaacaaatagaacccattctacacactgttcttcctgctggcaaccaacgtgccctactcataataggtgtttaatatgtgctccttgactatgactacagttggaccacaaggtggtgatttgtccataatctcaggttgaaggtgctggaaaaactattttttaagaaactgttcctgtagaatccatttctctataggcagccattcagctaggaaatagaattaagtgacaaccagcaagtgggcaactggcatgcttctttgtttctctaaaattccccaacttcgatattatcagtagtagaacagatgagctctttgaacaaagaaagtaaagtctgcagttacaacctgatcaaaatccaaaagaagggaaagaggggaaatacacctttttttctcaattgaatgaatatctagaaatcaatttctatttcagaaggtcttattagctatagatcataacgtcatagcacatcagatagtgatgctatagttaggttcacaataattatatattccactcaaactaactgctcaaagaggtctggctttaagaataaaacatgaaatctgaagttcaatttttcattgagttcagatccaacgtttcaaaaagaaactctgtgctgaatttgtgaattattatttgagatacaaataatcacgggacagctcaaaaactgacatttctatttgactttccttattaaggtgtatttatttagctaaagtccacaagtgattaagaagtcaagaaattacatctgagtcaacacttcagtctgaaatgtatagttgtgtattaatggatggtttatatgcgagacacatatgaaaataatttaactgccttgacaattttttgtcactgaagctaatttgaccacaactttttggaaattgttgtgatgtgctgagattgtcgataaaaataattgaataaaacaagttcttacattgaaagtagaacaatgacacactcttaatttcctgacataaagtagacttcagactgttacagcgtattggcagtttctccattagaaaattgacaagaatggggagaaaactgtaggatcctggggttgctctttgtttacaactttaaatttgacattaacttccataaatatccaattgttctcctagtttttcctaaatagattcatttcatgctcattttgtatcaaaggcaaaagagtccaaagaaaagtgaacaatatacagaatcactattggaagcatcaagaacataaagataataacttaggtttaaaacatttgcaaagtgttgtaagtcattagagaaaaaagttttgacctggaatatttgggtttcactcttctaaagttttaagtagagggcaaagagatggtcagccttgctttctgtgtaaacacagtgtctggcaaaactaagtctacaggaaatatttgttgaatgaattacttgattgatgttggtattagatgtagtagacaattgaatatctttcctcttaagatttaaacaatgacacacacaaacaaaaaagtgaatccttccatttgtgagatggtaaacatctcaatgtcaagacagtatttttacacattgcaatattcatgaataccgtgagtggacataatcaaattaaatcacgagataagttaggaaccctgataatatgaaaaatgtaataactttgatatttttgtcagaatcactcatcattattttaaaaaataccaagtaataaaaaaatacaagaaggtcttttttaattatctcaaatctcattattcagaaataaccattaccagctttagataaactctattgcagatacttctgtatgaatatgtatagagagaagagagatatataaattgttttatagagctgagatctcatcatatgtgctattttaagttttaaatcattcagtttaattattataaaatttaacagaagagaaaatcaaaagaaaactatggaaattgttaaacttcagataaatatgctatacaaaggagatattatttcctaatatacctccctaaaattcataagaaattattgtgtctcatatttaggagtttgtagttacatattttatacatacatggtagataggttacatatatttaattacatgtttacttatttaattacataattcaacttttgtgagttatggactcagtgctttgtaaaatggggaaattagcatcctgacactttctctcagcttccctacttccacattccaatgtttgttaggtatatcattatttttgcattgtgttacatataaatattaaccttctactaataaccataatttatagtattgcttatattagttctttcttaaaattctaatgttaccacaagtccttttatcagaacttcaattacaaattcatttttattcatcttttgagtagctaggttttactgaaacatgaagaaattagcctaagcatgaaaaaggagctgtctcagtttcagattaaaggggaaaaaattggcaggggaagtcctgtttttaggtcacagaggagaatgtggtgataatatccacttaggaatcacaattatttcagaggattaagaggcaaggtcaatgttcagagggaaggaagaggtgttaggatgggggcttcaaggagatggaagttcagacactgctagtagacatgagagagggagtggacaaaggacagatcatgatttctgggcagtactgcagaggcaagtgggaaagaatggatttatggtggcaccagcagacatcttaagaatgtcttaagcaacattcagattagggttgagaggtgagagaaatggaatcttccaaataatagagtgtcaatgaaatagaagaataggtaaattggaaataacagtgagagagatgaaagggagagagctatggttggtgagtgggatattgaagctcaaggctccaaaaattgagcacttccagataatgatgaagttcatggaagtgaattatcaaagtaaaaaggagatgaaggtgatcaagacactaaaagtaacatgcacaaggatttgttcacatacacctcattcatgctatggcaagaaataggattgtcaaggaagactgttgagagaaaacaaagcgaagtcctaggacaaaatgttggagaactttggacatgaaaggagaaagaggaaccaggagaggagtcagaacttggacggttagagatatggaaaaagaatcaagagcacacaggcctgtgaaaggaaaggaggagagagttaagaaggaaagaaggaagcaacctcagccactggttttagagacaaagtcattgttgaaataggaggagtcaccctagcacagtggaagaggagacgagtgttaatttgggtccccagatgtaggccctggaataaggacttaaatgcaagtagtttacttaaagagtgattctacaaaatactggtagaggagtggggaattgagataaggaaaggaaggcaggaataaagggtacatcataaagcaagttgtcactgtgggtaactggaactcaatcccactggaaaactgggagctggtgtagaatatgtgcttcagagttatcctgcctgaggggtgaggaagttggggtatttatacacgcattgcattgacatattaattaatgattgagagttactccaggctgatgttaacactccagcattttgtcctggcatatgctcagacagagcagaatttggccatccagaaaaatacttgcaaacagatgcagaggctggcacccacaaaatggtaaggcctatccaagaggatctgagtgtgaaagtaaacatgtctgctacaggaaaaaagcccaatcatgaaggaaagcatcaagtgtgatgaagtggaggtaccaaatatagaccatcccttcaagaggtatagtggttaaaatagaaaaatagtgttacagtcacttgatgtggttttaaaggtatttatgaattaataatttcttagcacttgtcagaccactggagattgctatcccaccagaatattgtgacatacctagccaatcaagtctgcattactctaactggtttttccagtcatttacatttttacaaatgataattataattatgaaattacagcctttcagaacaggaagggatcctagaaagacattaatttaacccttcatttaataaatgaaggaaataaatgagggaaagggcatcgaacactatgtttgtatgcttaactattccaaaaagcatttgagccttgttgctcattggcggtggtttagacaatgcattattgatatcactgaaccagctttccagactggatgagatagacaactagattgggtgagactcctataagtgattagccacatacaccaacttggtctgaccatactaattcatttcaggtcctcctgatgtgcttttttggtttgtttttttaccattttacccgtagaatttttataaattctgattttccaaacaaagctattcatagactcaaggattccacaccaacaaccattgggtttacacttggtaaaagacagaataggaatttatacttccttgactactcccttagtgactaaacagtgctatatatttagtaagcactcaataaataccaaaataaatactgagaaaaaaatttaaaggcttagcatcatcattagattttcactgcacacccagccgatgtctcatgagatggtgcaatcaggaaaaccaagtatgctaggaagggttataggaacatcctatttagtgcctgtgttaagtggatttccttaattgcccttaatagcctaaaattttgtgacttaatcattaagaatccagtgacagaggagaataaggtgacccacaaatcctattcctctttgcctttagcttctcctctatttctgtgggaagaaaaaatatcacttttatcagggcaccaccaattctcttcagtgatgatggaagctcaaacccaagaaggtagttgacatccaagagtcaattctagtcagttccagctgactatgtttctaggaactgtcagccaagaatgggagaccaagagagaccttgaagaacctaaaatgtgggaagaaggatgggaaacaagccatttgtgatctcttgaagttcagtagcagcactttaggcagaggagaagggacagggatccttggagagttgtgtcttaaatgaggtttgtcattaacccaaatttggacccagcagccgaagccagaaacaaaccattctggccataaactagaaaatgaggagaggaccaaagaagagttatgggagtttcaagccaatggaccaagaaattagcaagagctacagtcataccacagggacgtatagaaggagaagattattaaggtcattcaacaaacatatactgagtaagttcagtaaacaaacataatgcaacacactaagacatggatttgggaacaagtaagcaactgggattcaatcttactggcctaagatgattccaatagatagatgaaaaatcaaaccccaaggtgaaaacactttttttttttttttttttttttttttttgtgagatgaagtctcactctgttgccaggctggagtgcaatggcgcgatctcagctcactgcaacctccgcctcccgggttcaagtgattctcctgcctcagcctcccaagtagctgggagtacaggcgcacaccaccatacccagctaaattttgtatttttagtagagacggggttttaccatgttggccaggatggtctcgatctcctgacctcgtgatccacctgccttggtctctcaaagtgctgggattacaggcataagccactgcacctggcccatgaaaacactttttaagtctctgcttgtgttgcatttactaagtttcattggccaaagcaagtcacatggccaagtttagagtcagtgtgggaggagactaaccaagggaatggatacagggagatatgaacaaaacatggatccaatttcctactacaggcccctctgacagttacaacttatctgtgttgtcccatcaaagggtgaggaggctgggatgtttaacctccagctaccatttcttcttggttgatggttgctcctggggaacttcaaatctctcatacttctgcctgctgtaagtagaccaagcatgcttccactgccagagaacaccctcaggagagcggtgcctgaaagacattggcatctgtatgtactctgtacaggtgacctccagggtggaccaagggaaggcaggcagtgcatcaatatcatgtgctacacagaggacctaaagttacataaaattgaggttcgtcagaggctagaaagaaacagtttgtgagtgaggctgtatgtcagatcccctctacgtgtctcattacctaggtgtcactctagacttgatataaatcagtggttcagtctttagggggtacatcatagtttgaatcccattgtggactgttagcccagccctaaaatagttggtgtttgtggctaatccctcataggagtgtcacacaatctagttgtctgtctcattcagtctggaaagctggttcaattgtatcaacaatgcattgtctaaaccacagccagtaagcaacaaggctcaaatgctttttgcaatagttgttaggcacataaacatagtgtttgatctgctttccctcacgtataaaatgaagggttaaacgaatgtctttctaggatcagttcgcgctgattacagacaaatgggagtgctccatgtaaacaagtccagaaagtttttgtgatagatttaatatatagtgcatgtgaggccgtgactgtcagcagaaggaaagtcttcacaaagcaggcaataatacattgaggtaaatttacaatgaggcttataatttcaagaggtttaaaggaagaggtttataaagaaaaccacaggatgtgcaatgaaatgggcacggtttttcggaggattgcaagtagttttgtctgtctagatgacaagagactgggagatgaggccaaagaagtgacctggggtcagttcatgaccagtcacccatactatgctgaggaatttggattttgcaggtaggtggaaggaggcatcgaagggtacttgggaagtgtggcaggatggccacatacaggacatcctaggataagaagttgagctaatagtgacttggagaagccttgatctctgcctggtttctttgtcctgtggaatcactaattctggcaacaagtagcacatcatttaatagatgatgccactaggaagtcaggttatatgtctttgattccattgtcactggatgatggcatcagtgatactaatggcttgattaattattgtccttgtagtcacactgaacggctggtagagcagccagttctatccatgaagattagtccagctaagaacaaaacaattaaatgcacctcccctgacatataaatatatgaatgcagaacaaatcccgtaacttagaagccaagaagaaaagaaagaacagtggtgtatcaccatgatcctagctcacctaataggcacattactccctgatattccaaagaaataatgctcatttttaattttttctttctggaatgatatatggaaatgttgcctgaggctagaaagaaagtttgtgagtgaggctgtatgtcagataaccactacctgtctcattatctgggtgtcattctagacttgatataaaacagttgttcagttcttagggggtacatcatagtttgaatcccactatggacagtgagctcagccctagaataatggataaccatggacaacacaagctgcttcatactgttttcctgcttatggggaagagtggatcctggaattacagaagagaattgagcattatccgtggagaacaaatgcttaggaatggcataggagtaggcagggctggcttacagccaagtgtactgagtgctaagtcagtgacttacccctctctcccctagtttcccttccacacagcctcttacaaatcagctaattacagaagaacattcatacatgagttcttattttattaacaagtgtgtgttgagccctatgaagatgaggcacattgaaaggggttgattctacagacagaaagataacaggttcaagtttatgcccaaggacaagcacacttatagttctatagttctatagtctagtttataagaattcatacaatctgaggtctctattttgctattgcaaatgtctactttatgtgttggggtgtgacaaactgttttagcaattggtctctcgttctaaatgcaaaggaccttctcagaccatgctaacctggtgacacatcctaataagttgaggctgaatgagatcttttgtcacatctggttactcaaagacatgatgtcctcactccacaggccttgtgctattgagagaggagctgaagtcacacataaataatttaggctcctccactgcatgaaaagcatctgtttaaggagctgtcaagctgtccacctctctagtgaaatcatatttactttattcatctaaataatgtggcttgtttgccttctgtgtgaaattgtcttgcactgtttctcattggtgggttttatgggacagcatatgattttctgtgcatccatatgccactctacctctgggaatggaatggcttcttgttcagtagttttgattattatagccctttatagcttatgagtcattgggtttactcaaaatgtccagctcctcattctcatttttttctctatggcccagccatgcccgtcctgaaaaatttttaaaaaggaataataaaaataaataaataaaagtcatgtactctatatttcatttccaatgagttgcttcttgtttgggtaattttttattgtattagagacaaggccttactctgtcacccaggctggagtacagtggtatgatcatagttcacagcagcctccaactcctgggctctagtgatcctctcacctcagcctcccaagtagctaagactacaggcacacaccacctaatctgactaggtttttattttttctaaagacaaggcctggcaatgttgcccaggctggtctcaaactcctgggctcaaatgatcctcctgtctcagcctcccaaagtgctggaattacaggccaccatacctggccttgtttggataattatagcaataggagtccaccgaagtaagttgtgtttttttagttatttggcattctcacacttggatgctcagaaacatgtgagcaaatagcactgaatgtacccacaattatgtcttgtgctcagtttgtaagtcactattacgtaggtgagaccagagcagttactgtgaagtggaggtagctgcatttaagactgtgaacagcgcatcaagaagcacacaccacaacgtgtgtaatgcccctgccatgatacatcacttcaatctaatgatgagaaagcagatgatcccaattgagagacagtctgcaaaataactggcctgtactcttcaaaagtattaacgtcataaaagaaagacagatagactaagaaactcttccaaattaaaaaaagaaatgacaaccacatgcaacatgtgatcttggattgaactttgggccagattttttatttttttttccataaaggatgctattaagacagttggcaacatatcagtgatgtctgtaaattagaaaatgatatcacattagagttaactttctgatgttgatacttatactgccttgttcttagaaaacacacacacaccatctacaacttattctcaaatgattcaccaaagtaatacgtatatgtaggaaaataattttttaaatgcagtaaaatgttaacaattggggactctgggtgacatggctatatgagttattttcactattcttgcaacttttccataagtctgaaattatttcaaaagtaaaaaaattactgctaaaagaaaaaatgtgtacattgatgcaaaactaacattgaggtctctccctctatgaaatagagctgggttaaactttgtcaccaacaatgggtttctgtcccagctctgccactatagagcagtgtgaccacatccacataattcaactttttgaacctcatttttctcatctatgtaatccagatgtcaactagaaatacctggacccttgagatgtagataagatccactcaaatccccataatgtaccctgtagaagtcttaacccttcccaatattcctttaaattctaggagtggagctagattttcgttttacttctggatacagttttctacttctaccaaaactttccagttaataaattatgtctccttcctacccaaacaatcattcttcacaatggttactcaagtgtaaaattcagccaactcccttgatttcccttcaccaaaaaactcttaccattcacccaaggcatctgtgactagaatgtattttcctgaagatgtcacaggtgccaggaggggatttatgttgcaaacacaaagaactttaagtaagcacttgctttgaggagtcatttcatcccctcatcactgggcacgggcggtggcctcttcctgcccagcctcacatttcttgccagatcctcgccaccttcttttatctgccccttggtttctttagtatctcctcctctcatgggtgtgggcagattcttcccaggcagagcaggtcagatctccttgctctctaggcacccatgacctcaggtacccaccaaccatcacagaattatcccaaatagagacagtttcctcccgaagaagagctcagatgattacattctcaccctcagagtctctgcaaagtgagacatagtgctagatacacgtggaggtcatctccagtggaaatatgctgagattctatgaagtgcacctgctttaaaaaaatggaaattactttttcaagcagacagatatcaaacacaagttcctttcctctagccttgttatctgtgtggaatttaatagggtaccaataaggtttcactaacaaattacactttatacgaccttgccaaatgcagcattcttgtgggttattctagctttttaaagggatatcttgcttgtgaagatactagcatgtaattttctagcttagacatctacttttcacccccttttctcctttatttagaaataactctgaacccaaagctgatgtttgggagtagttaacttcttctcttgttttctatagctgctccaaagagcttggacctgactacagaccaaagtaacagagaatgctagcctcatctgtaattgataggatttttttttttgctagaatatctgagagtatttttacctcgtgttcaatctcatgagtttcttttcattccatatctcttatgatgtgccttctgtcttgtgcttagcagagtcctagacagctcagagctaacaagtgcaatgtgcatcactcattggatcacaaattgagtttggccagcacaatgctttcaatctgtttgacttgtggaggagcacgtaccctccagtttaccacaatcctcaccactttctattgtcttttacctgattcgcttagttagacagcctgcttgacccccaatatattaaatgtcttaccaatgcccaaagaactccataaccttagtcatccacactgaatagcacaactacttaataactcttgctagaatctagaacctcctgatctttttaatttactcagcaggtatctatgacatgatactctgcacctaggacatgagcaaaaccggtgttgtccccatagagcttgcaatccaggcattccgaggactgtgttctgagagataattctttccagcataccaagataattttgaaagatgaatatttaggcaacatgtcagtacctcaattttctttttcatttaagattcttctgctccctactactgtattcgaaaccagcctagtggatggctcttcctataagcaagaactatttccttactataaagtgtgtacaatccacttggctgtgggttggagcggctctattagaattgactggggatattcagttggaggttgacaatgagaacacgacaaggcagatgatcagagaaattacagtaattactcacaatcagtcttcgatagtaagtcacaaaattaaaaaggagaatgtaagtcacaaacgtaaaaaggagaatgtaaaagtatgaaccaagagaggttccatgttcctggtttaacagtggaatagtaaatgcaggatatcctccagaaaatgcctgaatgaatggtgcctctactctctgctatggaagttagttgggtccaacgcattccatgggggacgtggtccaaagtggacctgaagagtgtggtctgtcccctagtggtcctaggctgtcaatcagactatcccatccttgcctgggagagcagctgttgtttcactgatgataaataattctgcttgaaaaaaaaaaagtggtttctctttagtgatggaaatagatacttaatttgtgttttagattagacatagtcactcttatgttgttgataattaagaaataaaatcactctggaagttgttcttctctctccctttgctctgaagttgaaactcaggcctgtctattaggtacctttagaattatcactgagatcattttaccttgcacacaatccagggaaaccagtaatcatctctgggcagatatcagtaatgtgcaaaacccatttcctacttgacttggaaggagaaagaaatgttaggaagagtgaaaaatgaatggggaaaaagaacacatcagttcttctccacatggtctctcatcctccagcagcctaccccagacctaaattcaaatgagcttccctttctctcccatccctactcctgggcatcatgttctgcctataagagattgcatgcaattgaaggaaataaagaacggtctctgagaaagtcaataaaatgcagagcttatccctgttggtaaaattcaggtccccaaatgaaatggacaagcaattatcaactgagccagttttcaatccttggtgattgtttcgtctgccagtttttgtttcttaaacctcttgacagcagtccctcttacaaataaaattataaaaatcctatatagcaaatgatgtccagtgttctaccaaactagatcccgactaagcctgactgaggaccatgaaaaccagcacagtggacaaacacaaagaaagcagccaaaggaaaagtgaagagtctgatccgggaagccttaactgttctgagggttctgaatccatttgagaatctgtaataagcagtagactctcctgagaacaagcgaatgcacagatgcacaaaatttggaatggaggccatgccaaggtcacagaccctctggagcatctacagattccctaagggaagagaactctagtgtttaaaagaagcaggaaataggctccatgagaatttaacacttctttttatctgttcacaattggttgccagttccctggagttccctactgctgggaaaatggagtgtgtgggttcagagaggtgctatagcttggagccatagttttcaatgggaaaaggaagtaagaggaaaagaaagaagacaatgagaagtgttgctgagatccatacatttttgtggcataatgagaatttctaaaaactctgcaagtctgacttagcagcattattatactgtcacccagcctgaatcttcaagctgacaatttgctgcgagttcttcattcacttctttttctccttccttctggaaccatgcatattttgccttaagagaacaaagtgatgatataaaaaagggtgtgtgtgtgtgtgtgtgtgtgtgtgtgtgtgtgtgtgtttcaatgaagaaaacatttcaaaacatactaaatgcccgcagtatgagaggcttcttactaggatactcaggtgaatgtttgggaatctaccactgtgttcaatatgtctttgctatttgcaagatttgcagtctacttaagaatctcaggaatgcatcgatcagccttacatccttgaggtctgtgtaggcagcaagtaccttatactactgtaagtcacatagcatctgtctttctctccctgcggtggagcttatgattgcacaaagctcttaagcagctgcttctcagatgctcagaagacagtggatcttgggtctgcactccaaaagcaagagacaaaaaaggcccagaaaaataaccaatgcctacaggttagtcttttgttaggttcatgatcagtcaatttacctgtttattgcataagagtaagctcgtcagaggttcaaattttagctttatgagaccaattagctccattttctttcatagccaagaaagaatcccaaagaatccagactcaagggtcccaagatcacagcagtggggatgtcacccatcaacctggctgtccttgagtcccactcatctccatcaggaattccaggccaaaatctcatggattcctagtcatggttacaaaggggctgggacgtagagtaggaccaccacacaagcagtgtggatttacactcaggagagctgggatttctgcagagagctcccattcatctggtcaggccctggcaccccctgagccacagtgtcttctctaaaaaaatgaggcagctagaccaagccaggtatgcaactcagtagcctaaggtaacacaaccgtggaaagggagcttagtgtgtgaccataggaagtgcaggggtaggtgggttctgatttgaaactaggaaatacatgacctttctgaggtcattcaaatttaaattttaaaatatttttacatttttaacttgcatcttggaaataatttagactttaaaaatgttgcattaagtcgggcgcggtggctcacgcctgtaatcccagcactttgggaggctgaggcgggcggatcatgaggtcaggagatcgagaccatcctggctaacatggtgaaaccccgtctgtactaaaaatacaaaaaaattagccaggggtggtggtgggcgcctgtagtcccagctactcgggaggctgaggcaggagaatggcgttaacctgggaggtggagtttgcagtgagccgagatcgcgccactgcactccagactgggagagagcgagactctgtctcaaaaaaaaaaaaaaaaaaagttgcataaatagcacacaggtacacctatgttcatggcagcattattcgcaatagccaaaaggtggaagcaaatcaagtgtccatcaacggatgaatggataaaccaaatgtggtatacagggtggaatatttaaccgtaaaaaggaaggaaattctgacacatgccacaacatgatgaaccttgaagacattgtgcttaagtaaaataaggcaggcaccaacagtcaaatactgtatgattccacttatataacctaattcgagaaatcaaattcataaagacagagtgtagaaaggtggattccagggctggggggggaatggagagttactgtgcagtaggtacagagtttcagtttgagatgattaaaaagttctggtaatggataatagtgatagttgcataatgtgagtgtacttaatatcactgaactattcacttaaaaatcattaaaattgaaaagttgatgttatatatatttatcacaataaaaacattacttttaaaaagaagcagagtttccatatacccttctttattcagcttccccaaaattaacgtcttaggtaaacatagcaaaattaccaaaggcaggaaataaacattgatataatactattagctacaggccttattcaaaatgttccagttgtcccactagtgtccttttttctgatccacgattcaatccaaaatatgattatatttaatagttatgtctccttagtttcctctaatttggaaaagttctgcagctcttttttgtcgtttatgaacatgatgactttaaagagtactggtcagttatgagtttgtctgatggttctacctgaataaatacacgttatgtatttttggtgagaaaatcacatgaacaatgtgcccttcttagtgcatcatagcatgactcatcactggtgaagttaacttagatcgcttgggtaaagtggtctctgccaggtttctccactataaagatacatttcccattgtttattattgtatctcacctattaattttagcatctattggagatgtttgccggccacaattactattattatgacattttctgaatgatgatattcaatgtccatcatttcttctacatttattaatggcaattccactgtaaggaagagttttccctgcacctcagtttacatttaatttcttattttaaaaaaacactaaaacaagccagaatcatggtaagatatgttcctctgatacccactggcacttaacaactccaaattttctttctagtgttaaaaattctaagttctaggccagatgcagtggctcacacctgtaatcccagcactttaggaggtcaaggcgggcagatcacttggggtcaggagttcaagctcagcctggccaaaacagcaaaacctgatctctactaaaaatacaaaaattagccaggtgtggaagtaggtgcctgtaatcccagctactcgggcggctgaggcaggagaattgcttgaatccaagaggcgaaggttgcagtgagccaagattgcaccactgcactccagcctgggcaaaaaagtgagactccaaaaaattaaaagtaaaaaaaaaattatcagatccataatgcttcctgcaataagaaacaaaaggtcaaatttcatactacctgatagtgttcaaagtagaaagtttttggaaagcaaaatacagcacacatacattttcttcctctcccctcactttttttattttattaaatcttaatattatccagagtatatcagcagggttaagtagagaaaacatttaagaaccattgagcctggaattatcacacgaaatatttatgttaaatttgccatggggaatatggcttttagtgaacaggaactaaatcacaaaagctacaatgttctaaaaaatttttattcacagaaaagacccctggttaagttggctatgccttgaagatcatccagtatctgctgatctgagtccaggcctgtccccctgtgccagggatgtcccttgagagcctttatctgagctgctccaagacggtgtcatcagttgacagacagaaccaatattattgtagagttttatgttaacacagctgtgaaagctgaagaaataaaacttttttttcagctagctacttgtttctgtagtccattgctgagtaacaaaccaacccaaaatttggtggtataaaacagcaattttattatactcatgaatgtgggaatttgtaatccaggcagggcacagtggaaatggcttgtctgtggtccacgatgtgtggaggctcagttgggaagactcaacagctagaggatgactggtatggctggagttggaatcatgtgaaagcttcttaatatgtgcatttaacaccataaatgggatgacttgaaagctgcgctcttccaggattgtcaggcaaagcactacacatgcttctcaatgttgcctgggcttcctcataacatggcagcctgagaggagttggacttcttaaattgtaggtcaggactttaagagcaagtgtgttccagggaacaaggcacaagtctaatggccccttatgacttagattcagaagtcacatggcatcacttccaccatactcgtaattaaagtgatcatgttccccagatgcaagggctggaatcatggacctcatttcttgatatggggagtgtttaaaaaaaagctgtggctttaaacagccacactcttcaaaattaaaacactagaaaaatataatttttaacagaagtggaaaagagtctcttaagctgactgccctcccctttctccaaaaagtctaagaaatattccccaagtatccctctgattgaaataacctctcctttgggtttccatagcagcttgtgaataactctgctacagcacattctattctaacaataaaaagagtaacttatgcttgagtgcaagatattattccaagcacttttcatgcattatctcacttaattcccataacaaaaacattttataagtaaaaaatctgaggcccacaagggttaactaacttgccaaaggtcatagcgctgttacgaggaagagcgagaatttaaaccaaggcaatctggcttcagaactcatgttcttaaaccactccaccacagagtactgttaatagattgctgtgtgcaaatcttccttccctgtgaattgtgagctatttgtaggctgagaccatatcatcattacctttgtctctccagcaccaaacacagtgcctggcttatgacaaggaacacaaaaatacacaatagaaaaatgcacaaaagagaagaaactaaaatgtcaataaacatatgaaaagatgctcaaactttcaaaacaattaaaaatattcaaataagatgaaacattttgcctataaattggctgcagttaaaatatcattaataaatgtcaatccagtgttacttagagaatgggaaaaaggatatttttattcttatttacttttcggtgaatcttggaatatacaaccttatagggaaacttttctgaagtatctatcaaaatgataagtgttcataatctacgacttagagattgaattcctaggatatatcctacaggaaaactctcatctatacaaacagtgataatcacaaagctgttcatcatagcatttttaatagcaaattgattaagatatagttcacatgccataaaatttatcctctaaaaatttgcaattcagtgatctttagtagagttgcaaagttgtgcaatcattaccagtatctaattttagaatatttttaccacccttaaaataaatcctggaccattaacaatcactcttcatttctgtcccctctcagccccaggcaaccactaatctaatttccagctctatagatttgtctattctggacatttcatataaagaagtgatacaatatatgaccttgctgtcaggcttctttaacttagcattaagttttcaaggttcttccgtgtttttaccatgtgtcattgcttaattcctttccatttagaaataatattccattgtacatatatatcattttgtttactgttttatcaattgatagcaatgtgggttgtttctagtttttgactatcatgaataatgttgctataaacatttgtatacaagaatttgtgtaaatgtatgttttcatttctcttatatgcacccgtacatggaattgctgggtcatatgacaagtctatatgtttaacattttaagtaactgccaaagagctttccaaataggctgtaccattttactatcccaccaacagtgtatgagggttcaaattcctccctatccaggtcaacacttgctggtttgggtgcagttgggcaggggttgattttacccattctagtgtgtgtaaagtgatatctcatggttttaacttgcattctctgatgtctaataatgttgaacatctttctgtatgtttataggccatttttacttcttctttgaagaaatgattcctctaatttgcacatttttaattggatttcttgaatttattgttgaattgtaaacatttttaaaacattcctgtgcgagatccttatcagagatatgattttcaaaatttttctccaatctgtgggttgtcttttcgtttccttcgctatttcttttgaagtacaaatattcttaattttaatgaagtacaatttatgttcttacacttttggtgttgtatctaagaaaacattgcctaacctaaagccatgaagatttatttatatgttctattctaagagttgtacaatattagctcttacatttgggactactaatcattttgagttaaattttgcatgtggtatgagataggaatccaaattcatttttttcatgtgaatatctaattgtccaagcacaaaactgtgcttgaacagactattcattctcattgaattgttctagcatccatgttgaaaatcaattgaccataagttgattatcataaattatttctggattcagttttattccattaaactactatatgtctctcctatgccagtaccatactactttgattactttagctttgaagaagtgttgaaattgaaaaatgtgagtcttccaactttgttcttctttattaagattattttggctattcttggtctcttgagtttacatttgaactttaggataagcaaaaatgacagctgagattttgaaagtaattgtatagaatttacagataagttagggagcattgccattttaaaaaatccgtgaacatgagatgcttttccatttatttagatctttaatttctttcagtgatgctttgtacttttcagtgtatacatcttgcacttcttttgttaaatttattccccagtattttacttatttgatattattttaaattgacttatattcttaactttatgcttggattgttcattgcttgtgtatagaaatataattgattttgcatgttaatcttatattctgcaaccttgctgactcttttgtcaattctaataatttttctggattcattataaatttctatgtacaagatatgtcttctgcaaatagagatagtttttcttctttctttccaatcttgatgcctttatttctttatcttgcctgatggcattagctaaaatctccagtacactcttgaatggaagtggcaagagcagataactttgtcttgttctggtcttaagaaaatcattcagcctttcaccattaactatggtgttagctgtgagtttttcatagatagatttatcagattgagaaagttccctttcattcctaatttttttttttttttgagacggagtctcgctctgttgtccaggctggagtgcaatggcgcaatctcggctcactgcaagctctgcctcccgggttcatgccattctcctgcctcagcctcctgagtagctgggactacaggagcctgccaccacgcccagctaattttttgcatttttagtagagacgaggtttcactatgttagccaggaaggtcttgatctcctgaccttgatatctgcccacctcagcctcccaaagtgctgggattacaggcgtgagccaccgcacccagccttcattcctaattttttaaaacgtatttattataaaagaatgttgtattttgtcacatgtttttctgcattgggatgttcatgtggtttttgttatttattctattgatatatttattatagtaattgattttcagatgttaaaacaactttgcattcctggggtaaatcctacttggttatgatgaaaatcctttttatatgtgactggattcagtttgctactattttgatgagcatttttttgccatatttgtaagggatcacaatctgtagttttcttttcttgtggtatttctgtcttttcttcatgtcagggtgacacaggcctcaatgaattagttgggaagtgattcttcctcttccattttttggaagagtttctgaaggactggaattatttatttaaacattagtagaactaatcaggattagtagaattcatcagtatttattttgcagaaagttttaaaattactaattcaatctctttactgctattgaggctctctgataaatttttaaattctgttatgtactttttagctccagaatttctgtttggttctttcttcttattatttttatctctttattgatattctttatttgatgattcaccattctaacactttcctttagttctttagatatggtttctttgaacatatgtctgggtatagtgatatctatatataatatcatgtgaatatttatagttatatagtttagtctttgtctagtaagtccaacatctgggcttcctcagagagtttttattattttttcctctatgtgtggagcatatgttcttatttctttttgtgtctcacaatttttcttgaaaatttgacattttaaatactgtaatatgacagtttggaaaccagagttacctctccccaggttgtttgttgttgtttctaggttttgttgtttttactattgctatttgttttcctgcacccccacccctgtttttttttctttttttttaattatactttaagttctgggatacatgtgcagaacatggaggtttcttacataggtatatacgtgccatggtggtttgctgcacccatcaacccatcatctacattaggtatttctcctaatgttattcctcccctagctctgcaaccccacaggccccagtgtgtgatgttcccctttctgtttccatgtgttctcattgttcaactcccacttatgagtaaaaacatgcagtgcttggctttttgttcctctgttagttgactgagaatgatggtttcctgcttcatccatgtccctgcaaaggacatgaactcatccttttttatggctgcatagcattccatggtgtatatatgccacattttctttatgcagtctatcattgatgggcatttgagttggttccaagtctttgctattgtggaacttaaataaatttacaagaaaaaaaacccatcaaggagtgggcaaaggatatgaacagacacttctcaaaggaagatacttacgtggccaacaaacatatgaaaaaaaatgcaccaccactggtcattagagaagtgaaaatcaaaaccaaaatgagataccgtctcacaccagtgagaacggtgatcattaaacagccaggaaacaacagatgctggagaggatgtggagaaataggaatgcttttacactgttggtggttagtgtaaattagttcaaccattgtggaagatggtgtggcaattcctcaaggatctagaaccagaaataccatttgacccagcaatcccattactgggtatatacccaaaggattataaatcattctactctaaagatacatgcacacatatgtttatttctatttgcttatttaatgtctttctggactaattctataaagtctgtaatttctataatgtgccattgaatctgcttggttaacttaatagttagccaatgacagggcagaggttttcttaaagaccttgaatcaataaggctttttgtttttaccctttgctaaggggctctgttgtgtatatcgggacatatcctcaattctcaagcaggcagttttaaactctgctatggccttcacctcctgtttttaaagagacatcaagtcaactaaaggtgagcacttagggccttcttagatatttcctggttgtgtgtacagctctgcccatgtgtatggccttctaagtgtccaggaatatattagagctttgtaaagccttcaatggacatcttattccctagattcttttacaaaggtttttgtccagccttttatttgccccagttcatattgctacttcaggaaattgcaaccttaaaaatttgccactgattatttttgacaaattccctggggagtaggacttttccaactgagcaaaccctgggacagatcaaataacaacaaatcctataaatggaacttttccagatagcttccaggcaattatttagggatggagctttttaaataactctaaacccagtctgcaccctctactatgtatttggctactggttttcacagctgctgtgattgtgaggttgttcatgttcaaagatgctgcagagctatgaagaagaggatggtcatagggcaatctaaaacagcacagagtttgccattatcactgagattcaacttttttattgaataaacacccttcgggttgctgcaaacctcttgtcaatttcctgtgttctgaataagttgatttggcaatttttttcagagttctatttgcttttctatagcagtagatttttgaaggttcttattctatcatacctgaagtttccccaccccaacacacagcattatctttgaatgtaaaaaaaaatggaagcatcttaatatgcatcaataatggaaaggctaaataagtcatggtatagcccatgtaatggaataatatgcagccattcaaaagaaggaagtagtctaggtgatgaagtaatatgtaccataaaccccatgacacgtgtttacctatgtaacaaaccttcacatgtacccccaaacccaaaataaaaatttgaaaaaaggaggtagtaagtgaaagtctgtgatagcatctgagtgacaagagaagaaccactttgcataatatgtagtgtgtgtgtgtgtgtgtgtgtgtgtgtgtgtgtgtttaagcaaggaagaagatctaaaactcactcatttgactattaaggaaataatcatttgctcttacaagtaggtaggcctagaggaaaaaaaacaaaaaggtaacctaactccaatactgccaaaaaagaaaacatgaagaatttttactttgttatctgtgtttttcggttttctaaatttactctacattttctttatattaaaaataaaataataataataaatattctttaagaaatatttgagccacactgaggttctatgtgatctaaaaatctcagattggccccatctatgttagaaaacttttctatcaaatcaaccacatctgcttcccttttcttccaaacactggatggcaacacacacaccaaaactttcaatagccaatactttgagtagtggaatgctttttgatttagggactcttttgagaatctgatgaaatcatgtgtcctatttccaaaaaaagtacatatttacattatttgtctataatttgtaagcattcaattaaattaattaatcaggttaagaactgcaaacagcatgtcttcatcaatgtgaagacgtggagaaaagggagagatctgggaacttcaagcccctatatttatacagaagagaaaaagatgcccagagaggaaaccacttgcccacaatcatactgatggtaacagacctgagccacatccaggcctccaaactcccaggtcaaggctcttcccaccaagttaccttgaatcatagaacaaatgattggcctgtttaggttctccaagactcttagaggccctgtgccaaagacaacctctcattactgtgacttctctgactggttctgacctgatttcaaggatccttgagataggaaggtagagggaaaccagacctgccatccaactggtatttactaaatttagatgttcacactgtgctcagcctgataaaaggcaccaagggttcacagaaaaagcccaagacacagacagacagttgaagatctgtcacagacagctatgaagacatgactacaaaacatcgcagcataattctgaagcaaccaggtggtacctggggtatgcacactagaccaaggaaggcaaggagaatctgatgcaggtgtgaatgtaaaggcaaggctccatggaaaaggaaagggaatcaaaggatgtgcagaaagttaaaaaatgggggaaagaatagaaggtatttggggagcaggaggagagtggacaccacatgaacaaaggcaaggagaagagaaggaggacattgatagggaaatagaggaccaggactgacaggaggtttgccagtggtttccttgcatacttccctaccccatggagcccctgcaagcagccccagctttggtgtccctgtccctgggccaaccccagaagctaactatgcctatgtctacttgactctccacagcttccctttgctgaaggtctgtaccacttttatcacaatggccttgcaaaggccaagagaagacgcagcctacaccacaagcagcagctggagagagaccccagggtgagttttccccagaaacctgcctcccaatctctgctgccatggctgagcccaccaagggggtgtggaggggctggcagggaattttgaagtaaaggcacttaatgtactatgatagggcaaatgaatgctttgcagagtcatatcagggactctctgctcctttgtctctgcataataaataatcacaggcccctttgtatggctggaggaagaggaaattgggataccacccttttactggctatcttctcctgagttattattgggtgaggacttcgggttgcctgggaacatgttttggcctgtgatggatgggaagacaacaagcagtttaatgagtcattttacggaaggtttctactggtgaatccacatgctcagaggaggttgccatgccccacgttgtgaacggaaagaatgagagagccagtcagtgagcagctcacagcaggcagtggacttctcagtatccatgcatgactgtggccatgagactatctcagcctttctttttatcctatattttctagcactgatctaatttgccttcatgtctcagctgtctacttgatgttcatcacccccatttttttaatcttcagtctttaccttgctcttggactccaggtcccattttctactccctgtgatggctcaaattcaactttcccccaatcaaacatatcatcttagcaacaaagtggcttctctcccagtgttcccacttcttgcctttcagaataggacctttagtaatcatattttccaccatcccccatacctacacactcatccaattgggtagattctgatttctgttacaagaatcactaggaaggaaagtatgtaataactcagacaagttgttctctgtacattgaaggcagcgtaacctctttctcaggactctcagggaccagctgatgaaaagcgtgtcagatgtttgagttaaggactttcacatgagattcttttgagctgatagaatctgaaaactcattcttgtggggcttttcatgtgaacatttccctgggtttaatttgggcttcaattaggaattcagataaaacagtctctcagcagattgccaaatgacaggccacaggcaattttttctttaacttctcaagagttcccaccttctctaaagaggaatttctgctctaggaagccactttaactttacttttgcagtaacaattaagctgcctgtgctgccagccaaggccaagtattcttaaaggatctgtcatagaagccggcaccaagacctaagggagaagctctctattctatgtgataataaccttggccttggctataccaattcattacctggggatacccttgggcagtcatatggacagggatcttgccctgaacccaaggtgggcaccagtagacaaagatcaccctggtgcaccgtgacatttgtcttccctacacttcaaccctatgccataaccttgccatttatggccagttgttttccttttagttatgtattttcttaaaagtcccattggctactcttcttccacgattaaaggcgttgctccaagattattcagaaacatataaactgggggcagaatgaaagagacatttaaaaggcttgggctgggaaagagaactgaggcacagtagaactcaaaagtccctgtttggtcagagagactatttagcaccactggcctgagcttttcccattctaacacatatgatctctgaaatgctgattcttgaagtatacagtgacacttttaaaatataaaatgggactaattgggtaataaaaagaagagatcagtcactggtgattctaatcatttgtctttctcttcaaaatattatctgttatcaccaaaaggggtgcctatttccccttcattatctattataaggatccaggtagccaattgcctctatctggtagttgtaaccatctgccttgcccatgaagaccaacagaaaatagcagaaaaactaaagaagaccaagtatcctatatcttttccctatcttgtcatcaaggttaaatgctggggatgttgtcaataataaactcattctaggaaaataaataaagcacaaaaatctcataatttttttcaaaacgaaaaaaaaaactgctaatgatgactgcctttttccaaaatattagattaaggtctgagtctttcctgcatgatgttctcgtggttgtctaattttggcatctgctgatagaaaaatagagtggcaactattctgaaccaaaaatcattgactatgaacagtgcaaagatagtaaactaaagattctgccttgtgggtttatagctgttaaacaaaagggtaaataagtctagagtaggaataccccaatttgggggttctcaaacacattcaaacaggttgcaaaaagaaaagtaaatgaaagaaaaagggagagaccaagtagccagaaggaggtccaggcttttatgtcttacatagatgtggcaagttatgctttataaacacagaatttaagagtaagttgttttagcattccctgaaatgtactgtctcctagaactgctaacgttaactacggttgcagccccagcccccagcttccttctccttcctgtccctgcaccacttcccagcctgtctcactcactgtctacaggcttgtggtaaggaacacaaagcccagggagggtggtctgagctgctattcgctttcagggcttcatctactgaggtagctttttgaccaaagaaacctccaagctctgctagcaacccaagaaataaaaaagaaaaaggtagaaacccaaggtactttttggctttttttgacttcagaccagaaatttcaatgatgtttgcctctcatgtaacaactaatttttatgctaaaaggaaaacagaaaaaaaaggactagaaagagctaaagtgctactttccatgtgctcatctttgttcatcaatatgcagacaatagctaagaaaacagattctgatgtagactgtgttaaagatgttcgcttctctttccagttcttcctgctaaaagattagctgactgccaagtatcatcatttagatgctaaaaagcaaaagttgtgtcttgtttatttcagtaatatctttgcacagtgagatgttcaggaaatgactgagcatgtcaaatgaatgaatgattactattttttcttcagggttttaatccatgtaatagtattgcccttctcattttatattttcctccgtatcccaaaatttgtctccattaggaaataaaagtactatatagtcttctccctagcacctcttttacatacattcttaattgtgggtaacagaaaccaatgactgtttcattacttccaagttttatcacaaagaatcccatgaagaaccagttcttaatttccaaaacccaatctgccttcttcctaatcatattcacagtcgtggtacaggcaccaaagcgggacaatgtgtctggaaggttttgataatgaaaataatttgaagaggtaataaatcaattcaacactgaaatgaaataatgaaactaaaaataccttctcaacatcagggtcaaaaacaaatattttatgcccaaaagctctgtaagatttgttcaacattagctagaacaataccaacaaatcttaaagccaaacctatcttcagtccctggtcaacatatcaaaacctcataaattctacaagtacctgaaaagcttccgaagagtagatttatttaagataatatttgcttcccagctctgtcaaaccatacttgcacatctgaaatagaatattaaagtgaaatatattttaaaaacatgaaggactcataattctatgagtaacacacactagtcttatggaagcaaaataatttaattaaaaaataacctgaacttcatttcttgagagaggttatatttgagaattaaaaacatttatttcctttactaagcaattttactagaccatacaattattcctcatttttaaacatgtttcagttttacaagtcagaaacttctatcagtccaataaaaactttccttgcttctctcatctcaaagaatggatgatatttcctttgtgttctatatttagaagctatatctttctagcttctttcttatccaaatgtatccacatgtttaataaccataaaaggcagccacacgttctggtagtgatctgtttttggtctttaagggtctattcttgaatatatctgtggagttttcaagatactgccaataacccacaaaatttagcttcactggataatataatcacttcagaaatctcataataccactggagcaaaagaaaagtttcctattctttaaaatcaactggacatgatttatatgatttgtgtgtattgtggccaaactcttctttcctttcaattatagtagttaattatttgattatttattataaattaaaagggaagagaagggaaaatgctgttatcttttggaaagtctattttcttttctttctttctttcttttttttttcctgagatagagtctcactctgttgcccaggctggagtgcagtggcacgatctcagctcactgcaagctctgcctcccgggttcaagtgtttcttgtgcctcagcctcctgagtagctgggattataggtgcgtgacaccacacctggctaatttttgtatttttggtagagatacggtttcaccatgttggccgggctggtcttgaactcctgacatcgggtgatccacccgccttggcctcccaaaatgctggaaagtctactttcaaattgaaaatgtcacggagaaaaatctcctccccctcttttgtcttgaccacaccttcctccagtggataactaatggaatttgaggtgacctctacttaccatcaccatgactgcatgagagcctcacagtctgggggctgggtaaaaatagaaattagatagttttagtgcctttttaagggatttatacccaaagaataggctgttttttatccttatacttgttaactctaagaggataaggtctgaggttgtgaggtgctgctctgagaaacatatagaaattttccaatttatcttccaaatgttttattgaaggaaaaaaataaagcatatagatttgattatattttacttattaagaaacatagtcatggtaagtttattaatattatgagaaacacaaaagggaaaatagcattttgtatttttctagaactttttattctacagggcatttgtggctgctatttcttcatattctcatttccttgtagcataaattggacaaagggtggattctgagttccccaaattctcatggtttgtaaggagacttaaccactccatggtgctgctctacactgatttgtattccataattttccctgctcctctgcacaaagagaattatagagcaggaagagtcttaaggaaacattgattcagcccttgaccttgaagcattaaaatataattttaccattgaggcaaaatagacccagagagagagaaggtgacttccctggggccacacagctataactgataggaagaaaataaaactcgtgactcctctcaatacgaagtctgatttaaataaaaaactaagtgagaattgatactgcttatgaatctgtcgttctttaaacaattgtttgcactaattagtcactgaattttctcaattaaaaataatgtgctgaaaagaagtgaagttgcctcctgagtttatgtcacttatgtgaattcagtgagctcagctataaatggaaaagtgaaaaagaagagggaaataaaaagggcggcacttgagctcactgttctgctcaatttgcttatgccctggagtggccttgaactgaaggcagctgagtatgcagttggcctcggttccctggtgaccctcacagtggaagcatttcacctttctgggggtgagcctgtagcatttaaagttaatacttttgatacaaaatatttcctaaacgcaagctgacttcttcatttgctgtgagaacaatgggacacgaccagggtccattgtgaaagggaaattccacccttgtgatgtattgagacacaatatcagtttctaacccttaaggagttttcaaagttaattttaaccatgcataagttccactttgcacactttagaattcactccctaaggcgtgattcttctaggagaaattaaacaaagatggggtcttcattttggatttcccagaaacagactctgagatgcagagttgtatgccagagacttcttggagagcaaggaagagaacactgggcaaagggagaagctgagcaaatgggctttcaacaggggcctcagtcaattttacaggaaactcagaaacaggggtggcccttcagagttaccccagtgtgaggcaaaggaaccggacctttgtgcccccataatgaccagttattggcatgggtactccctcaaaggaaacatagtcttaggtaaatcacgtcctgctaccaaaggcaattctcagtgaaagaaactctgagccacatttagcagctggaggaaatgtgtgagggccctaaagaggaaatctggagagtgcaccacagttttcattacacctgccatgcccacttcactcaatttgtctgtaaattcacatttgattcaagaggcattttctgggatctttgacctttctggaagagtggacatggcttcccagatcaggagctctccgtgcccaatccagctccccatccacccctgctgcccttttccagagattgaactgaactaagaggggaaaacatgaatctgtaggcacatgagctggaccatattttgaacacaaatagtgaagccaagagacccaagtgaaacagtttctgacctagcctcccatctgtggccaaattcattttctagataacatgccaagaggtcagcgggtgtaaaccattcatgagtgatgcaagttgagagttacttgacagcatcaggaaaaggagaaatgcaatgggggaggtatgcataagaagcagggcagaggtatcttcatggatgccccaacctgtgggaaaaattcatctgttctaatcctctgctttcagaatgtggcagggaggactttcagcatctcctctgggcattgcagatatgcctggcttcccaactcaaagagctgctgctggtgctataattaactatttgtggggaacaggggagaattatttactacagctacagaaaggcacagggaaagctgctaatgagtaagcctggtttttttctagatgctgtttttttctagatgttcatttttaaatgatgggtactgttcgtgctgtcatgcttcctaaaggaaaagtgggaactctctgggaggcatcatgctagcaaagccagagatctcttggaagttttaactttctttgggagaattcttacaagccctggtatagagaaaagttaacacagagaaaattggtggctctgtatcgtctttacaattcacaaggtgaagagtctctaatggtgggctagcaaacctttaggacttcctgggaaaatcttagatgtttgaagggcaaaattctcctgatctgcctcacctgattccctccccaaccttccccaagatgcaaaaggaaatgcatttatatatccaatgtgtatatatatatatatatatatatatatataatgcatttatatagcctctattatatcttctaaaaatgattatatgtgtatgcttattaaattcataatgtaactctcttatttagttgttggctagaaaaccagcattcattcagcaaatagttatcaagtccaaactatatacagggcactcttctgcatactgaaatataacagtgaacaagacaaagtcctcctcccagggggcttgtatactagtggcaatgaaggagagaaacaaaaaacagatgaccaagcaattgtatgaatggtggtcaaaatgctatgagaatgagtagagcagagtatgggaagagggagagccatagaggggtgtttctattttataaaaagcatccaggtttggctagtctgggaaagtggcatttaaatatagacctgaaggagatgaggaaggtattcatgtggatatctggagaaagggcactccagacagaggaaccaccaaggaaaaaggcctggaatccaagacacacctggtgtgttccaggaacagcaagaatgcgagtaaagctgcaaaggaatgagccaaggacagtggggaaggagatgaggttagagaggaaaaataaagcaagatcatgggcgacatgataagctggggaaagaactttgaattgactctgaatgagatgtggcttctgtgcctatgggcaaataatagacaatggggtagaggtatggatgagggacaactggactagagagatccatgcaaggcgattgcaatatttcagaagagaaaagccagtggcataggccaggatagaagtggtggaggcagtgagaaacaaatcagatctgggagtatgttgtgaaggtagtcttcaaattcgttgatgcatttgctgatggattagatgaggaatgggagaggaagtgagaaggcaaaggtgactcctaagttgttggcctgcattactatagaatgaaatggcacttatgcatatggacaagatggtgagaggagcaggttgatggggagtggttagggaattaagagtttagttttaagcacgttaacatttgagatttgtattaagtaaccaagtggagatgatgtgaaatgaacagatggacttaaggatctaggagagaggtcagagttggagatataaattgagaggcatccatctattgttagtgttcaatgccaggagactagttgagcttacctacgaaatgagtgtagatatagaagagaagatttgtgggactgagccctagggtactctaagatttagaagtcaaagagataactggggaccagcaaaggagacagaaaagcagcaagtaatctagaaacaggatcagaggtcaagagaagaccaactttagccattgtgttctagctcgtctacattttaccatagtaacttggccatccctataattatttcttattagaggtatcaatgtttcttcacttttcccctctctgatctatttttcaaacgctttctcaacggatattgaaatacatggttcacacatgaacttatgaaattaaaggatactgatgtgtttgggctgggtagtgtgctttaaagcagcaggaggtcacatttgactcagaatgttgagaatctagctcttaaacctgcaatcccaactaggcactaactcagagccaagaccgcgttctgcaagctgccaggtgaagttaccaggaaacagcctctgtttgacatgtcaagggaagaacctgaattgggcacctctttttaattttgagaaactataaaagccatgagaaagatcatgtttgactgtaaaccaaaaagaaaaaaccttaccctccaattaaggaaaataaaattataagttgttgttgatttaattctgatcatattttcatagatttcagaaagatatagtttttaaaagaatttcctgttaagattcaaaattttttctaggatataatttctcactcctcaaacctctgcttcaaaataaattttattcaatatttagcataaggagactataaagttccttaatggtgacataaatgaacagttataatcgtatgtctatctagctactgaatatttctaagataacgttttgtgaggcaaaagtggtttgaagttggtgatgcctcaaaaaaaattttttttaatactctttagaactctttctgggtattttaaaattggtttagctatttttcctttttgatgcctattgacatgtttgtgatcacatctctttctataaacaggtttcacggtcttaaagccaaaccaagggaattttgaaaatgagtggaattgaattcctgccatttccagtaatttcaaagctttatgggttcaggagaggataacagtgcagccaggtctagaaatgagtaaacagcagttaggcaaagagattcatgtctgaataacaacccaattgctggagtttatctaattggtttgccattatctgtaccaaaaacattgtgtttttcatcttctctacgatgagcatgtcccatttagcaataaagaacttattgcttgagagaaaacaggtaagacaaaatagttttccattccccctgaaaagggagagcagtccatcccaagtaaagaatagtttaatggatgttaatttttaaggacaacttagagaatcaacatgagaaagtttcttctcccaacagaagcaaagaaaagcaattaaaacctattgtgtggaaagagacccaaataattgtctattagggagaaaaggaacatgatagagtccaatttgaggtcattcttgagttccaatacttacactgacaccaattaactgtgctctccttgaacaaaccgttgtttcccccagtcttcagttctcttgtctgtaccatgaggagtgtggactagttagtctgtaaaatgccctctgaggtcctaaatctgagattccagggactaacctgaagcctctccaactggttaatatcaaagccacgactaaaacccagcaattctaaccagtttgtgatccttcctttacatgtctttcttttcatctgagaaatagggctttttctttaaaccaatgctataaagtgtttgcaagaactagcatttatatgttggtatcctcaacttatagaacacaatttcaaatcctgtactgttcaaaccaattcaatagtaccctaaaattccatttcttgtctcgggggaaatattagattatgagatagaggttattcatccacttcaaagataatagctcctctatcatgttttataaattgggatttggtttaagatttccctggtatcatgggtgtgaaggagtgggggtccttaaaataaaaaataatgtttgaaaacctttgatagctaaacaagttcgattctttagcctagtcaatcagtgtatccaacagggataacaagcttgatgcctacacaggccatgcaaataaattacaaattgaggtgggtcagttgtaagcaaaacagctactcaagcaagagaataaacggcaaaatgatcttctcctctgtgtgaggaacacaacagagagtggtggggactgtggtgaacctgagtgtacacaccctcttaaaaggaggaagcggattcttattctcagctaattgttacctccaataatggacgccctggttgccacatctacaattttgaagaaaagtagcaactaccaatctttgtaaagattcttttatctttttaaaaaaattagtgattaaattaaaatttcttaacacactgtccaatctaaagaaaatacatcatcagaacaaatttttccatgcactaccattttgcagtccctactctacaacaccccaggacaggatgaaacctgatagaacacctctatgactagtccgtgacttcattatttgccaaggtagtccacataaaagttcttccttaagggaattccaaagctacttccttgtagcgttggttcataatccacattctcctttctgaggccaaattaatctatcttccatgtgagaacccttcaaacatttgaaaatagttatcatgccccctggaccttcctagagtaagcattcttagttctttcagatgttttcattgaatttggcacttctttcccatgccttcctgattacacctctctgaacattactggagaacaatacattataacatccaggtctgctctgattatttcagagtagtattgcatgctcacttcccgtatctcccacattttaaaagctattcttctattagcacatcttaaaatcattttagcattttgtggaagtcatagatctcacattgattaatagtgaacctacaattagctaaaatttctaggttcttctaaaatacactcataatccatccttgaaggatcgaggtattggttctaaaacaaggaacctttaaaaaggatttattttttgaattttcatcttattagagttcattctgacctgtcaagattttattagatttggattcagtctcctttccactttcttgtcatctatgattttgatcagcatcaatatcttcaacagttcttaagaaaaaagttaaatagtacaaagaaaaatgacaaagttcagaaccctctgccaggatgatatgaatctattaatatagactctaaggagtatttcacactgaccccatattaaaaggaaattctaaagcacccaaagttctgaaaaatcattcaagttaaatgaaaaaacagtgtctcaccagggaggctatttgaagactgtttatatggcttaactccaacactctgaatctggttgatttgtgtgtgtatatggctctctgagaaatcagtttatttgccatggaacaatctaatttggtcattcacatgactaaaagtaccagaccaacatgttttcaatccagtcccttgaggcaatttgaattctgttgataacttgtccacacacctgctactgatggatgtttcgtcatgaaattttaatcagagagccaaaatcaatgggtaattgttaatttcaagggtgccaggtgacactcaagtgtagaccaaaccaaatttttataaaacttaataaagtgatttcctttaaatgagtaagtcaagatatctcagacatagattaattcagctaaggatcatattctccagagctgaaatattaactatcattgaacttctatcagtgcttccaaaataattattctaacacttattcatgtgacatgggcaagtcatttaaccttcactaattgtcttcattttatcatctctaccattaaataacaatgaaagtccaaatgactggaaataaattgccttaatttttaatccctatcatggaattacaatgaaagtgcaaatgtctgccaatacatgcctaagacttcaaagctggaagtatgactccatctaaagtacatgttaatttcacaaatacattataactttgccaaagcagaaaaggtgatagtgtcacctactccttttgcatcttcttagttctctacttgttttccttgcctgcccctactccatgaaaaatatgggtgtgaattaaatcagtgttccttaaactgtgttacgctggagtccttgggttttcttccagaacgttgtgaataataaagatattagttaggataaactagattacgctgcagtaacaaattaacttttaactcccaatggtttaatatacaaatgtttccttttcactgtgctacaagtcacaagtccagcatgagctggatagatttgattaatataatgctgttgaaagtttcaccatcttgaaacgccactatcctagcacatgaattccaggacactggaagagaaagaggaagtgaaagcataataagctctacccacttgtaaatgcctcagcttgaaaatgttacatatcactctgctcaccacccattagcgagaactaggcaaaatgaatgtcttaatgaaaagaagctaagaagtgtggttctcccatgtgctcaggaaggagagacaaactggatttggggagcagtagaagtcccttgcatagtgtattttttattcaaaacaacaataaacatgtgaataaaagcccatattctattattctgggtgatccttgggattgagactttcccataagttcagcactcatgtttataattgtattggcagcaatactgccatccagtctctggctattgagaaagggtgggatacaccccgggatgcttctgttgtcctaaaatgattggaacatctctcttcatgtgtgaccttctgcaatagggcctggctcctcctctatccataggtagagtctatttattcacccatgtgaaggctctgtaacattttatctggtagaacgtggtgggagtgatactgggccaattctgggcatagccagcccctacctgacctggtagcttctactccttcctcagagaagctaaagaattgtgattaccctgagaactccatgctgtgagtaggccaagccaggtggagagattgatataccgtggggagagagagaggccaaggagcaccaagataccagaactatgagtgaagaagccatctcagaagtggatcttttagccccagtcccaactgctgttacctggagacaaactacccagtcatgtctttcctgaattcctgacccaaaaaatcttgagccaaataaactggttgttttaagccattagtatgtggtgtaatttattatgcagcaatagataacaagaagacaaacgaattttcccagcagtgcagaggggatgagtggtggagaactgagtcatggcataaagcacattaaaatgaaccccaagacactacaccccagcagtctacagcatagtcacattgtgttttaatcagcattgcttctttggctattattgtttttgtggtgtttatatttaactcgtaaacttgtcttagttttatagttgtataggaaccataatcattaggagttgttattctatcttattttgtgcatattatttatacatatatatatatatatatatatatatataatgttgggcgactaatgaaaaatggttttcttataaaagagtccctttcttgtttaaatttattcgagtttaagaaatcaatgcatttgaaaagatctaaaagaagtaggcttttccaaagtataaactttggcatgaaacagaagcaatgcatcccttttggtgcagtgatatcagcaggtaacagcatacgtagtgagaggagaatcaaaggaagaattaggagttccgagttctaatcacagctcagccatttattgtctatgtgggctccaggtaaccacttagttttatggtcctcaatgtccccatctgtgaaatgattaatgacattacctgtgcttattacatggggttactctggcaatcaaatatgatagaaagaaaggttcgaaaactgtggacttttactattgttcatagagattcaggctagagtcttaagttttgtgctgacaaatctaaaagtaacctgactaaaaatgtgtagcaactgagtttaaaagaagctcaaataaaattatctttaaaaactcaatccaatgtaagattaaataggaaatacattggatttacattttctttgaagtataaggaaacgtgcagtctgctgggatccatcacactgcttggtctggaaaaagaggagggtgaattcagaactcttgtccctctctaaattcttgtaaccttctaatctctctggagtgtaaacttgtggccaagattttgagctctggataaattctagttttaatctcaggtccaccactcactcacttgccagttacataagtttacgttgttatttaacatctcacaaccacatctatacaatgtgggtaataataatattacttatctgaaaggttgatgtgagcattaaatgaaatgatgctagggtaaacgttcaaaagatgacagccatgaccaataatattttgttctctagcattcgattacatggtgactgatactgatctctgaaacttgcctatgtagtagcatttttgttcactgctgtcctttagtaattctacataccataaaaaaattagttatgcatggtggttttattttcatcttaccaaaatgatagtttacagttttaaaaatcaaatgcaagccttataattaaaaacagaagcattttgctccagctttctcaaatccctcagaggcattatccaccaattctttaagtgtttcttgtgctaattaactccacattttaaaataatatgtgtatgctgaaatgtgtggatttgcttcatttcagatgttgtctatgggctttcttctatggaagatgagatttaacttttaaattcaacacacacacacacacacacacacacacacacacataccatgtttatattttttctggcttttgaatatagatgtatcacaagatggggctaggttaatattcagtgttcatattattgtgagtccttaagtactatttacagctgagccatttataccaataacatcccttcctctctcaaacagctttttgtttccctgtagttaataatggccctgtgatgccctctctcaccactcctattcaacatagtgttggaagttctggccagggcaatcaggcaggagaaggaaataaagggcattcaatcaggaaaagaggaagtcaaattgtccctgtttgcagatgacatgattgtatacctagaaaaccccatcgtctcagcccaaaatctccttaagctgataagcaacttcagcaaagtctcaggatacaaaatcaatgtgcaaaaatcacaagcgttcttatacaccaacaacagacaaacagagagccaaatcatgagtgaactcccattcacaattgcttcaaacagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaactggaaaaaactactttaaagtttatatagaaccaaaaaagagcctgcattgccaagtcaatcctaagccaaaagaacaaagctggaggcatcacgctacctgacttcaaactatactacaaggctacagtaaccaaaacagcatggtactggtaccaaaacagatatatagaccaatggaacagaacagagccctcagaaataatgccgcatgtctacaactatctgatctttgacaaacctgacaaaaacaagcaatggggaaaggattcccgatttaataaatggtgctgggaaaactggctagccatatgtagaaacctgaaactggatcccctccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaattaccatcagagtgaacaggcaacctacagaatgggagaaaatttttgcaacctactcatctgacaaagggctaatatccagaatctacaatgaactccaacaaatttacaagaaaaaaacaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacacagttcatgggactgtaaactagttcaaccattgtggaagtcagtgtggcaattcctcagggatctagaactagaagtaccatttgacccagccatcccattactgggtatataaccaaaggactataaatcatactgctgtaaagacacatgcacacgtatgtttattatggcactattcacaatagcaaagacttggaatgaacccaaatgtccaacaatgataggctggattaagaaaatgtggcatatatacactatggaatactatgcagccataaaaaatgatgagttcatgtcctttgtggggacatggatgaagctggaaaccatcattctcagcaaactattgcaaggactaaaaaccaaacaccgcatgttctcactcacaggtgggaattgaacaatgagaacacatggacacaggaaggggaacatcacacaccagggactgttgtggggtgggaggagaggggagggatagcattaggagatatacctaatgctaaatgacgagttaatgggtgcagcacaccaacatggcacatgtatacatatgtaacaaagctgcacgctatgcacatgtaccctaaaacttaaagtataataatgatataaataaatagataaataataatggccctgtaaccccaacactttgggaggccaaggtgtgtggattgcttgagcccaggagttcaagaccagcctgggcaacagagcaagacctctgttgcctttttttttttaacttgctcactttcctatctccttatgtctaatttttcccctacattgtctaatagtttcctaaattttttcagtatggtcaaacgcatcccctaaacgatccattgctttatttggttgtcatccaccctagagataccatcctttgacttcacgatgtagtggttgctttctggaccagctcacacctcttaccctagcacttccttcactattatcccaggaattccctgttggctggatagtgttggattcctctttcctggaaccccttcatttccctttctcagattatttccgcattccgatgcagaatgtccttcatgagaggcgactttttaggacttttaatctgcgttcaaatcaattaatagtttgacggttatcaactattaggttgggaataaacatctctcagaaatttgcaagtgtttctctgttatctttgcctacaatggtgccattgggaggtcaagatcattctaattcctgtttcctggtattcctctttctctctagaatttgctcttagttctctgcattttgtagtgaaactcgtttctcttatttgatttttttgtttaagttcatttttttccatgaaagctatgtttctattgacatgacatttgagtattcattgcaaagctttaaaatgtgtgtggcccagtggtggctcacgcctgtaatcccagcactttgggaggccgaggcgggtggatcacctgaggtccagagttcgagaccagcctgaccaacatggagaaaccctgtctctactgggcatagtggtgcatgcctgtaatcccagctactccagaggctgaggcaggagaatggcctgaacccgggaggcagtggttgctgtgagccgagatcgcgccactgcactcctgcctgggcaacaggagcgaaactccgtctcaaaaaaaaaaaaaaaaaaagtgtgtggcccatccacatgcaaatatccttgtttctctgataaaattgctgattgtattcttgaagtgttgattcaataagtgttttcaaaacaacacttttttatttttttattttatttttaattacaaaagtaatgcatatatgcatttttatgctaaacatccaaacaaatgtagaagacaaaaaaaaaaaacacacttgttccaaatcaagcttatatcctccgcagaagaaaacactattatcaatttaatgtgtagctttcagacattttattatatgtcaacatggttatacatgcacatatggaaatagagagtttaatttttgtggtaagagttttttaaccaaaattgaattgtatagtatatactattttgcaaattcctttcttccatttagtagtatatcttagagaatttgacttataagtacacacatattgaatttttcttattaatgactgcataagattccaaaatgtagatatactatggtggaaatttctttcaaacttttcactacataaacaacattgcatgcttctttgtgcacaaatataattgtttctttaggatagctgtcagaagtgaaattgatgggtcaaatttgtgttttggtcttgtaattatgccttatcccagaatgatgccatgtggaagttagacacaggcccttgtgttttagaaagtgtggcagagccttctcaacttcagagtcacccagaggaagttataaaagtcagaagggacctatggctacatatagtgggccatgtctaataagaaggtagttttgttccagaattctttaggtagggaaatgctctaacatctgttagctctacctaagacaaatagaagattctccattaattccccaagtcaggaagtgataatgaggtacacctagtgcctgggtgtttaagatcaaaatgatagctgagtaattaattggcactttccatgtgccttttgtctttctagctggccaaataagcatatctgacagtgtgtggcaaatgataaactcccacaccaaccatgtggaggcccgtatctgctgcaaaaatcagttgttccgatttgcttttcagcaacctcagtggattgttcctttctatccactgcattttcacttgtctggaaggtctttcaagcaatatgactataatttgcaaccaaatctgatctcccgccatatttgccttctccttctttttcctggagacttctttcttctccctttaaaagcaaatatttttacttgaaagtatagtaacccaggtgaggttcaccttcaagactctccatctgaggtcaaactgggcatgtgacatttctcagttgatttaccatccacgttgactacccatctattaggcagattttggagacaacctctttgtcctcctaactgtgcaatggaattaggcttctcccttatcgacaatgaccccatacctaacttcagccttcctggaactccctttttatctaaacacttctcctggccctgatgaagaatgcagtccagaaggaaagccagtgaactttaaggtcaggtgctcctgtcccttgggagcaaacctcggtaaagactagatcccaaatgtgggtgctatatacaactagttccaccccttactatgttaccagtgttcccatggtgatgctgagaatgttacaaggacctttcactcagctattgtatcagttcaggctgcttggtctgggcatgccaataaccatatataaatgttttgtttctctttattctaattaatctgcccacttaacttggctggtatggcttctcatccctggcccaccttttatcatactctcacctttatgtttgctgccccctgttggttgctgtgaatcccagtgaatgctgtatgttagccaagcaattgcaggccatggccagcctatgcagcaagccaggtgttctgataccttttcttgcaggaatgggaatgtttctgaaccctctggaaagtgccctgccactctcacctgattctcatgcttactggtcccacctatggataaagattctctctgggaattgcagggaagctgccattcctacctagtatgatgtcccagtaagccacttgactgttgcccttaggtacctccccttccccatattattcttaatctttgaccttcccagtgccattcacacaatccataacagttctctcctaccctggaatattctctattagtctgactccacctttcaggagtttctcatggtgtatgctccactgggggcacccattttgctttctaatgcagttaaggatgtctatataggcatgtatatatttacatatatatatatggatttatgtttatatagctgtgtatctgcacaaatggcagacagacaatccctacctctctctccatacacacacacataaacacacacacacacatatgtatatatatgtatattctgcatatcatattataggatgatacatatgtatgttaatatcaaagggttcaaagaagggagaagacatgggaagtggctcttagtctgccatttgcactgagtcctctgtagctttaagaagaaatatcgatttatttcattggttgtgcttgtttttgacccaaatgttcactttagcccatggtctgatcttttcaaagacaagcttactcaagcaaagaaagaggaaagctccccattgtcacgtcaattatagataagttcatgccaacataatacctcctcctcatcttatttctgtagctcaggataaaaagataatctccaaaggaggcctaaaaaacagccacattaattaaaggaaagagattttttttttctaggaagtgcctaataactaacggacaagcaaaggagactcattagtggaagtatttcctttgaaagggcacacacgctgtgaaaaaaaaaaaagaaagggttatgccaggcttttctctttgtaaataaagtgacaccttttatctttttttctgttaataacacaggctggggagaatgagtctgagggaggcttgtagataagctggcaggatttgaagattattcagatctttagtttcttatttctctatgttctagggtaagacttttcttcattgttcatggccttgtataaagaatggttaggattggggatcttagggagttaggcttaagagtggtggcttagactccattatcccagttaactgatgaaccatttgccatgaacacctttggtaggtcatgctccatttagcaactgggcagggaatccgatcacctcaaacactacattcaaacagaaaggcaaaagatgctataaaagctagatggagagataggtggatacacagataaataaacctgatagaaagatgatagatagagatataaataagtaggtagataaatgaatagataggtaaagagactacagaataattagctaaattctgtagaaagacctaaaagggaaaagatattcacaagcgggggcattcagggtgagtttgaatctttaaggagatttcaaaaaggcacagagtgatgtctaggatttgcatgataaactggaatcttacttggagcacattttaccaacaccccataatgaaggttacacacagaaacagcctcagactctccagaaggaactgtcgaatttgatgagcacacatagagctagactaaatggatggggtgctgaggctgggcttccataccttaagtacctacgaatcatgtgagtgattaaaagatttcttaggtcaggcctaatttctaatcatctctcactcaagccagcatatggccactgtatgagttcaagagtgagcatttttttgaaacgcagttaagacttcagtttcctgcaccgaagaactaagtcactggcaacttgtcatgctagagaaaaaggcaggggacaattccatctcaggtatcatcacttcacgttgcttaccctacctacctaaatccagctagcatgtttgctcagccccacgtcagctagagtagaaattacttatccacttctcctctacacaaacctctctttatgagtacaaataaggaaaacaagcctgccaaatgacagtttgtcattgcaggagccatggccagaatccacatttcccatatctaatgagtgtgactccagccatgttcttcatttacatttatatcgttcacaggaatccatgtagccctgacttttgtgggcattgttatatcaactccacccccaccattgccatctcatctggtttgggagttaacaaagctctgtcatcttctgagtactgtgtgagatggcccagaaaggtatcattgttctcacttgggaacattgttcccactaaatggagagatggaggtttatggagctaacagtcaaagagtagcagtcacatccaggtcttcagcagcaccaggcttggccccgtatacatgaactctgactgctccatcactaacaaggcacatctaatctggaactgtgccttatgctttgctaactgtgacatacagcacactattggcaatggctttcgtccactccatccaccatcaccactggctctactttgcaggagttatctgatccattttctctgttgtttccttgtgagggagagcagacatgcacaagctattgtcaaaggacaaattacaacaaatttagtttaaagatctcgctgggctttatagcaattttagaattggtcaacacttaattccataaaatagaataagtgttccaatgagcctagcagaagaggttggctttctagacagagaatgtaattgtactaggtttgttgcccgatgtgcatggcaaatcaatatgccaagacactggattgtgacagagaagagatttaaccatagggccaccaaatgaggaagagggagggaaaatcaaatctgtctccccaaggagtttggggatagagtttttaagggttatggagtgggctgaagcatggagattgttgacggggtgaagagtacagagtgaagtcatgggacagggagataaagaaactatattctcactctgatttcattactctgtggggggtttcaaactggttggcaacaactgttttgctggaattcaggatctggaaaacaccttaagcaattcttaaacaaaagtcttgtgattttaatgtcagagatcttatctataggaacaatggggatgccagtggtcaggatcagtgctctgtgactatcaggttcaaggaagtgggtaaaagtgaaggctgattatttactcttatttataactatatttctgtccagaattcttcttaaccctgtgaggatggcttcaagaagggttgaagaaagcagaaacaaagaacaaaggatgtattcattatttttcaaagttactttttcttgtcgggtgggaacagggaaatagaacaatagaaaaataactgattagttaacatcaagtcatgtcaggctacttattttgtgtaaggaatacagcagaaggaactttattaccatgtcgattgataattaaaactgacctgcttggaaaatggctgttatttctgtctcccgatttctcagaaggctggataatgtcatagtttaggtttggtgatgtagaactttagcatgggtgactctattttgatctttagtctggtctgttgaagtctagtgcaaaagtttagtccaaaacaacaacctcctataatttttaacactgtaaatctctcactagccctgaattcttcagtagactgtattttgagctcctgctgcaggcaactgcagacagattggccacataagagcagtagccttcagaccaaagctcagaggaagtgccaaaacatgtacaaaccctggatgggttctggccttggcaatcatgagccaccattactgttaaggaattaggagtggaatagtggaattttccttgctccagattttaaggacacactcaacttcatccaggccccagcacatcacagacccacctatgagtcagtactaatggcagtactagtggcctcaaaggacatttgaagaaaaattgttacttaccagaccccaccagagctgctgagatgatcccatgtaaccctaactacagagttacctttagcttttttcagttaaattgtattttatgtgagttttaattgacacaaaatataattttgaaagcctgcaaaaaaatgcataaatgtaaggcagaaatggccaggacattcctccaaataactctgcctggaaaacaaaatcttgctgtcattactggattgttcttgttttctccacatgaacaaggtttggataatgaagtaacagctcttcctggagccccattgccaaaaactagcaataaaggaagaccttactacctaacacatgtggctacttgaaaattatctgaaataaaaacaagccagaatcaacataatagtgtataacaaaacccagatgtctcttgaataaaaggttaatcaaatgctaatgttaaacgaaagagtttcaaaggcaggaggaagaatgttagagataaatgaagaaattaggtgcagcctctgtatgacttggaagagcaagctctctgcacaggatcgtttttttgttttttttaggaaattaagcttttctttcacacctagaatgtgtcagatgctttataagaaaggcactaaatacttttccaggagcttaatcttcaaagtacaatctactaagatgtacctggaggaagaaaaatgtagcaattcttgcaaagcaatgctttggatattacctttctgccatattttggtagacgtttatatataaatcctggtttggtcaggaatccagtaagaatttgcaatgtttgtaaaagcccacctgctttgctcatgaattgcagaacagctcatgcctccctccacagcaccctctgccctggtctccatcccagtgaagggggttgtgctcacagtctgtatcagaatcagtcagggttctccagaaaaacagaagcaatagggtgtatacatacaggttgtatatgtaaagagagatatttattttaaggaattggcttatgcaattgtgaaggctggcaagtccaaaatctgcagggcaggccagcaggctggaaatgccaacaagaatttatgctgcagctcgagtccatggcagtctggaggcagaattccctcttccttaagcggaccatagtcttttctcctaaaaccataagataagacccacccatattttgagggcaatctgctttactcagctctgctcacttaaatgttaatcacatctaaaaaaaaaaaataccttcacagcaacatctaaactagtgtttgaccaaacatctgagcctcgtggcctagcccagttgacacataaaattagccacacatccagtgggcaagacagacaaagtcacaatagacatcgaaggctactggcggggactgagagaaagtggggagtctacaagggtgaaggagaggaaagcaccgtgaaaaatacttgcaaatatttattcatgaggtcgggaggcatttcagggatcttgcaccagcatgtgcgtgtctgtgtgtgtgtgtgtgtgtgtgtgtgtgtgtgttaaaatggggaggaaataagagaatgatacaaatgaagctgaggaagtaaacaggtcaaggaggggagggtggattctttcttgtctgctcaagcataggagcaagtggggtcatgcaattttattttataactagtggctaagcatccacttatcttatggaagaaggtcctcaattctccaagaaccctggtgcttcagagtcagcagtgccattagcaaccacaggtggcgctgtcctttctcaggagagcaccaatcctacaactcctttggttaagattataaccctggccagccagtattcccccaagccaccctagtgggaggcctggggagccttcctaagcccctgggctttgtgtcatacctggccataaggcttgcctgccttcatgctccagatagctttactctggtggcctcgttgcccttgcctaacacctgaccttgatgtaccctcccccagctcaccctgaaagagcagcctgactgggaatctggggatggggtgtttttcctttctgtcccagaacgccctgtcttcctcatgcaaggtgatgagctctcacccaagggctggctctgcaggctggatcacacagctgtacatgcccttccccacttcccattctaaatccacctgatcaagctggactccttcaccaggcccttccaggaacggacaactctgctctgaggagatcccttctcatggaggatgactcagcatgtcctttcatgcagcttccatctaacctctacctcagcaggtgtctgctaccctagggcacatgaggatgctcccaaagccagcagaaatccaggacagcatttcaagaaggggagaggccagggattctgcaacatggtctgtcacagaggagggtggcttcgatggacagcaatagcaagaccagagcaggtgcaattccaagggtgcaaagacagctctggatgctggagaaagtcaatgacagtgagtccctactcacctgctccaccactaatggctgcagcaatgccacggctcatgttctgggctgaattgtttccccccagattcatatgttgaagtcctaacccccagtacctcagaattagactgtaattggagattgggcctttaaaaggataactcaaatgaagtcactagggtgagtcttaatccaatataatgggtaaacacccatgagaagggcaaatttggacacagacacacagaagaaagaccacaagaagacgtaggagaggaaggccatctgcaacccacagacagcagtgtgagaagaaaccaacccagatgacaccttgatcttgaacttctagtctccagaatcgtgagaaaataaatttctgttgtttaagccccccagtctatggtactttgttacagcagccctagcgaacaaatatactggcttcaatctaaatcaacttgcagttagcaatttcaaaagactgcgtgaagctatcccaaaaggctatccgcaaaggaaagctgcgttcttgtgcagtactattaatagattatagaaggaaataaggatgacagatgttactggaaaccaccttgtgcctagaaagaagcatttcctttctctcaaccgaaggacagcagcaaggtcccagatggtgctgaataagcaagtgatcaaatatcttatcattttggatataaatcaatgcagtgatattacctctcaaactttgctcaatcacttagccttgttagattagtcaatatctaggttgaagagcaaaatgagaattggaattggccttttcaaagtcagatttgtgtacctaaaacaagccaaattagttttgcattaaaaaaaataacacagcaagtcacatatgcatatttgagggtcactatgaagctccttgtttaacaactaacactgattgtaataattgtgccactgtggttctgaatgtcaataatgggagaggttctgtggagatggggtatatgggaaccctctgtactttccactcatttttgctgtaaacctaaaactattctaaaaaatatagtttattaatttttaaaaactgaaaatagtaactatttaaaaatactttgactattcaaaaaaccaacacatcaattagtctgtatctatcaatatatatattttagagagtatcactttaaaaataaaaattacccatacccaaagctaaacatcacttaactttttttgtttatatcttttcagtgttttgtctctattttttttattttacaaagctgactttctattgtaaaatcaatgtttgttttactttcctttataatatagcttttgaaagctgcaatgtttttcattgtatggttatagcatcatttatttaacaattcctctatttaggaaaaatggccatttctaattttttgtagtaaatgagattcaaaaaacagtgtcaaaataaattctcttttgtactctttaatgtacatctgattatttgcagaagataaatttctagaagtagaattggtgcattcatcagtttgctcattgtttaggttttttaatacatctctgtcaagagggtattattagcatttttcctctgtcatcaatttggcaggtcagagatggcatcttattttattttaatttgcatgtacttgatttttagtgaaagcaatttttttccacatatttctcaatcatttatagttttctttggtgagaagacaggtaccttgagtgtgtggcttacagcatctatcacagatcactgcctggcacacagtaggtcttcagttagtgactgaattaatgatttaccctgtgttcttgtcatcttttgggaagtgctccacttttccctaaggatctgtatgatcccattttgtcataagaatatcagcccattttctaccattcatatggaaaatggtttgttctcttttctcatttaaatttctaataatcatatttgtccctgctaattatcaccatgtgcccagcctggaatgtgtactttacatattttatcttgcttaattcttaccaccaccctaggaggtggatgttatcatcctgtttactaatggaaatattaagactactcctagacgttaaataactggccctggtcatactctcaagagacagtagcacctagttctgtctgatattccataagccttcacctacagtgctatatcgcttccttttaaattatatttatgtgggatttttgaaggaggtaattgtctttgtctattttctgctgctgtggcagaataccaaagactatgtaataaagaaaacaaagaaaagaagtttatttggcctacagctctggaggcttggaagtccgagagcatggtgctggcatctggtgaggaccttcttgtgttaacccatggtggaagggcaagcaagcatgtgagatagcgagaggaaacggggaccaaactatactttcctgaggagcccacccccacggtacctaaaccatgccctcaataatggcatttatctattcatgaaggctccaccctcatgacccaatcacctcttaaagttcccacctcttaatattgttacagtggcaattaaatttcaacctgagtttaggaggggacactcaaaccatagcaataatatattcacctgcatcaaaaataatatatataggtgtgaagtttaaaaaaaaaaactccttccctcatttgctcatttttacccctacttactttaaataaccactattactaatgttgcacatacaaccttcttgagcctcttttatgtatatacaaaatatgcatatatattcttctcccatctttttacacagatggcagcacactataaacaccattgtgtacctgctgtttagacctttcttattagtacatgagcagcttccttgtttttgttgtgttttgttttgttttgtttttgtttacagacaaatgatattccattgtatgaattgattacattttagctaaccagttcaaatgttacttaacatttgggttctatcaatcttttgctataacacagtgttacatttattgttgaccacatatgcaggtatatctgtaagataaattcccagaaatagaatggttacagcaaagggtatatatatttgtaattttgatggatgctaccaattgtcctccacagcaattgcagtacttatatttatggtacttctgaggtatagaaggtttttattttatcagttagaaattgtgtttggctgctaggaacagagacctaaccacagcagcataaacagataagggttttcttttctcacagaaatggaatctggaggcaggcagtatagagctgatatgagagctccacaaagtcataaggaacctaggctcctttatttttttggctctgtcattctgaacatataacttccaatctcgagatcacaaaatgactgctgaaactctactgtcacatccctgttccagacaagaaaatcaagaaaaatctaggggtaaaaagtgtctttcataggagtccaaaaatatcattgcccacaccttttggcaagaaatattgggaagtataattttgtgactgagcacattgcagtcctcagtaatataagggttctattaggaaggtcgaatacagcgcatggatattgagtagataagcagcaacctctaaatgtgtcccatatcttgatctttttattcatagagtcctcactccaaaatcaaatacatattacctgcatttctttttatttctttcatggcctcaattttaactctaattcattttgcatttattttagtatgtagtattttaaagcattttttcttgttttagaaagaaaagaaaggccttaaagatctgcccccattccatctttccaaaagaaagaaaaaatatttctatatttataagataaaattacaaaagtattaggcaaattaattaacaatatgcatctacatggttaatctatttggaatttatttttgtgtatggtgtgatacaggaatttcttttgtagttagctaattgactcaatatcacttactgattaatttatctagacctgattgtttgaatttattatatacaaatggtttaaaatcaaatatttggattcaatttccattaagcttattgattattaggaagaggagaaattgatacctttacaatgttgggtcatacccttcaagaatatggcatatctcaatttattcacatctggtgggttcttcagcagaatatcatcattttctttatttaggtcttacatatgtcctgtaggtctagtctcaaggctcttatagctgggttattattgtgaatactttttcttattaagttttctggggtgtttttttttatttttgtttgagagtgtctagctttggggcccaggctggagtgcagtggtgctatctcagctcactgcagcccctgcctcctgggttcacacgattctcctgcctcagcctcccgagtagctgggactacaggcacgcagcattatgcctggctaatttttgtatttttagtagagacaaggtttcaccatgttggccaggctggtcttgaactcctggctttaaaggatccacctgcctcggcctctcaaagtgctgaaattacaggcatgagccaccacactcggcccttattacattttctaaaactttattgctaatacatagaaaagctatgaagtttttacatgttgattttctccagcttgctgaactcttattaattaaggcacctataaaatgattctctcaaattttctaagaagaaactctcataaagaataaataatggttatttaacttgtgttttataatatatttatatctcacacatttttcttgctgttgttttggctacaacctccagactaatgaataatagctgtcagtgtggacatccttgtcttgtttaagattttaataagaatgcctctattttgtttttatgtcctttggcttctaacaaattcccattatcatgtttcagaacattttttatgtttctaatttatacagagattaatcagacatggaaattttatcaactatatcaagtatacttgaaacatgtatccacataatcacgttgcattttcttttaacgaattaatttaataaagtgtattatatgaatagatttcttaatataaaatcattttgaaatgactagattagattttactttgtcatgagattatgttttattattctttggattcgatttgtcaatattttatttagaattttaaaaatctatattcctaagatatatttgtctatagtttcctcttctggcagccttcttctcaggaattgttcagcccaacaaatgaactggaaccttcgtgtttttctgtgcttctttacagtttaaatggcaaagaaaacatgcctcttgatggtcaatgtaactcatttttaaaatgggctggtccagtccctttttgaaagtgtatctttggggtttcaatttcttttaagcttactgtctatttaggtttctaccatttcgttagtcatttttggtaatttacatgttccttgaacgtacttattcacctcaattatgaaatttgttgttgtaaacttgtataaagtattttcttttttttttttttttttttttttgagacggagtcccgctgtttagcccaggccggattgcagtggcgcgatctcggctcactgcaagctccgcctcccgggttcacgccattctcctgcctcagcctcccgagtagctgggactacaggcgcccgccaccgcgcccggctaattttttttgtatttttagtagagacggggtttcaccgtgttagccaggatggtctcgatctcctgacctcgtgatccacccgcctcggcctcccaaagtgctgggattacaggcgtgagccgccgcgcccggcctgcagtcctcattttaaggcctgcgtattttatgcttctccagtgttttcctttttccctttctagtcttctgctggaataaccaactttactttatttctcctgccctcacacatgaaggttagacagtttcatactgaattcagaagccacaatccattttcctctgagctctgtaaaatatatcacatgttctcttagcatttggtatttccactggaaagtctagtacctgggaagctccatttgatcctccttcctttataatgtttttcccccttgtctaaaagtttataggacttttcctttatcctataaattcagaaatttcactagatgtgatttattttcagtaatcttgtctgtcattcagtgagagttaacaatctgaacactaaaacttttctgcaaatcaaaaatatgtttgcctgttttcctccatctcctctgttctcttcttctcaaactcttattacataggtataagacactctaggtctctcaacacttcttaccctcccttcctttacttctttctctttgctctgggataattccttgaattcattttcttatttattagtttggtgtttagcaatgtccattttattgctaaattaaatctggaattttaatagtttttaattgcttggagagctctctttttcctatctcttgtttttctcatagcaaattgttcatatcatagtgatagaagcatccctcacatttcactgacattcaaaattgtaataatcttccctgcattttcagttgtttcagtgaggtctgcatttatacgcagttaacacacacacacacacacacacacacacacacctctctcaagagtttaatgcatgccagatattgttttaaatgccattattaccacttcccaagcaaggagactgggcagagcctggaagccaacccagacagtctgattcagagccaggaacactctaccaccgtgcaataccagcatttgttctttacgctcagctgggtctcctatttcaagttgctacttctacagatttgtccctaatttttctatctgcctcatttttatttacttatttatttattatttatttattgtatatttatttttatatatatttatttatttatattatatatatttatttatttatttattatttattttagagacagagtcttgctctgttactgaggctggagtgcagtggctcactgcagcccaactcctgggctcaagccaccctcctgcctcagccttccaagttgctgggactacaggtgtgtgccaccatgcccagttaatgttttaaattttatttttgtagagacgggggtcttactatgttgcccaggctgttctggaactcttggcctcaagtgatcctcctgccccagtctttcaaagtggtgggattacatgtgtgagccaccgtgtctggcctctcacttttacaaataaagataatgtatccatattgataaccactgtggcctgcacccagcccctcctcaagcaagctgatagcagggcatccacaaatgtgcttgtgtgaggggtggcacagacctggggttcaagccatgccagcttctaagggtacacaaagttatagttccataacctcagagggtgcaggactctgatgtgtttcaaagccccagaatctggtgtctgtccgattttactgctccagcctctgatggccaatgagcagaaatgtgactgccagtgtaaagcagcaagacagcctaagcaaagcaggctcccttgggccacagacgtggcttggcaatggtgagtgccaagggcctctgagcaggacacagggtccgctacacagctcagcgtctcaaaaactcccaacatcccagaacaagacagagttaatcagctacataaattgagttaattagctacataaatcatgaaatataagttgttcttatctaaaattataaagaattaccaacttttaaagataaacattaaataagatgaccttttgtagacatccctactgctgacactgccaaaccactcgcgcccctctcagcacttcacctgtgctcacctggacgccatctgtttcctgtcttccagaaattcttccaacctggcctgtcaaactcagccttctgggttttccagctctgttgcatattttatcctaaatgaacatcccttcagttatttcagcagaattttgatagggaaggaaagagagcacgtgagctcaaatcaccttaaaaatgagtcttgtatttctggcagattttatgctgcatatttttaaattaattatcataattttttatcagaagaaagtgtgagaaggatttttcttggtgaagtcacttcaaccctaaaagtttgggtgaattcacggctactgtaaaggtaagccacaagcccacttacgacagctcttcacagtaagataatgtatgtctaaagatcctccattcgttggactcaaagatatttatttttgttaaatatcatatttccttgcagaccagagagcagcatatctagagagtaagctaagcttaaatgagcttcagagtggcccctttatatatttatttttaagggcatttaaaaagattaatgtatccatgacataagaatacaattataatcgtataaccttcattaattaaaagagctgacgtttaagcagagaagttagtaaacagggtattgtatgcagtggggacagccaagttcaaagtcaaaaaaggagctgtttacattagagaaatagcaaagagtccgaggtagcaagaggagaaggaagcagagagcgatacagaacagtgccagacagagacgtggagtccagatcctgttgggtcttgtaaaccatggcagtaagcttgcatttcctttgaagagggaagtgagaagatctgggatttgggagagtagtttggtaactccattgaggtggtgttggtgagtgtcaggtgctatggtggagttgcctgggcagagagagctatgcatcctcgagcatcatctggggaactaggaatggacttatcatgaatggatccagattcaacactaccgtctgaagcagcactagctcaggttgactggactgtgcacttcaggctgcaggaggggctcagggggttgccatgggtctctttccaggactagcccctccctggagcttgctcattacatggcaatggcaagagcggtttatatactttgacaggatattatttggttcagagtcatcagggttatcctcttcgtgaatgtccttccttatcaatataaaatcatatcatgtaatggtttttgcctttgagtctacttcttccaggataaacactgccacctttactgtcttattattacatcagcctgatacacctttgctcattccttcattttttgccttcctatgtcagttatttttaagctaattttttaaaataacatacaattggattttgcattttgatttaagctaaaagtatttttattttagtaaagcactttaagatattttctatgtattatcaaaacaaatacatttgctcttataacttctagactagctcctttttccgccctttattttatgcattatatttttattgctcttttccttcctcttacgctttgaaaacttaatccatctttttattcttctcatggttgtcataaaatataaacatattttaacccattttctctaattataaaatgtcaactatcaaacaatatttattatatcaatcctgagtaagatactaaattttagcacactgttacttcctctgtacttgactacttttcaattttaattgatagaggtggggtttttatgctttgctttcagccaccctcctccacagtctacattttatgactcagcttaaaaggaatggttctcaccacatagaaatggggtgattttggccccaggggacacttggcaatgttgggagacagtcatgattgtcactggtgggaaggtgggtgtttgctactggcatctagtgggaaaagaccaggaatgctgttcaacattctacaatgcacaggacagagtccacaacaaagaattgtccagcccaaaatgccaatagtgttgaggcaggaaaattccattttagaggttttgtggctcttatgataattgtaagttaatattactcattgtatttaaattatttttaccaccagtactttcatatcctcactcttaaatttttaaattcctgtttatccctcgacgggctagaaaatatttttaagtaatttttttttcaagtagactctatagaaaggaggaattatacttccctaagctgccagtatttgagcaaatctttctaacactctcagacacactcactggaagcagatgaagctattagtcagtcattccccagcctctgagaaggaatatttttcttgtagatgttttccctcatatatttgcacatgttacacttccatttgttaatcgcctgtccttatcttacccgtttacctattcctatagtctatgatgcaatacttttatgcattttagctcttgcataatgtatgtgttacaaatatttaacctataatatttaagatatcactgatacttaatatttctaatttttaatgtacagaaagtttaaaagtttatttttttaaaatttacctcactgtctcttccttcacttttttgctagaaaggtcttgtctattctgagatcaacattttcctaagtgcctcatctatttgttttcacatgcgatcattttaagccatgaggatttattttggtgtttgaaaataccctcaaattgttaagcaattctcataatttggtttattaaataattcatcctttcctctctaatatgaaatgctacttttatggtgtaccaaacacaagggcctgtttctgcagtttatgtcttgtttcatcaaatctatcttttcttaccctaaattttatttcaattattttggctgtataatgtttttatatttgccagttttccttcattacaattacttttaacaaccatatttttaattttccttgcccatttattctttcagaagaattctggagcaatttaatccagtttcaaaaaaatagcccttgggacttttggttagaattgtattacatttccaaataccggaagaattattgcaatactagatatcctcagcccatcttccatttctcttttcttctacaatttttatttctttattgtttcctctgagttctggaaatttttcttaagtttaccttttccttcgctaatccaatttttcacataatctgccattcttctggtgcaggggttttgaatgtagtaatcctatttctgttctttatgtgatccttactgatatcaaatcatttcattttggggactctcaggtctattttcataactttgggaagtagaaaaacactctttcccctatcccttgctatatgtctattttggtgaaaagcattgactaactctttggaatgaacaaagctagtcttcttagagtctagggatgtctctgtttttcctcgcagagacaggtctgtatttagcccccttgctcacagttgagagattgctgtccacatacttcaggcccagaaaaggaaggagtgaaatgctgagatttgctctggttttatttcacctgttcagagacccaggggacagtgtcagagttcaagggatggtcacaacatccagcctgactcccaccccttctgctgaggcagccatgagttagccccagcagtctccacagttcactggctacacctgccctcattagaagtccacagccctgtcctcccaacagagccatctgtgtctattgaacccagtgtgtgcactgctgtgggcgcctgttacccagtggcattgatggaattaaaatgcatctccccaaggcctggccggctgagtgacagggcatagatgggttccccagaggtccttgcccattccccagaggtccttgcccagcctatctgcatgaaatatggaagaaatgctagctaacttaaattatgcatgttgtctgatttacagcccaagtataggtttcagtttttgcatcccttttagttccttctgcagtttaggaggatgacattgacatctgtgtccaactcgctgtctctctggatatttaagaagtagaaaggtggtcaagggaaagttgaactttatttatgtctcagtttttatagtgagaatatttttatttttctcatttctcattttcatattttttagttaataaaaatagaaaggttttaaacaataaagtccaagataattcctaaaacactgaatttttcctaatgtgagttgagactttaccaaaattaccctcaaaaggagcaagttgccttcaggcgaagtcctcacaaagcctcttataatagtgtgtaatagtaagtgctctcaaaattatattactcataaaataaatttgtatttaggagaggcataatttcccttaaccttaatcaatgctaattgagctcttagggaaatgacccaatgaaataagtataaaaaggatgaaaagaaacttaatgaagatgtagtcactattgcttgggaaggggcctgcacttcaagagtggggtgtcgttgttaaaaagccttctaaaatcaatttagaaagcaagacactaggattgcagaccatcatctacaggataagcaaagagagcaaatgtatttgacgttagaaatttgggaatgtgaacttaggtcttaggataaaatttccagcactggctggatgtggatgccaagagttctgtatctcatcattttggtggaggagacattgctagcagctctgctctgacaactctgtgtgagactcaaaaagcagctggaggaggaggagggctctgatatcaaaggccccttggaggagttaggataaaatagtgtcaagaactgtgagagtaaaaaagcagtggtttgaaatcaatattccatatacataattttaaatgtgtgtgagtaaacaaataaattaatttccataaggagacatttgactgattcatctacagtccaaagagctttgatatttaagttgcctataaaacattttttggatagtcttcttggagaaaatgggatatcaccttatattagagattggagatcaccttttatttggatttttatttatataaaaatacatatattatgaccaggcacggtggctcacgcctgtaatcccaacactttgggagtccaaggcaggcagatcatgaggccaggagttcgagaccagcctggccaacatggtgaaacccagtgtctactaaaaattcaaaaattaaccaggcgtggtggtgcacacctgtaatcccagcttctcaggaggctgaggcgggagaattgcttgaactggggaggcagaggttgaagtgagctgagatcatgccattgcacttcagcctggtgacagagcaagactccatctcaaatatatatatatattattatatttttttctcctcttcaatttacatacttggtacagcagccttgaccttcacaccaagtcaaagtgtgtgaacccagaaataccaatgtttaggatgtaggcaagtaaaaaaatcacacgttttgtctaacatctctccataggctgtccctgcttaacccagaacttcaggcaaccccaggccttgagaaaacaagaatattcttattgggttacagtaggagttttgtgctcaagtcaaaacaggtgatactaaatttttcttaatcttcgaattccatgaccctatatccactcaacaactccctccaccaacccatgtcagtttctatcaattattctttgtcatttgccctgagcatgtttaaatttaccaatttaaacatgctggtaaatggtctgaaccatttgaaaacaatctgaaaaacaattttttcagattgttttgttgctgttgtttactattgcttcttatgtcccattccttgcctccaggcctcatttttcttcttactgaagcacaccccttggtagctctttcagtaagggtctgtaccgaaaacacttttggagccctttatgtccgaaaatgttcttcacatcatgttcactcttgattaatgtattagttggtaataaaattctaagttcacttcctttacctcaagaaacagtggagctattctctttatcttcatgggtagacagccctgtttcaactcctgaattcacacagagaaccaggatccaggccgtgctgtgaatgagatttgtttgaccccagtcatcagaaaagctttgaggaacgcactgtgatgttgttattcagtactggttacgaatagcatggaaagcttcagatctcacccttttcccaatatgttgttggtgttgttattcttgtctcctgtttctggttgaagaagagctcccttccttgtttttgaacatggagatatatttaatattacccttttgtatttgatctatgtttggaatgagaagaaggctcaatgtgagctcactctgacatcttgaaccagagaacttgaaaaaatttaataaatctataatccatttttctcctaaacttttttctataaattctcatcttttctcatttgaatttccccacatctctaatgtcaagttgctttttcctatattgttcaatctcttgccaggcaaagggatgggtatagctcagtgatttaaaaatatatacatatataatatatatatttatattattataatataaccatacatatctatttcatatattatagataattatatataatatatattagtataaccatatatgtctattacatgtatattatatattactatattataaccatatatatctattacatataatatataatataaacatacaatatatgatatataattatatattaatataatatataatatatgtaatatatatgtatggttatatatttttaatatataatataatatatattatattaaatataatatatattatatataatatatattatatttaatataatatatattatatataatataatatatattatattatatataatatgatataatatatattatataatatattaaaaatatatactttttttttgagatggagtctcactctgtcacccaagctggagtgcagtagtgccatctcagctcactgcaacctctgcctcccgagttcaagagattctcttgcctcagcttcctgaatagctgggactacaggcacgtgccaccccacccatctaatttttgtatttttagttgaggggagttttcgccatgttgtccaggttggtcttgaactcctgacctcaggtgatccaccccccaccccgccctcccaaagtgctgggattacaggtgtgaacgaccgtgcctggcctatatatatatttttaagtgagacctctcaatttatgactatatgtattggaggtctctttccagaaccatatatatatacataatatataaatatatattataaccatatatagctattacatagctatatatggttctggaatgagacctctcaattcatgattatccaactgggagtcttttgggaaagttacttcacctctgtaagcctcaggtttttcatctacaaaatggagataataagcataacaatttcttaaggtggttttggagaattaatgatacttggtaaggaaagtgcttagcacaaagtgagcactaaataaacattagttattttattatgacctattgtaagtttttgtgtttttattcacattatgcaggatcctaatgtctagatatatttctgccacataatagccattcaataaatacttatgaaggaattaatagcagtaacagctcaaaagcctaaaagagagaaagtaacagtatattttgagttggggagatggaatttcagcataacattctttaatcagcttttcaatccatgatttcttatctttttaagagccaattactggttaatagatagaattttctgaaacggagcacaggaagctattgtagggacactggactggcaatctgggtagaagattcttttcctcactttttcttgtttacctattttctctacttagaaacttttctgtgttgtgtaatttccataaggcaacttacacatttttttaaaatctgtgagcctgatgggataattgattttgaagtcactccttctgagttttaattgcagctcaattcttaattgtgtgaccatgtacaattgagcttatgattcagtctccccatatgtaaaatgcagataataatagatagcaaaagtttttgcttattgttttcaaaaagaagccatagtagggagagaatttttcagtacccagaagctgcgacaagaatatagttaaaagcaattccacctggcctcctattgtgttttattttgttttgtttctgactgaatcatctgctacggttaagcccacctcagcaggctgcagctcctcccagctctctctcctttcaatctcatttcacaagcctagtaatgcttccattgcctcctcctgttaccatttttttgtttcctacaggttgagattcagtacgttctaagagggagttcagtttctgctccattgaaaaataattatgacaaagcagcattttccaaaatatgtttactaataaatgttaggcaagaaaatgtttctatggcccaggaatttagggaaacactcgtataaataatattaaacagatgtctttatcttaagactatttgacattttaaatatcagaagattctgtcgcttttctgaaaaaggggacaggataagtcacttgcaaaatgaaaatgtttttttttgaggcatctggagaactacttttatgaaaggcacatgttgggaaatgttctgatggagctaaatccaaagaggatagtaagacaagagggatgattggagggaagaagggaaggaatcgtgtgtaatctggtgacaagagcagcaccatcaaaaccccaggcttggctgcaaatctcggctctctgccacttcccagccatgtgattgaaactggtcactttaattcttttacaagctgttttctcatctttaaaatgggtataatactacatctctcaaaaggtcattatgagaatttaattagaaaaatcaagcacatagcctaataagtatgctttcaagacaataaaaaacataaacacagaaaaatgtcttattttccttatgtattttttgcattcctagcatttgcaatggcatcaatcatagtaggcactcattaaacttttgctgaataaataaatgaacaaaaaagctttatcaattcactgaataggtaattaatcaaacctttgcaggtttagcactatgccatatacacaaaaactaaacaaaatattatcattgtaattaagttgaacaggatgcattttgctactgttaggcattcgcattgtgagtgctacagtcttttcttagcctgacatttttctgcaaatgtgttacttccaaaatgagggcagaatttgcatgaataacgttttggtactaaacactgtatttattaggatgaaccatttttatagggctttctaaaacacaattatatggacataaagatggacaatacaatcttatctccctttagccaaagagtattgacaatgcaatttgtgcaaagtttatgtgaattcctgtagttcctcagtcgtttcttggtttgtagataaattatcatgttgagtagattctttgttttcaacttggcattttgatttgttttcttacttgtttacttgacaccaaacaattaaattatgcccccccaaaaaaacgcataaaaataagcccttcggtgactgaacctgcatacagactgatgcagaaaaggctgaagcttcccaaagaggattgtttgaattctcaaacagaagatggtcccaggcaggcaataactgcttctgtctagtgggcattagatttataaagtgaaactgcttttctccaagtttaaaagtataacatgtaaaagtttgaccaggcctcattgcacaagtggagtgctaatgagaaatgggaggactcactgaagggaggacactgttcgcataggaacagtgactcagtgcctcgcagtacccttccctgatttctcattattgctccatctatgcaagactgggttaaaccactgggttcactaacagaagcatttccagtgactccagaatctttttaacgtcctatgtaaagagttcagagcaatacatgatgaactgcacacaaactctttcggccttggtaactttcctgaggaaatagatgtcagacctaatcacaactcttttgccattaagtcttaggggaaagtttctcttgaaactatattggtatttagaaaaagctttgaatctaaatgtcatgcatctctcatttagatagataatttgtgagggaaaatagtctggatgctattggctcattcattcgttctactaaaggtggaatgatatgttaatgtcttatcagccaagtcaacctagaaataagaatgtcaaccatgttaaattgtaagattattcaatcttatagattataattccctatagcatgcagagttatttcacaggctttatcttcttaatttgacaaattttttagagaccctacttgccaagcactgagaatatgaagttgaataaggaatagtctctaatctcaatcaattttcagactaatggaaaagtctatcatagaaacagttgttatgagctctaaaatcatagatgaagaataattaattctcattgctgaccagaggtaaatagaaagaagagtcaaatttgagctgagagccctagagggatgaaagagagtttgtcaaagcccattctgaagtgaataacacggtcataagaatgagccatggggaatatgacaaacagcctggtgtggccaaagggtggtggtggcagtggcagaagagaagcagcctgagagatggctagggccagaacaagagccataggatctctcctagtacaggtgggcttcaactatccgcgtttttacatgttgctttggcaaacttgagagaattgatgaatgccttctatcccttcaccaagattgtattgaatcctcttccatatacctaccagcagtgttctaggctctggggatacaacatactccctgatttcatagagtttacattctctatgaaacagataattaatttaaaaagcaataaataaaaatctatatatcaagaaataaatactctgcagagtattaaagcatggaatattagtcttttctcactttgctataaaaaaacacctcagactgggtaaattataaagaaacgaggtttaattggctcatggttctgcaggctgtacaggaagcatagtggcttctgcttctggggagatttctggaagcttccaatcatggcagaaggtaaaaggagagcaggcatcttccatggcaggagcaggagcaaaagaaagagtgaggggaaggtgctacacacttttaaacaaccagatctcacaagaactcattcacggggagcaggcatcttccatggcaggagcaggagcaaaagaaagagtgaggggaaggtgctacacacttttaaacaacgagatctcacaagaactcattcactgtcatgataatggcaccaaggagatggtgctaaactgtccatgggaaacccactcccctgacccaaccacctcccaccaggccccacctccaacactggggattacaattccacatgagattttggtggcgaaacagatccaaatcatattacatgataatgtgatagaagataaataggtagtacaattagaaaagatggtcagaaaaggcctctccaaagagcctacatttgggctaagacttgaatccccccaaaaaagaactaaacatgcaaagatctgagggaagagcattccaggcggaagtgcaaaggtcccgaggacagaacaaattctctgtgttttaggactagaaataaagctgggtggctgtagtgaagggagttctgtacatgtatcaagtagctattgttgcataataagccatcccacaatttaatggcttaaaacaacaatggtttatttagctaagtattcttgcatgtcattaatttaaaccgagttcagctaggtgggtgtctcatacatctatggacagctgtgggtcatggaggcaactttgctgatcttagccaggacctctagcatttctggggttttcgtgggagcatttgaactgactcaactctgccccatgtggtctcccatcttccaggaggctagcccggcttggtgactatgtaggatcccaaggagagcagaggctcccaggcttcttgaggcctaacctgagaactcacacaccaccacttctgccaaactctatcacagagtaaatatcaaaggaaatcaaaggccagcccagatttaaagggaggggaaacagactctgactcttgatggaagaatctgaaaagtcacatggcagagggagtgaatgaagtagacggagcagtggagtattgtggccattttcgcacagtccaccataaaattgaaaagattgaccagagacagatcatggagggcttggcaatctgtactgatgaagccatggaccagaagagaagtgagtcaatgaagagagtttctcttttcacatggccataaaataatagtgagggctatgacagcaaagaggaaacaaaagctgtagtgatgagtgttagacaattgatgagctgggagagaatttgttgatccaaatgcaatcttctcatccttactgtgttccagaaagttaataggaaagctgaagttcaaaaacagtctccaaaatttatttaaaaagcaatgaataaaaatatatatgtcaagaaataataaatactctgcagagtactaaaccatagtgtattagtatgttctcacattgctataaggaaatacctgagactgggtaaattataaagaaaagagatgctgggcatggcggctcatgcctgtaatcccagcactttgggaggccaaagtgggcagatcacttgaggttaggagttcaagaccagcctggccaacatggtgaaaccccgtctctactaaaaatacaaaaattagccaggcctggtggcaggtgcctgtaatccctgctactcgggaggatgaggcaggagcatcacttgaacttggaaggaggaggttgcagtgagccaatatcatgccactatactccagcctgggtgacagagcgagactccatcaaaaggagagaagaagaagaagaagaggaagaggaagaagaagaaggggaaggggaaggggaagagaaagaggaggaagaggaagaagaagaagaaagggaaggggaaggggaagggggaggaggagagaggtttaataggctcatagttttgcaggctgtacaggaagcatagtggtttctgcttccggggaggcctctggaagcttccaatcatggcggaaggcaaagggggagcaggcatcttccaaatcaggagcaggagcaagagaaagagcaaggggggaggtgctaaaacacacttttaaacaaccatatcacatgagaactcactcgctatcatgacaatggcaccaaggagtgccatttccatacacgagtcattccaaccaccacactgtccccctgataagacttgctgagacatttgctgatacctaattggcttagaaatgcaaaagtacacctctaaagatgaaatttgaccctttcccccaggctctgtctggaggttgggttgctatcacgaggttaaaaaacattgatgataataaacaatcatgataatattttcttatgtggaaattttattacctgatatttgcaacatttaaaagagctaatgaaaataataatatattaatagccaacactggttgagaacttgccttgttcctcttatcttgacctctgagatgccaaaaataaatgttgccaatccatgcatgtgcagttattcaagctatattttcttgaattgaaatataagtcttaaaaccagtctgttccctcacagcagattgatttccttgagattagagagtaggtttcatttatctttatgtatctagtaggtcatatagcatcctgcaccaagtaggccatcaaaaaatattcatggaggcagtggctgacacctgtaatcccagcactttgggaggccgaggcaggtggatcacgaggtcgggagttcaagaccagtctggccaagatggtgaaaccccgtctctactaaaaatacaaaaatttttatttttgtattacgggcgtggtggcacacacctgtaattccagctactctggatgctgaggcagagaattgcttaaacctggaggggcagaggttgtcgtgagccaagatcgcaccactgcactccagcctgggctacagagcaagactccgtctcaaaaaaaaaaaaaaaaatcatggaaaaagtgaataaatggtcttcctcagggatagaaagggtaaaaaatgttttttaattagaaagatcaacaactagagtagtttgagcccattaaacatagagcaaacctccttggacaccctccattttcatgtctgtgtataaattgaacaagataatgaaaccttctgcttataagaaaaaatgttagtttctattctgcattgtagtagattttaaaaagatttccattgaaaacatctactttttaacatttggtgctaaatttgtaagttcctgtttccgaaaaaaattcacttaagttgactaatttatttcctgataaatattacatgaatatctcatatgaatatatttctttaaaaatttaggcacctataacctgattcttatcccaatagaagcaattaaggggcaggtggtggtatcacctttaactgaagtagtaagctgttggtcttccaaggtgacccagcaagcagatgactgaatccaaaagtgggtgatttatcatgtcattctgggagaacatgaagaagttctcagcttttagaatgtaccttaggccaattacgtgcacgttgacaaagatggatgtgtcttcattatgtagtttattatggatagatcagggctgggacaagaacctacatcttgtgatcctagtacagtacatttttaggaagcacaacccccatagatgaccctacaaggagcctatactggagtgaaataggaggctgtgagttttacaagacatcaaacaatggctgcaaacttgattttataggtttagtaatatctccagggaataattctctttccctttccctacttctgtaattggtatatactctaaatgccattagacccagcttgctctaaagatctgtagggatagtatttctctctctccctcattcagtatgtgcccatgtcaggcctaactgaacacagggaccaaataaatagaagatattccattcagattttatagcctgactgctttactctgcaacctctattattgagaattatctattttgactgcaaacacgtcatttcatcaaaggttctttacaaagcagatgacattgaaaagcagcctcacatttttcaggtttagagactagatttttatggacttggaaacttggaagtcagctcaccattctggcatagtcttcctgccaagcccaaattctgaaatcagtgtgggagcaatcagtgggtgacatccatctcagagtcaaagaaacaggggacttctgattccttgtaatttctctagaagtaaatcctcttttccttgactggcactcttctcttttgagggccaataacaacctactcattaagaaccatttaacattttccaaaaatacttccaaaaccattaactcatttgatccatgtatcaattctatgaagtcagtaggccaaatattaatatttgtagtgaacaagaaagccaagcacgaagtgttcaaaaaactaacccgacaacaaactgaaaccctggatattatcaggataacaaaaaaatcacctgacctgacccccagttaggaaatttcccactgtcctatgcactgttctgcacacagtaggaaatttcccaattaggggccaggtcagatgattttttttgttattctgataacattcttctcttctagactatgagaagagaggtgctgtagtggtggagaagcgagtgtgtgtgtccccaagaatattttaggtatggccaccaagttagccctaaagaaactacaattaaactaggaaatagagcagataaactctgtgtctagaattctaaacttcttagatttatatgtcctaaacccaagtctttcccgtctcttttcaggctgttcccacaagtactgacattacttccaaagaggagaatttgggtcactaatctagcgaaagcatcttcccctctgaattcaccatcaagatgaatgctatccactagaaatataaaggaagccacataggtgatcttaaattttctagtgggcacattttaaaaaggaagacaaggcaattaaaatataattttaataatatatttcacttaacccaacatatccaaaatattaccatttcaacacatgatcaatattctaaactacattagtgagatagttacactcttattttcattcttagtcttcaaaatccagtgtgtattgtccactcacagcacacctcaactcagaccagccacgtttccagggcctcaaagtccacacctggccaggagctgacggtctagctcctgtgagtaagctagtcctcagattttataaaactctctcttcagggttgtgctcaccttccccctcccactcctgctgctcctgacctccatcaccagaagagacccccaagagcaaatcatatttttgtttccaagagggcccactgacaacactaaaacccaggaggaagcagttgacttaagaccttcgagtgactcactttgtaggaaaagcagagaaaggctggcaaacaagaaaaacataagctcatttttctccccctcatcaacctcattccccaacctgtttgcatcctgaagagggcagaggcctccaaagttgctttagagggcagaggcctccaaagttgctttctgggtcactgcggggtgattcacccaacaataggctataatttacaaggtttttctctgcaagtcaactcttgctaatggaaggacgacatgaatgttgaggctgacaggctggaagataagagtagttgtttgttccctcagcccattgaaaaatccagccccaaacccatttgaagaacagttcctaatagataatgagacacaaatcgtgtgtacctgattgtaaatgaatagctcatatgcacaaagcaaactgtaaaacctccatttctcagccaggatagcactccattaatgatgtgcttttgtttcttccaaagactaagtgctcctttccaggagaaaatagacctcaacctcacctccccacccaccatgtccctacccccaccccaaagagactgcattaccctgagtattaatatacattgcctaacaaataggcaggcaaccaaaaactgagcaattttagccatttaaaccctgtcttgaaatagcaactcactggataaatggacctaccatttagcaattttcaagatttccaacctgctttgatttcctctctaggtagttttttattttgtgtttcagcgggcatcaactttgcaatatcaggaaaaaccagagccaggcttgaaaataatgctgagacatctagactcaaacccgggacacaagtgggaatgaatcaagccgggaggatttttccaaatctacaggaagtgaaattcttctgctccaggcaatgtttatcacccatgtagaaacctcattggtttggcaattgtgagctaacagggtatggcctgagttatgctctgaatagcttacagttactgccttggatgtgaacgatttgggagggacaagtctgtgcagtggcctaaagtgaggcgtgagtttgtgcctagcttgtctgtgaaattgggtttgttttttctgcttttactacacattaagccagatgaacacaaggacaccagttgttacttttgaatgatttttaaaattacatctctagtagggaatattgatttactttattgattttttaagatcctttctatttctttagtgtctgctagtcagtggcctcaaaaattgaattttcacgtgttgtctttgccacttaacattatcagaagcttcttgaatgtttactaatagaagtgtgactcctttcatgcttgctgtgtctaatgttatttttgtgttagcaaaattgctcttcaggaatatgctgatggctaacttgcagaaatagagatttaggatagacataatgaaggacttccctacaacactggatattaaatgctgaaaaaggcttttcaattccttcctgaaataagccagggccataagcacttagcccactctatcgaagtctccccgagaaaaccctgcggctttctctgcggattcctccagcccaacaccgaggaaccagggcctgggacttctggagtccctcccaggactaattcccgctctgatgcccagcacaaatttatcataactgcctgactctctcagtgtggtgtggtggtggtgatggtgtgtgtcttcctgagtgtgttggttggggatgtggtgggaggggttggccagagagttgaataaagaggaggaaaaaaaaaaaggaattagatttttcagaactgcacaaccaaagatttgcacacttatttatagaggtgacccgtgagcttggttgaccctggatgcttttctgcgctataagggaacccgtgggtggccgatcactctctggccctccagagggggcctccctcctgcgcggaaagcgtcccggtgcacagcgcccagctcccgggtctctgtcggacctgcgactcccggcgcctttctggtgccctccacgccctccacgggcaggggcggagctgaggggcccacacagctccctctgccccaaacggggcagagaatgagtaggtgcctgcagccaggggcgcgcccatcctttcgcacacaacaggctcctgttctctaggcagtgattaagtgagaaaaagagaagcctggcttgggggtgagtctggcgctgggtgaatgtgaatcgccgacacggtctcctgcagggctgcggcgtcctggcccgtggctgtcattctgtcccggtgcttcacccccggccggtgtgaagccagtgtgaatccatggcccgcgcggacacacccgccaagcaggcacaggagcaaggggctctagctgcgtccactccccagggttaaaaattaactgtccggccttgctggcatctctgttgacaacgcgatcattcctgctgggagcgagtgcgccacagagattaactctgcctctccagtcaggccgcctgggttccactcctaagccttaccctctttaaggctcgttcttcataggtcagatggatctcagtcgtcctgaccgcatagggttgctcaggcatagaaggcactgggcacctggtgtgggcaagttgtgcctgctcagtaaatattaactaccgactcacaggacatgcctctctttttgctaccctcgcacgtttcttttctcgtttccttctccattgtcactgacccagggttggctgatataagtgaaaaacaccaagggtgccgtctgttatctaagtcatgcaaatgctttaaaattatatgtctgtgtatgtatgaatatatgtatcaggctctgggcacatagaggtgaaatatcatgtaagcaagcacttgtataattttcttcagataacaagcttgaaaacacagcctctacttgtttccttcccttccctgtctccctttctctaccagagctttctggaccatctccaaataaactacttgctctcaaatcccagtgtcagagtctgattctaagtgaatctagagtgctggcaacccagaatccttttccaggattcaggatggaatcttacaggagatacacagtcctataaaaagttagaataataacgcagcatcaatttgtgcttgatcattaagctaataatgcctcctttctccaccagccccatgtttctgatactgtgatgtgtgatgttgtagttgtgaaatgtaatattgtgatgtggcagacagattataagagttgaatgcaccaggagatttcctgtggcattataagagttgaatgcaccaggagatttcccgtgacataagtaattctcaggccctatgaagtgcaggctttaaaaaaatctggttcagcagccaaaagtcatcaaaaattaatgctagtattttctctctcagagaatgctaatgggaacatgttctaaagtccacttttctttccttccttgttttctcagctttttgagagtgccacattctctctttttgccctgacatctcccagcttcccaaacattctgactcagtcttttcttctctcccaacagatgctcctgctagctcttagttaggtaaatcaacttagcctctctatatgcattaattctctctcagttcccaaactctccctaataaagaagaacttgagagttgactcagctgtcccccagtataaagtggtgggcatgagggagagaaatgtgaattactgatacataattttccccctattaaactttattccttggaacatctttgtgaattctgcaaattcacaaagatattcatagtcctatattcatttgaattatccaaagctccttccagacccagttgacccatcttttctttccttttctcactggagtgggcataatttcctgccatttcccactgtgctgccgccaattctggctgtgtccattagtgtccctcttgacaaacttggatttgaaaaatgggcaactaaatcttcatttattagacgtgtttttcttttactaacagctgccatctgttcctctccacctcaatacaactcccccaatccctccagcatcctttttggacattttcattccagttcctctttattcatgtgcacattcaattgccagacagtttttgaaagagtagaaataagaagtaacagaaaatagaaataataataaaatactacccccaaaataaaagagacatgggaagagtttcttttttcaaaagggaacacataaacaacacatgaaaggttggaaaataacaaagaaaataattttttaaaaaaagatgtagacgcaggaaggacaattatggaatggctggaaagattaataataaccaaatagcttgagggttgcctgcagcagagatgaagagaataaatcagaatagaaaaaaggtttgcctgattctattttacagacagtctcttaaaatgtatgtgtcattcaaatttgttttgatgtgtcagtcatctccagcattcatcctgggctttggatgctacttagttgcacgactggatgtgttctaagatctgccatgcaggttatattctgatttacttgcttacagtgagctcctatttggaacatagttctgaatgccaaagaaaaccaaagacagaacacttccagctcaatttccatctataaagtggtcaaagaaaactccagtccttgaacttgtgttctagtcttttatgcactgtttagaggttctgcaggggctttatgcctgccctctgtgagagatgaagcatgttaccggctcctgatgaatggacatttaagatccaaaatgtattgaagtcgagttgtcatcacgtttttcatttgcccaagtcctatatccaaaaaaaaatgatgtttttcatcatttcatatagatgaaaaacaacattaccagcccctgtttcaaaggcaaaatgcattctgcattgtatatgagttgggtaatgtcaagtgtctgtgattgcagcgtgggagttgttttggtctgttttattttgacttaagtcaggaaacaataagtatgtttgtcattttccaaacaatatggtccaaaaccacttgtggctggtgttctttcatctccacggggcattccacccaacaatcaccatctgccagggacgcctatgaatgtcaaagttctgctaggtttctctgaagcctgcttctgctttcagcagctttgaataagctacagggccacaatttacttctattgtcatttcttcagggagatagagagaaatacatctgccactttagacaagaagcccatgggaagagtacacacacaatcagaacagccagagcaggattattcaattcagctgcaatcagaaatgggggaataagacagagaagaaaagccccatcttgttatgtgtaatgctcatttctgagccagtgtttgaagacagatcatgctttgtgagaaaaacatattttttcatcagataggatgtaatcaaccaagaattaatcattagtgagccattaaataattaattgtaaattgtaactaatttctgattattaaaatgactttttttttatacctgggctcctataattccccattttaaatagttaccaagctacgccccgataagataaagacaaaaaagttgcaataagttagctttggctatgtaacaaaccattaagacataatagattaccacaaaaagtatttattagttcactataatctgggtcaggcatttaggatgagttccgctaggcggatcttctgcttgtcttgcctggggttcctcacgcagaggcaatcagctgatggtgtcagtaggagccgattggtcttgaacggcctcactcacatttctggttttaatgctggctgctgtctgggaggtgcaagggattgggccctgtatatctccaacagagtagcccaagattgttcacatgctggtggtcaacagtgttccaagatgcagcaagacagaacaagccccagtgcagaaacatttttcaagcatctgcttatagcatgtttactatattccactggcaaaagcaagtcacttggccaggtctagggccagtatgggcaggaaatcacaagggggtgaacactgggaggggggtataaatcaaggacgttactgcaacaacctaccacagacgtatccttgaaaatgcttttatccgtatcaccagaccaaaactctagggactttgaatcatgtaagcatgtgccaaaatggatctcagctatcttcaaatccttctttggacaacttaaattcagaaaggtgacttttttgggcccaaagtcacatgactaactcaatactacattaattatgaaggtattggcaagcatctggaatcactgatatagtagtttcacttaatttttaggataggaaaatttatttataaggggaaaatctatcaggactaaagagtctagaaaatattttcagaaagaaaagacagagctcaggtgggcaggtaaacaagcagatgtaatgagggaaaaccaactgaagctcaaggtgttatgtttttcttatattattttcagattcataaggcagtacttctcaaacttcaatgtgcacatgaactgcctttccagggagaactgtcctactgcaaaaggtgtatgcccaggagacacttagctctcatccatgttgttcccagaaatcatatagaactcataggacatactctgaaacctgaattcctcctcctacagtgcaccttagggagactcgttcccttggtcgcaagacacatcctcctggaatcagtgtcttcttttcataactgcagttatccactgcagcagagaagagctgaattctcatgtctcccctccctagccagcccacttgatctaaaagtgttctgtacccaggtcaagttcctcaggcagcaccaatgtgaaagtgaggaagtgagacaggaaagggaagaaacaccataaagtgtgtgttttcaaggaaattaccagtgtgggcaactgggactcaggcttgctgagcacctctgggaaactgtggagaacatgactcagtcatccacccaatgggaagaaagttgggtgtttatccacaaactccctgtcagagaccgctggagggtgctcggggaggattagttctccagcacatcactcttccttaggcacacagctagtgagtcagagaaaagccttcaggcagagacagtattttggggtttctaaaagcagcttcaagcttgtacaggagaatgcagaaggaatatgggaaaggctagagtccttctgccttaaccatcgccggagtactaactagaaagtcaggactagcttaaatgtataatggttgtgactaaaaccaaggcaagcacatgaaaagcaacacattagtaaaacaagcaaaatgttaggcatcaaacagccctgtcggttatttctgccttttcccccttctgttgactggttgggttatgttgttgttgttatgccaaccaataatgtctcagctgccttaaataaagtatttgttttcaacattattcacccaagttactcaacaggaaagcaaagattttttccttgctttccattaggaagcaatattagttagatctggatttcattctgtccctgtcgtctctcaaaactgtgaccttggccaagttatcctccctcaacttcagtttccttatctgttaaaagacaatagcaattctgaccacataggattgcagtgacagaagtatgtaagcagcccatccatgaaaggcacacaaatgttgtcctccttcttccccactctccaatactctcctcactgctgaggattaaattcaattctacttaatcaatttatgttgaagttttactgtgtgtagactctgtcttggattacatagcaagtatagagctaataatcctttctttctaatagctttccattttggggaaagacaggcatataaagctctaacaaaatcaggtaatgataagtacttctttcaatgtgaagagcatcatgctctgatcctacagggagaaacaaattatcctctattttcttgtaatttacataacagtagttgattccataattcactctcaactgctagagtctgcaagattcccaccaactgccatcttcagcagaattgtattacacatgaaaaaacctttgactaacctctaattgattccgacattccaagaactattaaaaagagttgaaaataatctagaaactgctgacttgtatcaggcatagatttattcagacaaaacagagagacagaaggattttgaagtgagatggttttgtcaattgggcataacaaaggaagaaaaataaaaattatcgttcatgctttgaaaatctctcttgtgatgtacctctctgctacagtacctggcatttagaggtgtttaaccaatgttagggaagaaaactaacactggttaaacacctctaaatgccaagtactataacagagtactcattgatcattttattcaatcttatctactcttcaaagcccacaaaagaaacctgttgatcaagcaaagcttatcacacttcctgcaataagagagaacattgtcttaatggagaatggttttagggcctgagctgggtgatttcgaagttggtcttgcaaggcagggcacttgttgggactggaaaagtttatgaaaagtttctttgggttggtaagcatatggaggtaagggtcttgaaaggagtattgatgagtaagtcatcaatcttgataagtaagctgtttcattggtgttatgggataaactgtgcccctctaaaattcataggttgaaggcccaaccccccttcctcagaatgagactgtatttggagataggccttcaagggggtaattaaggttaaacaatgtcatatggttgagccctaatccaatatgacttatgtcttagttcatttgtgctgctataacaaaatgccattgactgaataatttatgaagaacagaaatttatttctcacagttctggaggctggtaggtctaagatcaaggccaaggccagcagttatggggtctgtcaggagcccagtctctccttccaagatggcaccttgttgctgcatctaccacagggaaggaacactgtgtcctcacatggtagaagtgatggaaggacaagaaaggtgaactctctctgatgcttcttttataagggcattaatttattcatggaagtggcaccttcatgacttaatcactttccaaaaggccccagttcttttttgttttgttttgttttgtttttcttgagatggagttcactctgtcacccaggctggagtccaatggcgtgatctcggcttactacaatctccacctcctgggttcaagtgattctcctgcctcactctcccagagtagctgggattacaggtgcatgccaccacgcctggctaatttttgtattattagtagagatggggtttcactatgttggccaggctggtgtcaaactcctaaccttaggtgatccgcccacctcagccttccaaaatgctgggattacaggcgtgagtcaccgcacccagccaaggccccacttcttaataccaccataatgggaagtaagttacaacacatgaattctgagggacattcagaccatagcaaatagtgtccttataagaagaggagattaggacacagacgcacacagagggatgaccatgtgaggaaacacagggagaagacagccatctgcaagccaaggagaggtgcctcagaggaaacaaaacatgccaacaccttgatctcggacttccagcctccagaactgtgggcaaataaatttctgttatttatagccacctgttctcacagccctagcaaactaatataatcggttcacagtcatctttttggtacttccagaaacaggagattaagtaacatacccaagattacaaagctattaatgtggagccagggttctaacttcagtctactgaactacaaaaccaagttctgcatattttaaactttcctctgaagcagaaacaaattataaatagggactaaatagaaagtaactaaagctttgttatatgtttcttcaattgctcagttttccatgggcagcacagggcactcattgctgtttcttttctacagcctccagcctaggacagcatttttgtttataagatataaaagccagccagtgttttatccaggtgagctgacactcttgtgtcccacccactgtcctcaggcctgaccatttctgggagcagagattctgtgatttccaactgccaatacctgcaactcttcatcttaggcagttcccacttggccctggttcagggcagattggaagttctgagtagtgaatgctccccaccagagaagccctcaaccaatgattgatgggagttggtggacaaataccccagttccctcctccctcacgtgggatgactctgagacatgttttctgtactattcccagaattccccaatgggattgacacctagttgtggacagtagtaacaagcctgataacataccttgtattggctgccttttctccccattgttgctttttgggattgcctcctagataaactatactcaagtctttgtcttggggtcttctggagaagctcaaatgataccaggctataaccactggctccaatctgacagtcacctcccatctccaacacctctgtatggatctctaggtttcttaagcaagaggccactttctttaacatgacctggaagagctggcatgatctggcacctacctacctattcttatcagggttcttaggtttaacaacagaagtagaatctgggtaactaatgcagaaaatgaatttattacaagggcatctctcacagaatcagattagcaagatgggaaccaggctgatttagagacgagtaaccaaggccctaccataagaaccatcgacttaggacactcctgcagaccctagcccaccttggtcctgatcaccctcttcctgctgccagattccacaacccagatactccccctactgctgaatgttcagctatcagtagcccccatggaactctctaaccagtatgtaccctcctggccctcccgaaagacttacagcctgagaaggagctgtgggcttgatatgcttaaaaagcatgctcccacagtgcatggagaaaggtctcttcccctacttcagcatctgcagaaggaaatggggatgtcccaaataatcagggtgctcaaatactgggttgccagaagacagaccccctactgcctcacagccccctcctcatcctgaagtccagccctaccaggctttgtgcagtgtcgcgaggccaccatgcttctccttgccacacagtgtgcatagaaggctcccctcttctgcccagtcaaactcctcttggctgcagaattcaggtcagccttcctcgtggaagatttcctgagaccacaaacatgtcagatcccccacaaatgcatgcacaacagctttcctttgagaaattcatctcccttgtaattgcatgtcatttgcctccctcccaagaagtcagctccctgtgggtccaggctgtctccacttttactcaccctgtgtgctcagcaccaagcagaaggtccagcacatattaggtaccaaataaatagctgttgaagagatgaataagtgaatgaacacatttataagcagctcaattttggtttttcacaaatcactacacagtttgtaaatagcaaaagacattgtccttttggcttagaggtgaggcagctcatattttcaatgagaaagatgttctctcatgacagacactaaaataacccaatggggcgtgtgatcaccttgattacatgttcccaaagaaatacttttttaataccaaatatttttcaaagtttttataaagccttccatctactcaatggtaggtcatatctcaattaactattgctacgtaacaaatgtaacaagtgtctccaaagctcagaggataaaaacaacaatcattggttattgtccattcatctagacgtgggctggggtaaactgttctagatgaggctcagcagaaagcgacaatgctccacgtgcctctcatctttcttaactactaatgggctatcccaggcatgttcttctcaagccaccagtgggctagcccaggcatgttattctcaagccaccagtgggatggcccaggcatgttcttttcaagccattagtggtatagcccaggcatgttcttctcaagccaccagtgggctaacccaggtatattcttctcaagccaccagtgggctagcccaagtatgtttttctcaagccaccaggggcctagcccaggcatattcctctcgctgcaatgacagaagcaaaagaggtcaagtggaatcacaggagtcctcttaaggcctaagcttagtcatggcccactatctcttctgcccccatgccattagccaacacaactcaacatgatcaagtccaaagtcaagagtaggttagtacctccacccacaatgggtacagcaaaggatgaaaattcaaagccaacgagcaatctacctcaatattagaggtcaggtgaatgataagaagcatttagagaagcaaacagccaaatggcaatcaagccctccatcagcgtgtatgttgtatgcctttgaaaagctgtcagagacagtacttgtcaaaactgtcaaagtcatcaaaagcaagaaaagtctgaaaattgtcacagccaagaagaacctaaggaactatgatgaataaaagtaatatggaatcctagatgagattataggtcagaaataagacattagttaaaaactaattaaatctgaataacatatgggctttaataataatatatcaacatcgtgtcattagttgtgagaaatgtaccatactaatggcagatgttaataacaggggaaattgggtaaggagtatatggcgactctgtgctttcaacatttttataaatctgaaactattccaaaataaaaataaaatggttttaacaaacacagcagtcagagatggaatgtggtttatgacagcaagaattattgcttgtctagactcaacaagttcttaaccttattacagtcttacaaatgacggatttgttatctagggaagaaaaagccctcttctgggactctgagacaaaggatttatttgtacccacctgagacgtgctcagagagggactggaggtgcatggagagggctcctgtcagaatcttcaatccgggggaggccagctgcctgggatgtggggctgcctgccctcagtccctatgcagcctccctttgggctccttccagcctcactccactgtgatcttactcttctcagtatatctgtagtcttctcatcctcccccttcttctgtctcctcatctgtgtgaaaagactggatgaattctagacccaactccaagcttctatacgtttgcagtaacacaatgtaaacaggctaacttaaaagtccacagctacaagatcatttatttttcaaaatctaattgaagtcacagctcctttcaaagaaagcactgttcacctcaaagaaggtatcctgagaccacgaacagatcagatccccgacaaatgcatgcacaacagctttcctttgagaaatccatctcccttgtaaatgctgtgtcaatcacattcctcccaagaagtctgctcccggtgggtcggggctatgtcaactttggctcacccctaagtcctcaggacacaggacataagcagatgcattttccgagggcgcccggcctaactgtaagtctcgtgaaggcaggggccaacatgaatacatcctgtatcctccaaagatttagcaaaatgctaggtcctgtgccctaccccgacccccacccgtaaataccaaggaaggaagacgccctctgccccttcccctctcctccctggggcagagcggcgcccggacctgctcgctgccatggcaacgcggcgctccctcccatagacagtgcaccctccacgaagtcaccgagcagctgctaccgctgtgtctccgccagtgccatttctgcttcctcgaattttaaattggccagaataatacaacaaattaaggtatttgctggtttctattaccattttttggtaaatcactttttccctattaatgcatgggaaagagattgccagcaaacacaccattaatttcactgagaaaaagctttaaatgctcagtcatgtttttctaatacaattcagtgcttccaaatttatttactgctgcctcaaaaacaccaagtaaatcatgcttttatacacgcacgcgatgcccatgttgagaagaaatttgctaagcggctgtgtttgttgaatcctgagcctgcctctgcacctagaacaatcccaccatgaaatgaaatgaatgcttgcaaagatttcttacttcctcctttaaagagtggtaggaaaatgaacaaagaggataaaaggaagcaagctcatcatgcattcaccaacgttaaatttccaaacggtagttacaaagcatttttaaatttaagtttcattaaagatttggaaatatattgctttttttctctgacttctcccagaaaagtttttgggatttgggaattttatgtgtaggttttccacaatggagtttccttcccatgtatgtgtgtgtgtattttaatatatatataattatatgttacacataccatatgcaatatataaatattacctaacatatattacataattatatattatgcaattatatatattataaaattatacataattttatatattgtagaattacatataattatagaattatatgcaattttatatatattaaaatacatagacaaacataatttagtacatatttattagcagtggggatatttgtaatgcagataattacctgcagctttaaatgacagttttactgatacactgtatgtttggtgagaaagggtgctatgtatggtaaacggaagaggagaggaggacacaagttcaaagtcgaaaaaggttttggagattatcttccaatctaatgccctattttacttgcctagaagatgaggaccagaggaaaaactgacttggctaacaacacacagtcaacttgtggctgagctgtgagttaaatgatgaaactgaagcaaaatcacttggatttctgcatgggagttgtcgacagtcatgaaattacactcaaagactccagtgcattcaactaaatgtcaattagtatctaaactttgccagaacacagcaaacagcagagctaagacatcctgtgggtgatcttccctccctgcagcctggcttgatgaattagagttctttggttttcagaacgtggttgctattttcttctccagctccattagcaggttgggaatggcacactagctttttaattaaaaataataataattaaaataccaaacacagtgttgactaaaaacaaaccattattcttccttaatcacttaggcttagtaatttctctttgtatttggcaaaacttcaaaaggagtaaatcaatgttaaatccaaaatttaatgactcgagggtttttggagaaaaagaaacctagcagtacatcacaataaggcaggagccagaataagtctgggctgttttacaagatgctgtgttctaccactaaaaagagggttatcataaatattattagttatatatgagctaaccccaaaacatcttgattgccttacaagtcaccttttatttttaaacttatgaaaatgttcccaattattcagaagcaagatcattttatatagagttctactgttaaaaacaaacacattctgttttattactgcaaaccctacatgtttctccacaagctttgtctaatatttaaactgaaagacttattacacgtattgaagtgcatataatgttccaaaatagacggtcaccaagtttaaaaacttcgctctctcagctaacacgtgcatatctttaacaattgacaaattacatatgcaggattgttacacaaaatgaaaattaaaaaagaaaaacaattgacaaagcgaagcatatttgcatgtattaactcatttgttttgatcttgtcctatattcctaaaagtcacagaagataatctgttacgtaaatatatggtcagtgtggaaaattcaagaagtatatgaaggaaaaacagaaatctccctctatatcgagcccctctttcatctccacaccccggaggtaatcattattatcattagtttggtatctatctttttataacagaactggccaatagaaatgtaatgtgagccacaactgtgtacataatatgaagtagccacatttctataataaaagcaaaggaaatgagagaaattaaataataatatatttatgtaacatagtatatccaaaatattatcatttcaacatgttatcagtacaaaattataatgagatattttacattgttttcttgtactaagtcttcaaacaccagtgtgtgtttcacacttagagcacaaatcaattcagactgccaagtttcaagtactcagtagccacacagggcagtgactacctatgggacaatacagctctagaccttcctttctatgtgagagagagactgtgagatagtatatcaactaagaattcttggccgggcacagtggctcacacctgtaatcccagcactttgggaggccgaggcgggagtattaagaggtcaggagttcgagaccagcctgaccaacatggcgaaaccccgtctctactaaaaataaaaaaaaattagttgggcatggtggcgcgtgtctttaatcccagctactcaggaggctgaggcaggagaatcccttgaaccagggaggcagatgttgcagaatcagggaggcagaggttgcagtgagccaagatcgcaccactgcactccagcctgggcgacagagtgagacttcatctcaaataaaaatacataaattaaaataaaataaaataaaataaagaattattttgctgccaagaacagaagtaataatcactgaaataataaaggcttcaatcagccaatgtaacaggaagtctacaggtggccaggtctgaggctggaccagcagctaacaatccaggcctcaggatgctctctgcaattgtctcaaccatcccctgtggttgtaagatggttactgcgggtccagagagcacatcttcctactccagcttccaaaggcaggaagcagaagcatagctgagaaaatgagaaagagctctttcttcactcatgaaggggaaaaaaatctttgtcagatgccccctttatatcttttgctcagaacagatcacatggccttcccaggttacaagggaagctgggtaagcagctgtctggctcttttagtctccacagtgagaatcagtcataggagatggggattgaaaatgtttaaaaggtaagcacccaaagaactgacatggatagatctaaaggtagcgctcctgactcaaacagcgttcctacttcagagctggatggactcttccagcccactccttgtgggctgtgctgatcacacttccttcataaagtatgtaaaagaatgtttcagcacatctgcagcacgttggacattattagattctcaaataaccccgtacagtttacactttcatgagtgtcaccttcattttacccagaagttaaataactttctgaggtcacagccaagaagaacctgagtcatgaaccatctattaaacccaggccttctgtctacaaactcactgctttttccattctcagctgcaatccacctgacaagtaaagaatacttcatgaaaattgaaagtataattaaagaatctcaagttgaattttatgacaagtttgaaaacccaatgtaagacccttcccaggataagctctggcatttataaaaatccaaacagccagtctgtgactgaccaccagaaaaacagatcttggggcacttaaatgatctctctactgtgaaccactcagaattgcttttattattggagagaaggtaaaaataatgacagcaatggtggttcataatcttcaaagtatttttatgcccatcatctcgtgtgattaaaaaaaaaaaaacctctgaggttggcagaagtgtgcaaccttatttgataaatggtaactaagactcagaaaagtaaagtaattgggtcaaaatcaaacctgtaggctaggaccctggtcttggatgctaggaactatgagaaagatggatatcagaagtcattagaagctcttctattatcaaaactttctcagtggtctaggcactggttataataataattatagttcacacttacagagcatttattacatgctaagcactgttctgaaccctttacatttgttaacttatttaatttcacgagaatcctataaaattgtgcatcagtgctatgtcttcataacaaactaacgaaacttgcaggtgttcacagcaatatagacagttacttctcattaacagctactaaatgactggttgaggtttggctgatctagggtggactcagcttgggatggctttgagcccaagggttgcgttaaagtttacttctgattcatacaaataataccttgcttgtaaatttcacactcaatggacctcacacacaaatactattttcttagtcctcctgagtgggagttggagtgtcttggtggaaatgggaggattctgacaagtagagaaatgccctgatagccacctctatcaaaaagccaagtggagttgaaaatagggcactggatttgataagaaagagatcactgatgaagctgtcacctgaaatctgggagggacaccatcaagcacagctttctctagggcaacagttctcaaattgtgtcccctgaaccagcagcaccagtgtcacttgggaattggttaggattttctaagaccctgctccagacttacggaatcacaaactctgagagtggggcccagcaatttttgttttaataagctttcctgaggattctgatgctgcttctaaatgtgagcaccactgctctagaagaacaccaagaaactgagctgtgcacagcattcaccattgctgacctgctagaaggttgatggttttcaccgtagcatttgtaatcttggttgtatgcaccctgcctttattttactatatatgcaatatagtctttgaagtccctgtcctaccaagagaatcctaccttattttgggctttggctgctctaaaaatgaaaagttttgaaaagcacaagtcaccctaaattggatcctgggttgttttttgatgggggcataaagaacatcattgggacaattgatcaaatttgaataaggtatagattagataatagtattgtatcaatgttaatttcccaatgttcacaactgaactgtggctatgtaagagaaagtgactgtttctaggaaacacatactgaagttttttaacttcagagagcatactgtttgcaactttcaaacagttcagaaaaaaatgattttgcatatgtcgtatgtgtagaaaaagaatgataaagcaaatgtggtaaaatgttatatttagaaaatctgaatgaagagtatgtaggaattctaaatactcttttcccaatttttgtattatttccaaattaaaagtttacaaagaaaaagcaagtagatccaccatgacttgtgctccaaatgtatgcaactgattttgcagaatctcatgcttcatgctctatcctgttttggagcataactttcctccctccaaaggaaacaagagacacctatggaaatgctgatggagcgagggtggtcaccaggcatggagcagcacaggaacacaagcttcttgaggcctcccaacttgataatcttcacagctggaaatgtcccccttccttcagaatttctctgacattattgtctgtcctgggatattattgctcatttgttagtactaagaagtagtttaagagagcagtctctggggccacttcatgtatttatggcttcaaacagccagggttcaaattctgcctcatccactttctacctgtgtgacctcaggcaagcccctgtgtcctcatctgtaaaatagggatgataatagtaacaaggattaaataagtgtaaagggctaagaaccgtgctagcacatggaagttattcagtaagtcttcactgtgctattatttccatacatttcttccttctaagtcactgcatatatatatatatatatatatatatggcttcaaatctagatagttgtgtattcatagtatgttcacaacatgttcaattcatctggcccattctctcacttcacacctgaagaagcagagacccagaaaggttaaataacttgcccaagtaacacagcttgtcagtgttacttaccagctcaagtcacttgtgcctggaatcatttctcccagcatactctccagattggggatctgaaagagcagtggagtgggcaatctacttttccagagaaggtctttatatagaaaacagttttgcctggagggagccagaaacctcctgatgtaggaataacgcctctcactagagtcatcagagtcactggaatgagaaattaccgggtaccacaggcacactgaattgtaatttatttttcaaatgtgtggtaagttgaggacactggaaatgagcatggtacaatgagaatcagaaaacagtgggttaaaatttaccaattaacttgggtatgccacataattcccacaagccgcattctctgcatccacaaagtgcagttagtggtgcttctctctcagtgtggtgacagcgatcagagcggattcttacgggggggcaatgagtccagggccacggatggccaaaaaatgttctttgcttcaaaaaaggtgatggctgactttggggcagagaaactggtggtaaagttaaggctggggagggccaataggaaggggccatgaggggtggagaacaacacctggaagaaaatgttcctgctctgagagaagtagaagacctggaaccacaggaccagtacttctcacccacacatctattgtatgggcctgggatggaaatctgcgccaccaactgaatcttcaagcaagcacataaaatagtggtatttcatttctaattacacattctgtcagtcatgttgggtttcccctgcaattaactggctctttacaaacgcattagcatatacagccaaaggcattggtttcagactgaggcaaatctggtgtaaaaccggcaactcagaaattgtgtgactttgggcaagttactcagagtttatgaagttcaatttcttcattcgtagaatggtggacaattattcagttactattgctgtgtagcaaattaccccagagcctagagaagaaaggaaaccacagttttttggctcactattttgtggttcaggaatttgggaagggcttgcggttcccacttgggatgccatatacttgcagtcagacggcagcggagattgggggggttgtctgaagactcaacagggctggatgtccaagatgtcccatcacatggctacaggctgggagcccagctgaggatcaaccataggaccaaagctcagcctctccaggaccatagcctcagggggctcagacttctttacaggctgactggcttgccctaggccaaaacacaagatgtccttttctgacgtattcttgtaagtcagacagcatcacagcatcactttgtgtgtgtgtgtgtgtgtgtgtgtgtgtgtgtgttccttgtctagtttttatttgtttgcttgtgggctcttttatttatttcagtaggttttggggaaacaggtggtgtttgtttacatgaagaagttctttaatggtgatttctgagatttggcacacccatcacccgagcattgtacactgtccccagtgtgtagtcttttatcccttgccccctcccatccttccccctaagtcccccaaagtccattgtatcatttgtatgcctttgtgtcctcatagcttagctcccacttataagtgagaacatacgatgtttgatgttccattcctgagttgctttacttagaataatggtctccagtcccatctggattgctgcaaatgccattatttttttcctttttctggctgagtagtagtccatggtgtgtgtgtgtgtgtgtgtgtgtgtgtgtgtgtgtatcatattttctttatccacacattgattgatgggcatttgggctggttccatatttttgcaattttgaattgtgtggctcatcacagcatcacctatttcatgataaatcagtggttgaatcagtcacatgctcatccaggtcaaagagaggaacacaggttctacctcttgatgagaagaatatcaaagaacttacagatatgttttaacactgtcacaattgtaataccactttataatattgttgaaagaattagatatataatcattgtaaagtattttgcatttggtgctattgttaagatttttatatttgcatatagcagggaaacaggttgctgcctctgagctggaaagatgcaggttttaagagacaaacacaggtatacaccatcctttctttaagccacagctttataaaaacctagtcactcaaacccaggctagcaactagttgaatgccattgatttcttagaggaattaaccaaataccttctctgggtccctaagatgcattgatctcctgctttcctccccagcactgtgcgaatgtcactgaatgatgggaggctgtttaaatgggtagaaatattgattttcttttctacctttttgaaagttctttgcttaccaggtgctgagcaaacatcaggcaaacggcagtccacatagaaatagatgatgtgaggagcaacaatggcagttctggcttctgaatgtgaagctggttaagcagcaggtgcccccactacacactgtggttttagattcaaaaactacacatcattgttcacacttcgtcatttgctaattgataatacagctcgcccctgtggcactaagtagcatagtggaaaatatttccaaccaatccatggaaacagctccatccgtgtctgaagagggtcgactgaaagctgagatgaactgagggccagtgacggggtaatgaggtgcatttcggaggctggggtctgcatcctaggtgtccatgtgcaaaattggttatacccttggaaatgacaacaatgttctgtcttagtctgtgtcagagatgacagataaacacaggttaagaaatttctgggtttctttgatatagaggacatccaagaaaccatgcatcaacattaggttgctattgacacccaaggaaactgatgtgtggttaacttctccgaaagaaaaagccaggggttccctcagggagccaaagggcagcagattggaaatcactcgcaattcacaccattggaaggaaaccaatgatggaggatggagaagagccctgtttccaatatgtgcttcctaaaggatacagtcccagagaacttgcctcaaagaacaacaaaggagaatccccagagagtgacactttttcatgattttgtcagatactctgaatttaagtagattactgctttcaacagaatatgacgaaaaccacagtggggcattcttgggcttgcttttcagtttttgcgatgttcttagggaaaaggtcttactgggtcaggtttgccaggctctgcccttggagcacattttcagcacttggttggaagaagattcatttaaccctcagctgtagatgagaacaggatgcagcaaatttactgcaaaccagaaaataaaattggcttttctatccaagaaggaaataaagaaaactctgccttatcttactttataaagataattcttttgttttccctgaaataaataataatcatttaaaagcattgggagaggtgtgcagtgactcaggcccgtatcacaacattttgggagtccgatgcaggaggatcacttgagctcaggagttggagactagcctgggcagtatagggagacctgactctttaaaaaaaatgtttttttaattagccaggtatggtggtgcatgcctgtagtccctgctactcaggaggctgaggcaggagaatttcttgagcctgggaggttgaagctgcagtgagctgtgatcatgccactgtattccagcctgggtgacaaagcaaaaacccatctcaaaaaaaaaaaaaagcattaggagaagagaaagagggaaataaggtctaaatgtcccctttctgcatacaatgtgcctgggttcaggtcagatcaggcaggtactggaacttgggttcaggtcaggcaggccctggaacttgggccagttgctcttacctgtccctgaactcaagcacttccacacctgcattccctccagactcaggttctttcttctgagaagaaaccttacattttttttgggggggggggttgtgtttttgttttttgttttttgtttttttgagacggagtctcactctgtctcccaggctggagtgcagtggttccatgtcagatcactgcaacctccgcctcccaggttcaagcagttctcctgcctcagtctcctgagtagctgggattacaggtgggcaccaccaagcctgtctactttttgtatttttagtagagatggggtttcatcatgttagtcagactggtcttgaactcctgaccttttgatccacccatgtgggcctcccaaagtgctgagattaccagtgtgagccaccgtgcccagctaaccttatgtttttaaaattgttgttgttggttttgttttcaagtgaactttttgcctgttctgtcaggatcatttcaggagagtagcaaccctaaagaaaactctctttttctttgacataaaacttatttttaaaaaattaaataaatacttagtgagttcctactttgcatctggcacttccgggaactcagaaacagagtgagagaggggtcattcccagggagagggatggtactaggagatgagacaggactgggaccttcctagagctctgggtgctattgggagggcaaacaaatacatgtcattcctggaatgattaggagacactggcaattcaaagggaagacaatctcaacacactagtgcgatgggtgagtccaaattgatagcagaacttccagcaaatcgaccctccttaaaattcaagatagaactcttagaaaggatataggaatgttcacatagcatcttgtttttgaagtgattttgtggcctcatcaaggaatcccgtctagttttcattaagaacagcacacatttttagggagatttattcaacaattactataacaagaccctcccctagaaagcttcttagggatacacagcacttttcagaccccatacaacagttccataaaagtgatcaaatttcacattgtgaaacgagacacgatgcagctttttaaaatgctgacgaggcatgaacaacctggtggctttcatttgctttttgacctgagcatgttttgaagtggaggagacaagtgaacaaagtgaacagaaatcagtgaactccatcagagaaccacggtaggcttgttcacaagctgctgtgagccaccacgtcctgggtttctttgttttgcagcaacagtagctggaacacaaacattgagctcatgatccgtcgacatttcctcattggctttggccatttagcattgcaggcccagcccatgttgatttttttattcctttacaattaaaatgttttggttgtttttgttgttgttgtttctgcttgaaggcttctggaattttgtctctatcactgcaatttaaatattccctggaatatggctaaatacagatctcatgttattaatcttgcctagagtgaagtgagcctttcattctctacactgaagtgttttgcttcgtggcttttccaacggttctgtttatttgtttgtttgttttccaggaatattgttaggaatattcccaagctgaggagctggtacacactgataaatctggaactgcccagctcccctgtcattgctgccctcggtctaaggaccagcaatggaaaagagtagagtggcctcctaactatgcatagactatgggctcagtttactgtagattacagtgaacactagcaatggacatgtcataagttaatgctttgaccttcggattttaggacctaagactcaacatttgccttttataacatccatgcaacccacccctgcctgttatgtgacgcattccccctctcaggcctaagtttatagctctctggctataaattcctaagcatggggtctaccccaaatgctggcatcactaagaacaaatgggacaagaaaacccaccctttacttctacctcctgaggctcctcagtaaggagatattgaagcttttagagtaaacacacaggcggcatggaggaagagtcatgcaggtccccatgaaaagatatctgacttgagatcactcccatttgatagcagtagcatttgctgttgagaaggcattcagaagtattcccatcccccaaactaactagctttattgttgaatctgtttctctgctctgtgtcctacacgcctataattttccccttttgacattttaatctctttctggtaaaactgctaaaattcacctgtcattaccagtccatttctgcattgtgaattctgctctttgctgctttcaaaccagatttaatttgggttttgtgctgggcatcctcttcttgtctctatgattcttcaatttaccttttgttcctttttaccttttgtatcttttgtttaaaaaggtaaaattcttcaattttactgcttatcttgtgtttttttcctctccgtcttacggatttgggctcctattttgttacaatcttgatgtacatcctaattaatacaccaaggaatttcttctggttcttacgcttagttattttgcagtgcagtgtttttccctgaatcttcagcagaatgttcccctcccctgttccttgcatttttcattccagctctcctatgtgggcttcttttttctggcttacttatttttaaatgagataagctttacccaaacccagaattcaccaccagactcactgctgggttgtccctgatctgtccattaactaagtcacctcctgagagatagcactggaagagcatagttctttgccaaattcccaatgtttaaaggattggccgggcgcagtggctcatacctgtaatcccagcactttgggagactgaggcaggtggatcactttgaggtcaggagttcgagagcagcctggccaaaatgtctctactaaaaatacaaaaatgagctgggcatggtggtgcatgcctgtaatcccagcaacttgggaggctgaagcagcagaatcacttgaacccaggagacagaggttgcagtgagccaagaccgcaccaccgtactccagcctggaaggcagagcgggactgtctcaaaaataaataaataaaataaaagattgcagggtttaaattgaatctcttcctacccttactgcatatttctctgacattctgaacaaataagtgattaaaaaatgacaatccaccagggttcttatgtttccactcacacacttgaaagttgtgatttatagctcccgaagtgaagcgggccgcccccagtatctacctcctttccataagctgtgtattttggaaatgtatatgtctacgtattattttatgtttaccctttcaaagaaggggtcttgctgaaaaattcccttgttttcaggaaccctgcagagatggaccgtcaaatgtgtttatctattcagccgcactgaatagctacactacttagcagcaattcttttgaattctagcagcagatggactatgagttctgcttttcatggcgtgtcttgagtacttcagtgagaaactcaagagcactaggcaaggagttagtatccagaagcctctttcagaaaaatgattctggcagaaaactgtttttaagagggacagacacaagagtagaataaccacatgtgctctcaaaagtcagacttgtttacagaaaaatctatctccacaactttttttttccacagtgttccatgaacatgctccagggccacctctcaatactcacatgtgcaatatgcatttttgcatctttccaatcctgtccagcctgcttcagctgctgttcagtgagaaccatgtgttcccaaaactgtaagtttagcctggccacaggggtaattgattttctttgatttgtttgtatgaagcactatccagtcccattttacaagaaggagaattggagtagacagtttaaggagtggactacatactgtaaatgttcttgagtgataaggtgtgtgtcacacccagcaccagcaaattacacatacacacacacatacagcaaaattagcatcattcagaagttcttcccacacattccaagaaacattgttgagatggtgttattattccatgcttacttatttagaatgcatttagtgttaagcaatctataacgctcttgtttgtttctttgcttgtttgtttgtttgtgacagagtccttctctgtcacccagactggagtgcagtggcgtaatctccgtgcactgcaccctccaccccactgaggtcaaccaatcctcctacctcagcctccctggtagctgggactacaggcatgtatcaacatgcctggctaatttgtgtattttttgcagagatggggtttcaccatgttgtccaggctggtctcaactcctggactcaagcgctccacctgcctcagccttccaaagtgctgggattacaggcatgagccaccaggcctcgcctataaagctctttaataaacttttttttttttttgagacagggtcgtgctctgttgctcagactggagtacagtggcacgatcatggctcactgcaaccttgacctcctgggctctagtgatccccacctcagcctctcaagcacctgggactataggtgcgcaccaccacacctggctaattgttttctttttcttttcctttttttctttttttttggtagagatagggtcttgctatattgcccaggcttgtcttgaactcctggcttcaaggaatccttccaccttaacctcccaaggtgctgggactacaggcataagccatgcacctagccaacaattattttttatcacaacacagcgaggttcctgctataattatcctgactttacagatgagaaaacaaatgtacagaaagcttaaaaaacttgactaaggccaaacaactagcaagtggtagattcagtatgtgggcctagacagtccttctccagagactgactctcactatccctttattcagcactctctgtattgcatgagaaaaaatacatgttgcatctgtagctgaacttcatacaacgcacaccaactacatttgggagacagattcatttatttacaaattcccagtggccaccaaaacatctgatagttaaaaagcccatcttaaatgtttgtggaaatgaatggaattggatggttttagtagcttcaatttgactcatctaagaaaacagtataacccacatgtagctgtcctcctgagggtggcctctgttttcactatctgccagccatgaaacagggctgcttcatccctgcacagatatcttcagtagaacttgtcagcaaccaacctcacttctccagcatgaatattagctctctctctgcatgcgggaggcagaataatgaccttctcaaagatgcccacattctaagccctagaacttgtgaatatgttatgccacatggcaaggtggggttaaggttttagacgaaatgaaagttgttaataagctggctttgagacagggagattatcctgaattatctgaatggccccaatgtaatcacgagtatccttacaagaggaaggcagaagagaaagtcaaggtgatatcatacaagaaatatttcatccactgttgcgccgttaatgatggagaaatgggatcataagccaaggaatgaggaagcctccagaagctggaaaaggcaaaaaaagaatccctgccccctacaagagcctctagaaggagcacagccctgctgacaccctgcttttagacctctgattcctagaactgtaagagaatgaatttgtgttgttttaagccactaagtcggtggccatctgttacagcagccacagaaaactgcccactgcaggatgaaaagccactttctcctggtatttctcaaaggctaatctaagagcatggattgttctgtatcttccaggagcactattgcaaagtcgattcattacttttttcatttgttccgcatcaccgtgctggggctcattaacgccctgtcatcgggtgctctgtgcgtaagtagaagtgtgttaagaatcaatcgctctgacctttattccctgttggtgttttgtcattcgtgggctgcttggcttgacatatgaattactctccagctgcctggtgctggggaggcacagtcaccagcccccaaatatttcagacatatgccaattgcaatttcaacacacattttttttctaccgtcaccctggaactgttccattggcaatgcatgaaatatgaacaagaggaaataattgacaaggcaccactgttgactaaggggctaacctttgaggaagattaaaaacagatgtccttgaagaagaaagaactgaggaagtgaatcttctctcctcttaactctttagttcattgtcctcatccaaaaattaaactaacacactctgaagaaggtttaaggagatcaggaattttcaagaattcatttgtattctgtagcagacagcttgtttgttccccattgaaaacctacaagaaacaatactgcaacctttgttatagcaaataactggtgggtgtatccctccatgccaaacacatgccaagcataaaaaatgtgcctagaaaaacaaataactttggaaggctcttttcccagtgccttcttacttcctttgtcttagtcctcctttctgtgatggtgcccaacctaagccctggatcctttgctgttgatttcagtagcatttctccctgacttgcaggaaactgcccaaggctttcaaaattaccttttccataaactcctgttccttcctcgaacaatctcaaccagcatctttgcaaaaagctgcctaattaatgacttcatgcacaagtgtgggtaagtgataacacctggatgtgttgcccttcccagaggacttgttttccaaatcttttcaaatagagacataatcagcctggataatgagtgctcaaaactaaagcttaacccttcatggcaggagtgtggtcagtgtgcgtgtgctcaggggaggtgatatgggtcattggaggctttctttgtgcccctcaaatcacatgatttgtactacccaaatgctgcccctgcttccactctgacgatgaaatgatttcatgaatatattgaccattataattatagccagtgacatttatagtatgcttcattattctcaacaagaaaagtttatttcatgtcatcctcaccaataagcctgtgaggtcaagaattccatcatgtccgtgctatacaccagaaatcaacaaactttctgtaaagggccagagagcaaatatttcaggctttgaggccatatggtctctgttgcaattactcaactctacggctgcagtgtgaaagcagccataggcagtgtataaacaaatgggcatagctatgttccaaaaaatttatttacaaaagcagtcagcagactagacttgccaaacccatggtctggatgaagaaagcacaacctggagaatttgaggccctacctcagaacatgcacaaatcagaagcaaaccacctcagaacccaaacccagttctttcttacttgaaattcggtgctctttcactgaaccacacggtttggggcatagtctttagcattcaggagagtcatgactttggatcaaatcaagaatactctccacccacccatctcccccgttttcatcacacacacctgtaaaggagcagctggggctggggtaccatcattagcctgtggccatggaaacagagtcaaggtaactgacccacaggaccaagacacatgaccttgatgctattagctctttccattgaagcttgctggccatatacagcataattgaatgaaactgcagaacttcttcagtcagatccacctgtgccttccagaagcacattaatgaggcccccctccggcacagaatgggaactaggcaatccagacacatccccacccagcatcctccttctggttcactagcagaactggatcatgaatcaacaaaatgaaggaggctttgcaagaacaaagcttttggaacctgtattcctgggtggtgctggagccattcattcctagccaggtgccatgagcactttctctgtgggcgctgttggctcccctttacctctcacccccaaacgcctttccagggaggtgtagtgctgagtgcactggtcagatgtggggacactgactgttcacagctggagtgaagagggacagagacttctcctcgtctccccaccatccttctgttcctcctcccatttgtcctcccaggagctctccttattagactgaggccctttagcctgcctgcaatggaaaacagagccattcacctggcccaggcaggctctttggggtgctacaatgtgcatggccaaagctattcatgtattaaagaggcttagctagctttgcttctttactgcacttacatctcaggagacactcattgagaggaacatgtcattttggccaagaacagcatttagggactttctagcttctctggaaaattgtcctgtcaagtacaccccagtctaaccattcctgccgtaatatctggcatagagcctccatcttttaatatccttttccttaatataatttcctaaatccatctcctaacattgccccaccaccctggaaacaagcatagccctggctgcaatgcacatgttccaaccaatatagaagctgagatttcactttctcggggttctcgttggctgccttggcacctcgctccacaagaaacatctttgatccctccctaattacattgatttatctcacggtataccttgtatccagagctttagatgatagatagcaatttgttaatacttgtcactaagactcaatgactggaactgtggtcagaggcatgcagccatatcctccctcctcaattgatcatctttattcttgcaagatggtccaacctctctaaatgagggcaatcaatactgtgcattcagccataatcgtggcttaacttggtattctttgaaaacttaagctgtgtaatttgcctgtaattgggctttccaaaaagtcatatctcctgctcaaggaagcaattaagccggcacactccctgtctgctgcctgctccctccctcctggcatctgactgccatgggccaagtcttccctccgcagacctctctcctctccagatccctgtttggatctcgacaaccaaagccagcagttggcggcaaagcagatgaactagaatatctgagccccttggagaggcctttttcttccataatctcccacatcacttccatcaatcgcttttgggggtttctcgcttgatgagctgtgtccagctcatcaattcaaacactgagataacacaccgcattgcaaaggcaaaggcagaaaagctagagccccaacagtgaaccctcatgtaaaccatggaccgtgggtgatgacgatgtgtcagtgtcggttcagcacgcgtaacaaatgcacgctgtgctccagcagggatgttgataataatgggaaggcagtgcatgtgaggagacagaggatatgtggaactctctgtgccttcttctcaatttgctgtgaacctaaaactgctgaaagacacatagacgaaagaaagaaagaaagaaagaaagaaagaaagaaagaaagaaagaaagaaagaaagaaagaaagaaagaaagaggagagagaaaaaagaaagaaagaaagaaagaaagaaagaaagaaagaaagaaagaaaggagagagaaaaaagagaaagaaagaaagaaagaaagaaagagaaagaaagaaagaaagaaagaggagagagaaaaaagagaaagaaagaaagagagaaaagagaaagaaagaagaaagaaagaaagaaaggaaagaaagaaagaaagaaagaaagaaagaaagaaagaaagaaagaaagaaagaaaagaaaagaaagagagagagaaaagaaagaaagaaagtctaacaaaaagatgtggagacatgcccctcatgcagatggggacttgtgttgcatttaggacacacttaggaatggactccagctggcttctcttctcacatttgatttgctttgtcttcagttagctaagagcaagaagattaaagtccaggcatctgggcagctttggagtgagatgagcctagcttgaggtgttttggaacaagggaagtcactaccccactgcctttctacattacaaaaacattagcaaaattatagaagtaactgctggcatttcttgagttcacacagtgggccaggtgcttatatgcaccatcacttttgatcctcaccacaaccaaagtacacatgggagtggaggagcagcacagtacgctagagaagtacctagctagactgctggagtgtcgtgtcagtttgcgaaggctctcatatggggggccacagccagggtggcttaaagaacagaaatgtatggaggtaaaagtctcagatgaaggtgtcatcagggttggtttcatcagggccatgagggaaggacctgttccaggctctttccttggcctgtagatggccgtcttttccctgtgtcctcacaccattccctctgttggtaacagtgcctgaatatgatgacaccagttatattggatgagaccccaccctaatggctttaattaatgacctctttaaagacactatcttcaaatgcaacctcattctgaggtactgggggtaaggacttcaacatttgaacttagagggaagagagtccagcccacaacaggcatgacccgtggctctgcccttggctaaccataggaccgttaaccagccacttggtgtcttcatgccttcactcctaacctctcatgtggttgtcggggaaaataactgagataatgtacatgagtactcagggcactgcccagcgcaacagtcagccctcagtaagtgtcagccatcactagggtttatccttattttacaggtgagcaaactgagtcttaaatgggctccacagcttgctggagaccccacagccagagaacaacaggtatagcagggcctgtaactcatgtctgcctgtccccaagaccaagctctcatccacaatcctatgctgcctccttcacaatattacacagaaggcagctgtgtgcctacaaagaagtcaagctatattcccctttctgtgagatgaaggatacacaacccaatccatctcaattcttaccagcttcccaaagcgtgaaacgaaacttcccagccctgcctctaacaccttgtgagaggaagaacttactctgtcactatctggtgcccagctctgtgagcacaccccagaaatgcctcagatcctctaccctccccaggaagataacagtgacaaggatgaccaggccagggcccagaggtaacttctatcttcagccctaatcctgtgtcccatatggatgcgtcctcaagcccatccatgggtgttagagctaaagtgttttaacctaccaagaaaaaaaaaatcctcagactataataaaggcaaggtatcttaccatgcaaattaagaggtttttcataaataaaagattcatgctctttgggtacttttgctacatttttaatacttcctccagcacactggctcactacgctggctggtcatttgaattacctggaaagttttaaacaccgctgaggccagggcccatccctagcaactctcagttccctgctctggtggttggcctgagcacagggcttttgccaccttcccaggtgattgcactgtgcagtcaaggctggggacctctgcttcgcgaggacaccttgttttcttgtagtgatgttaactccagtctctgcctcctccatctccacatgcctttcactctgtgtgtctgtatgtcttcacatggcattctccttgtttctaggccctcttagtataatgacaccagctgtattggattgagaacccatcctaatctagtatgacctcatcttaactaattacacctgtagtgaccctatttccaaataaggtcacattctgaggtactggaggttagcgccttaatatatctttcaggacagcacaatccaacccatcatagtggtaaataaaataattctcagtggcacaagaaataattttacacaatcaaggacatcatagattaataaaccagtatttttagcaacatgttagttttgtgttttatgctccttttcttgctctcacttcaagcaaagacgtccctcaccatctttggagcaggtttcccctttgctcccctttctcctggcccctcccaccccagcacagtcaatgctaattaacagctgtttaattatcagcccagcagggaagtgatcatggcccaggtcctcagagagttatatgcacagttaagttgtcccagatactggaagattgactgtgttatgtgcccatagggagaggcaatgcggcttagtcgaaagttcatagcattgagaatccatcaacctgatgactctgccatgttttaactgttagacaatggcttccaaacctttttttcctcaaccgtaacaataccaaccccacagttttgttgggaagattaaggccaggcgtggtggcttatgcctgtaatcccagcactttgggaggccgaggcgggtggatcacctgaggtcaggaattcgagaccagcttggccaacatggtgaaaccccatctctattaaaacaaaaattagccaggcatggtggcgaatggctgtagtcccagctactcgggaggctgaggcaagagaatcgcttgaacctgggagtcggaggttgcagtaagccaagatggtgccactgcactacagcctgggtgacagagcaagacttcatctaaaaaaaaaaaaaaaaaattaatgtagtaaaagtaccttgttaagtatacaatcatatgcaaatgcacagggatgttttctgcttcatcttagcatggtcataactggcacatcatagagagactagaggtgggtaagggatgggtagagttgcttgagcaacatttgtgcacaaatgtcaaattaaggttcaaaagttgaactggaattgtgaaatagccatctgttcattttaaagaaaatattaactagtaccaattctatgaatctattccaaaaaatcaaggagactcctctctaacttattctacaaagccagcatcaccatgataccaaaatctggtgaagacacagtgaaaaatgaaaactacaggccaatatccctgatgaacatagatgtaaaaattctcaacaaaatactagcaaaccaaatccagcagcacatcaaaaagtcaattcaccacaattaaaaaggctttattcctaggatgcagttagttcaacatatgcaaatcaatatatgtgatcatcacataaagagaatgaaaaacaaaaaccatattatcctctcaataaatgcagaaaaaacttttaataaaatccatcatgccttcaagaaaaaaaccctcaacaaactaggcattgaagaaacatacctcaaaataataataacagccagctatgacaaacccatagtcagcatcatactgaatgggcaaaactggaaggattccccttgaggacagaaacaagacaaagatgcctactctcaccacccctattcaacatagtactggaagtcccagccacaggaatcaggcaagagaatgaaataaaaggcatccaggaaggaaaagaggaagtcaacttatatctcttcatttatgatatgattctatacctagaaaaccctaaagactcaaccaaaaggctcctagaactaataaaaaaagcttcagtaacatttgggttacaaaatcaacgtgcaaaaatcagtagcatttctacacgccaataacgttcaagctgagagccaaatcaagaacacaatcccacgtataatagctataagaagaataaaatacctaagaatacatttaacgaaagaggtaaaagatctctacaaggagaactacaaaacactgctgaaaaaagtcatagatgacacaaacaagtgggaaagcagtctatgctcatggattggaagaatcagtatcattaaaatggtcatactgcccaaagcaatctacagattcaacgcttttcctaccaaactaccaatgttatttttcatagaattagaagaaacaattctaaaattctataaaaccaaaaagagcccgaatagccaaagcaatcctaagcaaaaagaacaaagctggaggcattgcattacccaatgtcatattatattgtaagcctacagtaatcaaagcagcatggtagtggtacaaaaacagacacatagaacaatggaacagaaaagagaactcagaaataaagccacacacctacaaccatctgatcttcaagaaagtctacaaaagtaagcaatgggaaaagggctttttattcaataaatgatgctaggataactgtctagccgtatgcagaagaataaaactgcacccctttctttcaccatatgcaagaatgaactcaatatagattgaagatttgaaagtaagacatcaaacaataaaaactctagaagaaaacctaggaaatgccattccagacataggtcttggtaaagatttcatgatgaagactccaaaagcaatcacaacagaacaagaattgacaggcggacctaattaaggtgcttctgcacagcaaaagaaactatcaacagagtaaacaggcaacctagagaatgggagaaaatatttgcaaactatgcatctgacaaaaatctaatacctagaatctataagaaacttaaacaaatcaacaaaaaaaaaatccctattttaaaatgggcaaaggacatcaacagatacttctcaaaaaacacacaggtggccaacaaacatatgaaaaatactcaatatcactaatcattgcagaaaagcaaatcaaaaaccacagtgagataccatctcacaacagtcagaattgctgattaaaagtcaaaaaataggctggatgcggtggctcatgcctgtaatcccagcactttgggaggccaaggcgggcggatcacgaggtcaggagattgagaccatcctggccaacactgtgaaaccctgtctccaaaaaaaatacaaaaaaaaattagctgggcgtggtggcacacgcctatagtcccagctactcgggtggctgaggcaggagaatcgcttgaacccgggaggtggaggttgcagtgagccaagatcatgccactgcattccagcctggtgacagagcaagactccatcacacaaaaaaaaaaaaaaagtcaaaaaatagtaaatgttggcgaggctgtggagaaaagagaacacttatacgctgttgatgagaaagtaaatcaattcagccactgtgaaaagcattttggagatttctcaaagaacctaaaacaaaattatcattcaatccagcaatactattactagctatatactcaaagaaaaataaatcattctaccaaaaagacacatgcacttttctgttcagtgctacactattcacagttgcaaagacatgaaatcaacctaggtacccatcaaaggtggactggataaagaaaatgtggtacacctcatatacaccatggaatactatgcagccataaagaagaccaaaatcatgtcctttccagcaacttggatgcagatggagttcattatcctaagcaaattaacacctgaacagaaagacaaataccaggagtcctcacttataagtgggaactaaacattaggtacacatgggcataaagatgggaagagtagacaatggggactactagaaaagaggaagagcagggaaaacaaggactgaaaaactgcctattgggtactatgcttactacctggctgatgggatcattcataccctaaacttgagcatcatgccatatatccatgtgccccctgaatctaaaataaagttgaaattacaacaaaatttttttaaatgtttaaaagatattctcatagaaataatagtgatacccagtaacaaagacttctactttcttatgttttttatttgtacaaacgtgtaagccaacggtcctatttgaggaagcgttctaaaactaaatacagaagtgaactatacgttattttctgagaaggggaataattaagttgtatgcatgttattcgtatcacatctaaatggtaataaaaggtatagtgtatggaaggctaaaattcagagaaggaggaagagagaataagtcagtgaccttttagtaataatgtgaaaatatagtttagacactcggaaatatttctctgacattaagggctttatcatacatggaattgtaacactgcagtctttcccagaggtcttctaaaatagtttataacccaatctgtccggtcatggtaattttatttataatggaaaacaatctaaatgactaataagagggaaatggataaattgtggtatatgactctggaacatttaggtagccattagtatttaattttacttaaattttaattttaattaaagtatgatagctaagtagcagcatattacaattcttatggtaggatactcagtgaaaaaagaattcacaactttatagtatgattactactctttaaaaattaggtatgaatatgaattaagattgaatgagaacccagaacaataaacatgattaatggggttacatggtatcattgtggggaaaaaaaaaagttttccagttatttgtgtgtaacaagtgaaagcatatattgttaaaggtgttcgtctctttcaaagtgtaactgtggacaagaagataaactgacagactcagaaagcccccttcagtctcaagactcctaaattgctgagttgcaaggaggcagtgcccagagaatgcagcattcctaagcatcactagtttccattaaaacctaatttatggaattaaaaattaatttcatggaaatgaatttgagcagtcttttcattagagcacacttggtctaaatgagtttggagtggttgtaatagccattcctgcactgttatttataaaggtgaaatctgatgtgagtatttttgttcttacgctactgagaaacaacatattgcttagagttttcaaacttccatgtgatagttgctcttgctccccgaagatcctctcagggaagttatttacgacaaggagtcccatagaatgggaatccctcagtgaaagtcaaccaaggcctccgattagtgagtagagcagataaaggcctctcgttgtggaaccaaaatgggaagaggcaatggccaaagtgagacaccttctttcccaagtgcaagaggcactcttgcttccatagtgaaagaagtttgcgagatgggtgtatctgatggctatgtttccaggtggagaactatacatttacttcaacattttaaacattctgttaatgaatatgcacatgtgtgcacgcaaacacacacacacacacacacacacagagagagagctatgggaatatgctgcaaaaatctctgacttcagggaaaataattgaccaaggcccccagctgctgcactctgaaatctgtcactgtgccaacaaggccacactccccccagtgactgcgagcagcaggggaactcaggcaggcccatttctgggagacacagggctcctcaaatttaatccccaacagttttaccaaaccatccttagagtacaggggaatcaaggatgaatttgcccaactttgttcactgttctttacttggggtcagacttacatcacagtttcttgtatttttctctcataaaatacttgcacatttaatcccatcttggcaatggcttcctagaggatatacatgtgtgtgtgcatatatatgtacatatgtgacagtatgacacacacatatatacacacatacacatatatatttatatatatacacacatacatgtgcataagtatatatatatatgtatatgtacctttgaatcataatttatctccatttgatgggcactagttaggtccaaatttttgccgttataaaaatacccatctatcccatttttctaattatttcacatttctttggggagatttttttttaagcttgccacagtgactgtgactgtcctttgttggaatacctccaaagaactcccagagccaatgccacacttaacacttgttttccacatgtatagattttctggtgtggcttcaatttctctggtaaatgagcttcaggccttctcatgtcagtgtgcagagtaaagaagtgaggatctagcctttcacaggatcctctgcaaggcagtgcagtaaggaggggaagggttttctgccacgtctgtggtctcttcattcttctcttcctgctgtcattctcgacctgggccctgctgtccttctctcatctggtatccattagagttcttgattacaagcaacagaaatggattctgcttcacttcaaccagagagaagttgtcaggaagatatcgggggctcacaatcaatgggcagctggaggatcagtcttgaaagctccggggctgggttgcaggaacatagtgaggatcttttactagaagagcctggtgagggaacctccaggataaatgggctccaggggatcttggtccttgcttcaccttcccaagattcaaatcctgggaaagagacacccacagaggcacccctaaggcagagggagactctaatgcctgcagcaggcgggcacctagaacttcactccaccaacacagaacctgatggattggaagtaattcccccaaatacactggggagatttgggaagaggaaaaaaaatgttgggctacaaaatataatagtaatatctagcagcacccttttatatatgtgcataatccttgagtttgtacatgttcggagactggccacaactgttgcatgataaattagtctttgtccaagtgaaaacaagtttcctgattaaaacaaagcctagccattgccagaagctgcttgaactaactcagctcctaaattgcatttacatccaagagcttggggttctttctggctgtccaaaattgaaatgttgtcagtgcaaggacacaccatccatcaatttcttctcagaggttcctctctaccttctaggactttgctatggcatttgttggctctccatgctggcctcattgtttgtctgtttgttcttgtcttggggaagttttctttttcagcagattctcaaacgtgatagcactgtcaacaaattaaagactgggaagccatccagaaaaattatacatgctgttttcactctctctcttcctgaatccacatcagtcctctctccttaatagaaatgttccattgttttatttcacttaatgacccctaccacattatcttctttaagaatactttactcagccaggtgcggtggctcatgcctgtaatcccagcactttgggaagccaaggctggtggatcacctgagattgggagttcaagaccagactgaccaacatggagaagccctgtctctactaaaaatacaaaattagctgggtgtggtggcacatgcctgtaatcccagctactcaggagcctgaggaaggagaatcgcttgaacctgggaggccaaggttgcagtgagccaagatcatgccattgccctccggcctgggcaacaagagcgaaactctgtctcaaaaaaaaaaaaaaaagaatacttttctctatctaattcttactttagggaaactcactttgagtcatcaccaaagcctgtctgttcagtgcaaccataagtaaatgctctcataaaataatggtaacgggtcaggcacagtggctcacgcctgtaatcccagctcttttggaggctgaggcaggcagatcacttgagctcgggagttcgagaccagcctgggaaacatagcgagaccccccctaatctctacaaaaaaatacaaaataataataataatggtaaggtgagcatgtatatgagatgaacttgcttttgccaaagaaaaaaatacacctgatatacaaatgaaatttggattcatggaaacaaattccagaagacagaatgttcagattatattcaggtaatatgtcagcattgtcattccaggtaaagatggctttgcagcaggaaggatttgaccgaaaaaagcgaggttacagagacatcaatgagatcgacatcaacatgaacgatcctctttttacaaagcagtggtatctggtgagtgtctttatgtccttttggacatttcccatcttgagactctggataaaagatgaattcctgtatcctcattattcactaggatgttagccagtatccaacccagtgaccctctctgtccccttacatatgtattgattttctgtcaccacctgtgcatctagttctctaatctgctttcttctggaactgctaagtagcccttgtctcctagggtggaggctatgaccaacaactagtggaattctcttcagttctgaaaaagtgcaccagtgtatgactgaagattagcaaaactatataaaagtcaaatcagaggtctgggaagagtaatgcaggggtttcaacagacagagtaacaggggacataatgaagtcacaggcctaaaagaaaggatccaatgactttgcaaggggctagcaagaaagcttggagactaaagtagcaaaaagagcatctattaatgcttcctaaaacaatggcaggaaatcaattccatggggcttaactgatgcaggcctggaggcactaaaacccattttgcctggtgaagtgagcattttgtgggtcaccaacagttcatcatgatccatttggattggccaagctatgtttaaaaagggatcagtgactccaaaccaacctgaactgcagggcatattgacagaaagggagtgactaatttgtaaatgtgaatgaagctgtattttatttaagattaaaaagtgatgaacaagagagagaactaaattacagccttgtggacggctacattacaggaattcatcacaatttcccttctggggcttcagagcttgactctgacttatgctttttggcatggaagtccgaaaatccaatatgggtaattgaatgagtgtacttgtattagttaggataggctaggtttgttgcaataatgaacaaccctcggatcacagtagcttatcaaaagcaaggcttgtttctcacttttgctacacgactaatgcttcataattgctcagaaacgcaggctgaccaacctccatctgagctccattcccacactgctttcataagcccttcagcaaggaaaaggggcaaattgtagaatttttaaaagaaactcttaaagcttctgcctggatgtgaaaaaatggcacatgagatcacatgtcattggccaaaatcagtcatccgccattctaacttcagagtgggtggagaggtgtgtagtcttaacatgtctttagaagaaagagcacagtaaattttttaaagagccccaatgacaatcatacaatgttttagcaatatcataacagccactgatcactgtgggcttttgccagtacaagctctgacttcattattttttttacaatccatcctggagaaaacctacacagtacaaagacacatgaagattgggagtggacatattactgtggaattgctctttgttttcctttctttcttttctgaaatatttttgggggccaggatgaggggccttaggatttatttttctgcattagaacatgcactaaaggtgagccagttttctttaattcagttcaacaaatacttttgaacaagacttagtgtggtggcactgaaattacaaagattaactaggacatgtcatctcctgcaaaagatattgttatttagtaagaagttatattcaaataagaataatccaaaacaatatgctgtaaattcaaaacatgaggtagaaacaaagagctatgaaagtgagcatttaattctaaatcagggagggtttcctgcaatagcagctctcttatggaaaaagtttaaagatagtgatctagttataagatattaggggattgaaactatgtttgcatatttacagaaaacagaaaacacaaagtgtttataccaaaaaaaaaaaaatggagaggaaacactataggtaggttgggagggacacccaaaagtactgtttcatggaagatgtggcctttgagctggtcctgaaatattagatggctatagagtatgtcaagtaaatatgtacatgggtgctttacaacaccaaactaataccattctctgctttgaaattcctgtaccagatcaatactgggcaagctgatggcactcctggccttgatttgaatgtggctgaagcctgggagctgggatacacagggaaaggtgttaccattggaattatggatgatggtgagtattttgaagcctgtgcctcatttggaaataagcgtgcctttgcttgccttttgataaaagttgtattgttttggagatgctaaccagagatggaacagcaagatactgggcatgatggccacactgcactgtgcccagatcttcacctttcttccaatcagtggtcctcaaacttgaggttgcacttaacaaatattttttgaattaataaataataagctaaacaaatgaataaatgaaagctgcctatcactcaaccataatttcttactgcttacactttaccttaaaatgtcctctaaactctttatattcaccatcaatttctctagactcacactatccaatgtagtcaccactagccatatgtgcctatttaactttacattttaattaattaaagttaaataaaatgtaaaattttatttcaattcctcaatcacactagcctcaagttcttgatatccacatggggctagcagctgctgaaattcaattccattttcatcatcacagatagttacattagcgtgactctacatccataaaacagcttttcagtaacaggattggagcttggggaaatttgactttattgctgctttcagaatgaacccttgtaaagtagcctttgataactttttattacagacatcccttacatgttattcaacctgcgtgcctaccaaagacttagcagagcttcattttctatagtttgtgatatgaaaaccaatgggcttgatgaattggcatttttccaactacacacgtccttggccctgccaagattgtggagaattgccgcctgtggtcgtttcactggggatgtgttgttgccctccatcacccatctgggtctgccagcaaaaagctctactgtgcattattgacccaattatatacaaaggctacacagagatgaaacagttgagcctttcccatccgaagatcctcaaagaacagaacactatgttccttaaagtgaggctttgaagcagaaatgacagaggaaaccaagaggagccagcctgcttaaaacctgcgttgtcttgtgtgggctcattaaatatcaacataaaaacaatgcctcaatgttttttgatgtgtgagacatttttaagtggatgtaaaaccttcctccagaggccaagggctctcacaagaagaaaggagccctgcatgagagtgtgtgtgctcagatgtcaggagtttataaatgtttcttcttttctcacacttgttcttgaaaactgttccaaaggggttcaggccagctcacccaggaaaacaatgcatcaggatttggggaaaacctacctaggagatattgtcatgaccatttctaacagcatatcctactgggtatccccagccggggatcagagaagccaccctaaaagtggcactaaagtgccaacagatgtgcattgctctgctcttaggaaacctccaagagtactgtagatgcccatttcagaatactttaactgaaagctctttgactgactcctaaagtcattggctcctgactcatttccacatgcaaaggcaagccctttagaaagtctcagcagaatttctcatttgatgttctttcttcagctgattaatggcctttgggttcccacaaaagtaaactctgccccccaattacaattcctggtttcttcttcattttagtcaattactgctgcagaacaaagaatcccaacattgagtggtttaaaaaacaaccatattattatctctcacggttctgtgggttgctggagttcatctgggcagttctgcaagttccactggagtctatcatgcaggtggagtcagaaggaagttgaccctggagtcaactagaggctccaatgggaggctgaaaaggctcagcctccctccctttccatggagtctgaggacctctcctctcacatgaggcctccagcaaggtagatggatttcttataggtggctcaggactcccaagagtaggccttccaaaagagaagaagcagaagctgccagtcctcttaaaggctagacctggaatgggcaccggtaactctgccacttatgttggatgaatggtcccagggccaatccagattcaagtggaaaggaaataaactctgaatttgtggccatttttaatgcatcacatgctattccatatgataactgaagaaaagtatccaagttcactgttgaatagcaaaatgagcacatttgggacaagggcagctccccacatggtgaggacaaggacagatgctcttgccatgtaattggccatctctgtcctcacagctagaaccgggaaggctggcaacatcagtactgcattctctctcttaacgacctgcacgcatgaatggtatggtgccatgtcccagacattttcttggcaagatattccaaaataaggttaaagacagacacagatgccaaccctgatacctaagggcaaaactaatgtcatattctatcaacattgtctctccacatgttggcctgtgtggcaaatgttcaatcatctgcgtgcagaagtttaaatttgtggacagccagttttaatcactgccctcccatctctggttgcccaactccaaactcagccatcatcccctctgctggatccagtgactcaatggatgctcaataaatatctgctgccttcacgtaggtacaaagcaatgtcatttccacatgctacatatcactaggagaggacctccatggttagctgctgtctaaaggggcagaaattatttcttaagggtctactaggacatttcacctatgtagatattagcaaggaccccatttaatgatgacaacttccgcccttttactgtaatggaattgtttagagttgggaacttgacctggaaaatggaatgtgatcatgacaagatacagggatggacaagagtcatccagcccaagagtaattcagggcagatggctggttctcaagatcacacaagatcagagaaggcatgggtcaaggcccttagccattatcagatggagccaaggaagtgagatggaaggccagcgagctaaggtcagagggagcttcaagctgaagtaagaataaacaactaacagtaaaaacgacgaacatttattgagtaatcactatgtgctagacactgcttagcattttggaaatacaaccacagttattccctaaggttggtattattataatcgccattttacagatgaagaaactgaggtttagggaggcaagaaactgcccaaagtctcacaactaattctaaccaccattcttggtacttgaaacctaatcctttgctctgccttcctggtgagactttatgaatgggagcctcattcaaaatagcattaggagatatacctaatgttaaatgacgagttaatgggtgcagcacaccaacatggcacatgtatacacatgtaattaacctgcacgttgtgcacatgtaccctaaaacttaaagtataaaaaaaaaaaaatgacaccaccaggatgtggaaattctccaggacaaaagacagttttttcaataaattcaaataaataaataaataaaagattcaaacctgaggaccacatagtcacccacacccttctgagagatttagaactctgcatcacatagaaaacagtaggaaggtccagcagggtgactgctccagttacttttgctgcataacagataatcctgtattagtccatcttcacattgctgataaagacatacccagactgggtaatttataaagaaaaagaggtttaatagactcacagttccatgtggctggggaggcctcacgatcatggcgggagatgaaaccgtgtcttacatggcagcaggcaagagagagagtgagagccaggtgaaaggagtttccccttataaaaccatcagatcttgcgagacttattcactaccacgaaaacagtatgggggaacccacccccatgatttaattatcccccaccgggtccccccaacaagatgagatctgggggaggacacagccaaaccatatccaaccccaacacttagcagcttgaagttgctatttatctttaatcatgattttgtggcacaagaatctgggaagagcctggctgggcactgctcactcagtgttgctcatgcagttatgatgttagctgggctgcagtcttctgaaggccccgctgggctgcacatccatgatggtgcactcctatcgctggtggttgttgctggttgccactggagctcagctgggaccgtcaaaaagagtgcccacatattgtgctttactatagtttggtcttgatgtcttactcaccagagtggctataaactctatcctgccccaacaggactccaggggattggctgtagatgtttacaatgtgccttagtccgttcctgatgctgtaacaaaataccttagactaggtcatttataaataacagagatgtatttctcacacttctggaggctgggaaatcacaaattcagtatctgataaaggcttgctctctgcttccaagatggccccttgttgctccatcctgtggaggggacaaacactgcgtcctcccctggcagaaggggtaacaaagggatgaactctctccctcaagcccttttataaaagtacgaaccccattcatgaaggcacagccctcaaaacctaatcacctcctaaaggccccacttcaaaatactattgcaactagggattaagtttcaacatatattttagagggacacaaacactcaaatctcagcatttcaccctgcccgcaagcaccacccccccgaaaatttgtgtccttcacatacaaatacactttttctagcccagtagccccaaaagtcttgatttgttccagcaccaacatcaaagtctaaagcccagagtctcatctaaatatcatctaaatcagagatgggtgaaactcaaggtacgattcatcctgaggcaaattgctctccagctgtgaacttgtaaaatcaaacaagttacgtgtttccaaaatacaatggtgagacaggcataaaacatacattcccattcccaaagggagaaataggaaagaagaaaggagtaacaggtctcaagtaagtccaaaatccaaaaaggcaaacaaattctgaggcttgagagtaaccttttctgactctatgtcccaccttctggacacactggggtgggagctgggcctccaaggctcctaatgaccgctcccccatggcttcactgggcacagctcatgcagcagctctcatggggtggagtctcatgcctgccattctcccacactggaatcacatgttagtgggtctgtagttctggggtctcagggcagtcccacccccacagctccactgggctttgtcttagtgggggttttctatggtagccccaccccatggcagttctctgcctgggccccgaggctctagggttagggttagggttaaagaactggagctcagagccagggttctgacatgctacgcatctcaagtgaactattaacattctacctaggaatgtgcacatggaactccttcctagttcctcgaggtctccaggactgtcaccgcttcctgagaattgggactattgtggattagactttccaagaagcttcaaattgatgataggatactaatgatttatgaaccaaattataaccaagtctttgtcatttctgtgccacatttattatgattggctggtgatcagtcggtacccccataggctgtgagccatagatagttgtacagctcaggttctacgtctaaatcacctgcggttttccaggaccgacactgtgcctggcattcactgctgagaaataaacaaaagcatgaagtataagaatgaatatgagaatattgtaagaattaaacataagccgattaggaagatgtgttcagtacctcccaccttaaaagataatcaaatatacaaaaatataaaagtactatctagttaccaaattactattttccattcttcagtccattattactttttccgaatcatgtttgttgtccttcacagtcgtatcaatcattctctttctcagaccaaagtcggtatctgttctaacttaacacttagtattcctcttaacctaatttaagatcgtttattttaattaggctaaatttatcttgttttaattctaatttccttctggtctcaaattatcttcttgctccagtattttcccttgacagagaagacactactatttattggaacatttttctccttaacagcttccattctcagaacatgaagccatgtttcaaaaattgacttcctgttggaaaatatattctctgggtgtgtctttttttacacttatttagataagttcgtttgatctagctaagtgtgaaaaaagacacacacagagaatatattttaaaatataaatatttaaaatataaattatatttttgatcatttatatttaggtataaattatcaaaatttttcacccaatgagttcacaaaatttaagctatcttaacaaatagaagcaatttaatttcaacacaatatgctgaaaccaagtggatattttttaatgtttcttttcttctgcatatgcacactactccagagatgtggtagatgttaggactaatgatgataagaaatagaatgtattaagtgtttactataagctgaagactttcaatgaattgtctctaatcttgaaaaccgctttgcaaagtaaataatagtcccatttcaaatacatggaaaccaaagctcagacagattatgtcacttggctaaagccacacaagtgttagtgtctgagcccagagtggaactggatccactgatttcaaagcctatgctcatccccaacttcaccccacagcctaaactgaccattttgctggggggatgtttcttggtttgcttttggggatttgtttgttgtttccttttagagacagggtcttgctgtgtctcccaggttagtgtgcagtgatgtccttatttttgtagagacagggtctcactatgttgcccaggctggtcttgaactcttggcctcaagcaatcctcctgcctcagcctcccaaagcaccgggattacaggcgtgagccaccatgcctgaccaaaattgacggtctttgaattaggatccagaacaagggttaacaacatttaaaaatatttgtctttaaatattctgatgcctttccctctgaagacttcgggaggcaagtgggagaagaaggcataatgatttagggaggggactatagtctcccaaactatagaaagcagccatagtgacagcaattgcttcactcatcaaaatcaacagtgaaacctaacacacgtaccgtagattagtgactctcagtccagttactcattgtataaccggaaaaaaaaagaaaaatttcttttcagaaatatgcatcctaatacaagctcttttggggaaggcaaatctctaatggtggcctagccttagtaagcatgcagtgaagatagcagccttgggacagatttaatgatacttctggcttttagatattgcatccccatatagttattaaatgcaccagctgctgggccaagcataccacatgcattcatttctttagtccttacattgttctcacccccagttgatcaaaaaggaaaattatcacagagtccaagcaacttgcctgaagtcttgcaggcagttatcagggtggttgggactcaaatgcctgtctttgactccacagacctacgtttgtaaccattatgctagatggtgtcaagaacctgccctgtttcttggagggttagatgctcaggtgtaactgctgcaaagcttatgtggttttgcaaacccaaatgagagcttttcaattgcccttggagtttcttgatgctttctgaggtccaagggtctgatggaactcagcagtgctcatagtccctgattttacccttggaacgactactgggcaacaagacaggccaccattcaggagaaagcagggctcctgctgagacattcaagcctcaggcttcctggaaagccacattctgaggagacaagcctcagctcccaaccagcaacacctcactggaaaccatttgccctttacctaatggcttttcttgcccagccatgttctcttattatttccatgccagagtacattctcctaatccattgctgtccatgccctgttaaataataatcacttttcctccccagggccggtttcatttcagagaaatgccagttgatgctttaaaaatgtcaagatttctacaaatctcttttagatcagtgctctgatgagccatccatctcactgtcacaaagctgtcttgggcagctgtctctccgctctggcagtgcagcccaccttcacacctccacacagaagggaggtgcaagactgggagctgtgtgatggggcactcacccccatggcaagccttctggcaccagccccataaagagggcactttcttgggcagctttcctgaggacacagtggcaggtattaacctttggttcctgtgttattgttgtcttttcacagggattgactatctccacccggacctggcctccaactatgtaagtacaagccaactttggtggggaaacagatgcatcttaaatgtcctggtgtccctggctattaggaacatgcacatgtctacatgtctatacacatgcatgcaagtacaggagcatgcacacacacacacacacaggagtacagctgctggaacatatgcacgcacacatggaggaacacacacaaacaggaacatacacacacatgcataagcacaaaagatgcacacgtactcataggcacacatgcatgcacacacagacagccacatgggcagccacactggaactgtccatcccattggagccacagctcaggccacaagcaaatggacaaggcatgtggcctggcagcaggcaaaggcagtggctttgagagaagaaagaaacctgacatctgaaagagcagagtgccaagaaagtaggtacagggagggggaagaagagagagacttggcaaggtttaaatcaactctacctgatgatattgaattgaagggtggaaatgagccatttgggttcttgttggacaaaaccaaaggcaaaaagccaaaaactgcagtgactcacattgcagccccagctttatgaaagtaagagcgttatcttttttgattatttgtgtcacttatgaccactccactgactttcccccataacattgagaattactatcccttgacaaacaagcaatgttagcagagaatcaccaaaagccctgctgggctagaaccacacactctaacttttgactcagcagttcacacgctgctttcctgatgaagcccacaagccctttaaacagaatcgatcacttattttaaccccagggagtacaagattcaagcattggtgcgttcacttaaaattatccaaactatttctaagctatacttctgagacctccagatctaggtgtaaaaaatgttgtcttagtcattgaagagactcatatttagagaacaagggcttgcataaaagaaaggatggttacccagcaaaaagtgtttggaggtcaccagtctgggtcatttgtcctggaaggcgagtgtctctacgttgcacaaagaaagggggaatattccatgtgtttcatgcactgggcaacaagaaacaaggcattcaagggatcttataaatctagaagagcataaattgagaggagcatcttttttaatattaggaaaaactattaaatgaatcattggcagaatccagccaatgtggccccagaaagaaatgacagaaattaaaccaaagctatattcccagcaatgataataatccatgtctatggagaagaccattgtaaactgcctgtgccagcggtcctgtgtgtggagtctgaggaaacagcccttctccctgtctcctcatggtgccttccctactgaacatgagtggagctgtctgctggtcttctcatgcacttccttaaagggactgccctggacacagtccttgctgcctctccctgactatggctgactccgctagtgccttcacctttccctgcctcctccataactgcagggccctggagatgtgtcaggcaggggattgagaagtgctgcattgcattttctccaaggctctgatgtatctggggctgttcctcacagagagcaagtgtggcagggatcatggcctccagggtcggtggtcctccctccgagggctgtccccactccaccctctgcagacagaggcattgatattctccacagttccctccatctccaggacccagtgcctcacagggcagccacgtggagttctgctcactttcccaaaccatacttggggaaacaatcatcttgtcacttggaggacttcaaggtggggtggtacccattgggctggagagctgagggcacatggcctgtctcctgtgcatagcataaccccacaaaggcctaagacatggagaccgacctctgcatccttcccttctccctgcctagcccaggcagttcctgtcaggctgctcccaactccagctgccagattcgaaaaagatagtcattcattgggggcaagaatcctctggggttccagtgagctgcaggtacaatgttagtggatggtgtgatccatctgccaaaaccttcatctgaaattggaatgtgaaacctccatattgagccgtgccagctcctctgagatctgcaataccagaatacacctgaagaactcttatcggttctgtgagtctcaagttcttttttcttcttttctttcttaagaacatttttctgattaaaaaataaatgcatgttatctgtcaaaaaatatgaaaaagcataaaacagattcaaaactagccataataccaccattcttattattttgacatatttggggcctttaatttctatgtgtctatttttaatgaaattgagctcttattgcatattcttcccttctgcttgatgtgccataaacatttttatgttattaaatattctccaaaacataattttaagggctacatggcattagctcatgctataatttatttaaacattctgatctccaattgttgaacaattaggttgtttccaatcagtgtttcactgtaagagggagatgagatggcagacagtaacatgggtggactccaagccataccatgctaaggagaactgaaagaactggaaaagcttttcctggaaaaaagaaaacaggcacattgagtatgttttcaaatatttcaaattctcctggtacaatgaggcattccacttgttcagtaatttctcccaagaaaattctcaccaatgggtggtaaccacagaagcaaaattttaactcagtcaaaggaagaactgtctagtgattaagatagtaaattattgggaggccaaggcaggtggatcacgaggtcaggagattgagaccatactggctaacacggtgaaaccccgtctctactaaaaatacaagaaattagccgggcgtggtggcatgtgcctgtagtcccagatactcaggaggctgaggcaggagaatcgcttgaacccaggaggcggaggttgcagtgagctgagattgcaccactgcactccagcctgggcgacagagggagactctgtcttgaaaaataataaataaataaataaataaataaataaataaataaataaataaaaataaaagattagtaaattaatgaaagtaacaaattcttcatacctgaaaatattcaagaggaagtttgatggccactggtgggatgttattgaagagatgacaatgtctatgctgaacttaaactagatgagacctaagaattgaacagaaaatgtgatttctgtgcaaaactgcgcatcttgataactttcattcagagcaaagtctgagtcttcaacttgtatcaaacacttggaagctgacaatgaaattatatatatttacatatggctgtgaaaatgttctgcctctggtatagatgagaaaactgaacacctaactacctcgtgcttgattcctcagcagagggcccaaactggctggtttttaatggcacagtgtctctctcaccctgtgtagagttcagagtggcaacttcggagctactaaccacactaatcttctttatttttaattaaaaattttacactatcattaacacaatgaggacagcaaatagagtagaccagcccaggagagcaatgaaaccagtagacagtgataggctcgaaaattgtttgagcagagaattagcaggcagcttcacacctcgttaagtgacctaatggcttggagggatgagccagcctggtgccccttgagagagaggtacttggtggagtctttgcttgggtttccctagaagcagactctgaagcaagggtttgagtacaagtaggttatttggaagaggattctaggaagcaggggtagaggacagggaatgagtccgggaaggaaaggtagcttgtaaacggggcagttatcaaacaagacagcactgtgggcactgaggcttaatctcactgggcagctctgggagacagcatagaatatgtgagccagagtgatcccccttgggatgtgatgcctcaagaagctggggtatttatgtgacaacttcgtcagtcattggttgagggcttgtcccaaaagatgttcctacctccccacagcctggggaaaagccctgggcagaggtgtgggtacagacagctgcagcttaccagggacatgagggtttcaggctgaagggggatgtagcaacgtctgccccagagatgccttggaaattcattaaaggttaaaataaatagacatgttctatgttgaaaaaactccttgtggttactgatttattttcagtgaggattgaaaactctacccaaggctcctcaaaaaaattactttataatcaaaccaaccaaaatgtttctgaaagcagaattattttcaaagcttggttattctgtatattaagagaggaaacagcatatgctggtagtccagtttattcccattaaactaagaataaaatacttggaaaattgcaaatcaatatataaatgtaagttgttagtgttaatctaattcaaaaaatccacactgagcctgctgagtgttgggagtaaaggataataacggccacttggattattactctattgttctatgattgaatttcatcggagggatccagtcccactggtaaaagttcactattccaaataattaaaatttttctttttctatcccaatagtcatgacacgaaatgagtattagccaagaggctattttagaccaggttaaaattataacctcctttacccatcttcgctataataactgggtattttctctaagtcaatacaatggctgtggattgaacctgctatgtgcaagccccagaggaagagagataaataagacacaggcactctctagagaagtcggcaggtcagtaaagatgcaagcatgtgagacatgactgtcaggtgaggggtaggcagacagggaggttcgttgtctctttactctgagctcccaatccagtgaggattgcaggctgggttcacagtacgggcccaagctcaggggttctgttaggtctatggaacaaagggagacttcttcaagaacatgtggagtgtgacttaggtggcagctttcagggcatggaggtgggtggggtagaacgtctcctgctttgtagctttgctgaagctacaaaggtgaagaaaaggctggtgggtctgtagaatccaaggagagccttcttgctgtgtgctgggttttctcagaagcagaccctgagacaaggatttgaaagcaagtcattcatttgagaggagatcccaggaagcaccagctgggaaggaggaaattgatgccagaaagggagagtggcccagagagcaaattaccccctagggcaatgggagctcaatctccctggggaactctgggaaacagtgtggaccgagtgggcctcagagttacccacaaactcctgtcaaccactgggtgaaggccactacccaggagtagagatgaggtggggagatagaaggattcattctagacaagaaaaatagggccctgcagacagagtcttcagcagagttgcatgtgctgacagttggaaaacagccagcttgcaagggtagggttctgacagttggcagtagtggaaactgagtcaaagctgagatgactcctggctccctacctcatgatgcagccttagaggagcatatcaaacatctttgaaccttaattttttcatccgtgaaatgggcaaaatggatgtcttgtcaggtttgttgcaaggtatccttgagataatatgcgtatcaggcctggcacataatagatgctcaataagcattcatttccttctgtctcagaagagttgaggttacaacgttgcacaatttcgggttgtcctgatggagaagcaggggtgtgcctcaagaaaccagtgcagttgttcattggacctcccagtgagcttagggtcattaaaagaagaaagggcaactgatccaggctaagtataagattgtgagggttgcaaagttaagggcaaaaatcagaggataccaacataaatctcaaaggctttgaaaaacaacatccaagaaaagagaaggtaaaggcagggagaagacccattgctcgtggccagggatgtaatgaaggatgcccccgaggaagcggcatttctgacctgcatcttcttccctgtcacataccttagaactagatgaatattcaaggatagtcataagggagggttaatccctaaggtgggcaaagggattataaggtagcaactaccccaagtgaggttttctccgagccagggaaatctcctggtatttaagccattgcagggtgggacatcaactcctgttctgatggctgggaggatgggccacttcttgcactccgtcttctagcttggaaactgtgagtgatgctctgagcagctccaagatcctgtgctgagaatctgtctagattcatgacacttcatgagcttttccaagaattcttgagtgcagcaaatacagaagtttgcattgactcaactccacatccttccctagaccacagcttctgccatgggactctgtagaatctccctttaaagaggtgaagtgtgtttcctaccccttgactttggattgggccttgtgacatgttttaagcaatagaataatctagaactgacagtgccagtttggagcctaggccttaagaggccttgtgtgctcccaactgcctacccacgcctctgccatcgccattagaagggcattcccaggctctcctgctgtaccctagaggagggtgagagacatggagaagagcttccctgctgccacggcctgaagcaccaccacccacactggcctacagagctgcagtaagaagcagagctgcctagctgagccccaccaaaatcaccaaacctcagccaacccacagaaacaagcaagccagccaagctcagcagagctgcctagctgagcccagcccagagcacctagctgccagctgaactgtggactcgtaagctatctaaacacctgctgttatatgctgctgacatattatggccgtttttgtgtagtaactgttacagctgcccatgctagacccccttctccatcctcctacagtacttgaggtgtaccccagtctggagagaatattggcttctaggcctatcctagacctactgaatcaaaatctttagggacaagcctcatagtgtgtatttcttttagaatattggcttctaggcctatcctagacctactgaatcaaaatctttagggataagcctcatagtgtgtatttcttttgaagcactccaagattctgatggttaacctactcattcattttggcacttcattcatgcattcaatcattcattcattcaacagtgcagtttacctataatgtttgactacatcacagttagatcataagctctttgtaaggaagtgtgtactttgtaagtgttttgtgtccctcttaacacttatcacagtgttaagcaagcacttaatacatatttgttaaattgcattaaatgttaactcaccaatattattgcaagtaataccaggaactaaattatatgatgaccctctatcgacgatgatcagaaactgcagcatgcacaaccctctgtgtaattcctagttctcaaccacctcataggtggatgccaccattgcctccttcatcatgcatgatactaaggaaagagaggaccctggaacctaactgagttcctatggctgcaagcctggagagaatacgattcgagaggtgaataatccacaggcaaataactacaagctatttcttttctttaatgtctagaatccctcaagttgctggaaatgcaattaggttcctagataggagaggacaaattatgttctttggttccgttcaaaatttggaacattatttatgttccagggttgctatttcaccaacagaagtgatcataagagaaaaaggcccacccctacattcctgcacttttccattctttagatgggtcctgacaggtgactgtctctgaagtgggtgcctgctgagagctcagaagagctgccagcacaggaagtaccttgagcttgacagaagtgtgcacattgggccccagggggcatgtggcctccatgataaaagggcgacagcaagaaaccggcacagtactcagccccgaatgactcagatgttatgaagtattgatcacatacattgcttctggcttttaggcctatgaatatttaaataagcacattaatattgcatatgaaactgaggcttaaataacctttgtttcttattgaaaggaagggctggcattttcaatgtgctcttgaatgctggctggatcatgatgagcactttagcaccagatcagactgaatactgagaatggggactttttaaaaatcactttgatagaccgtcagtcaaatgactatcacttaatgcaactcatgtactagaggaaactatttatttttacagaaacatactttgctttaaaaatagggcagaaatgaaaccttgcttaacaaaatgaaactacttgtatggacctaaacttacagctatagctgaaagcaaagaaaatatctggtcattctattatttttaattattcaattgactagtatttgtttcattgaacttagtcagcattcaagaaagccgtattgttcccactgtgcaaaatgctatactaggggcctgaattatgaagtgtgaaaaatccagtccctgaccttggggggttcacatgtaagtatataattacattataatatgcttagtgctaacctggaaataaaacaccacccatataggaatgcaatagctagaaaaagcaagtcagccctaaaaaattagagaaagaaagatacttaaatgcatttaaagaatgcagctcaccacatgggggatgaacttgttttcttgggtcgatacagcatatgaattcatctagaagcttcatcaatacgatactagacaaatgggtaattggatttcatctggagatttgcttccacctagaagcctagacttaaaaagtagcccacatcatttccttaccccaaattccctaaagcccttcgacagattctcatctctttgactaaatttaactggcttaaagaccagggtaatgtcttccaactcttttactcatgagagaatgaaccagcggcctcattccccacagagatcattaagagagacttcataaataaaagactgaattatggatggatggacggatggatggatggatggatggatggatggatggatggatggatggatggatgaatggatggatggatgattggatggatggatggttagatggatggatagatggatggatagttggatggaacggatggatgaaaagatgggaggatgctaatgagactattgggattttattccatttatcactaaacacacctgttcagaaaaagtgtagcaatgtttactgataagccacaagaaagtcatttatgcaaatataagaaaattgaaagattactattctcaactgcctttgttcctttctttgtcttcattatcggtatatacgcactgaattcccaaaatgtgaaatattttactggcttttttatttgggtttctatctcatagaaccaaaaacctttaggtgaccaagccttacaaataattaacttggcaataacccctggctacagctgtggttcaaaatgctgcttctgctgagctgacatccattttcactttgtccctctcctcatgtgcctgtttcccaatcatactgtcttaaagccacagttctgggtgtctaaggcaggcctgaccagatttctgaacccatgtcccccacccaggaggggagtagtgggttgatgccacagcaaaatgggcagtcatccacactgcttgcccatgtcttgttgccaagcaacagagcccaagtgggtgtgtccactagagccacacctacatgggatcattgcctgggcaaatgtggatctgatggagaccaaacgtctgatccatcatccaattacagttttctgaagcagcaacaaagaccaagaaacaatgcccaggcctcaattaagaaggatcagactctgaagccatggagtcttctaaaatatgatagaagataaattttgtggttgtgtcaaagaatcatgagtactataactgtcattttggctagagccccattcttacctttaaaagctcttaatcatttttccttgaagacaaagacttgatggtaggcagaattgtaaaatgcccccctaagatttccaccctctgctgtaagcactctgtatagtccctctcttgagtatggcaggacctgtgaatatgatgagatatcactcttacaattaggttattagattgcattatatggcagagttagagatttttttcagatgtcatcaaggcgcctaatcagttgactttaagctaatcaaaggaaagactatcctgggtgggcctgaactaatcaggtgagccctttaaaaggtaatctacaagtcagagaaggaaggagtcagagagattctaagcagtggaggctttcacctgttggccttgaagatgccactgccataatgtgaacagggccacatggcaaggaatggcggactccctgggagctgaggcctcactcctacaaccacaaacaactgaatgaacttgaaagaggaccccaagccctagatgagacagctccagtgacaccttgatttcagccaggtgagaccttgagcaaaagccccagttaacccacgtccagaaactctgagataaatttgtgttgttttaagccactatgtttgtaataatttgctatacagcaataaaaaaactaatacaaccttcttgattatagtggatatttgagcacaaactgaatgacttgctgtctctctgaattaataaaaatagaccactcctcagtttttactttttcttaatatgtttgcttttatctcaaaaataagtatactctgcctattgccacatggggccctttcataaataataattctgctgcaatgagaggctcagagaaatttagtgaggaagttaagaagagctcttgggccagcctcgctgaattcaaatctcacgtccaactgcttcttaactatgtgccctaggcaagttaatctctctgtgtctcaatttcctcatctgtaaaatgggttaataataatactgatcttaccggtgattgtgataattcaattcagtagtgcacacaaggcccttagaactgcctctggctcataagacaccctcaataagcattcgatgttgttaagtcccctgcccaagattgcacagctagaattcagcagggaagaacacaagcctaaggtggtcagacctcaaagtctgttctcttagcctccccctcccttcctgccttaaggacacatatgaatttgcagaaagcattttttaaatgaaattaaaaggggcaattagtgcgttattctaagttttctttccactttcctgctaacaactagtgtgttattctaagttttctttccactttcttgcttccccagccctccctgtcctgcctcccagaatactttactggtttcccctgggagcacatccttaataaatcacttgcctacaagctttcatcacagggttggctcccaggaatcctgatcttacattagagcggtctggagctttaggcaaagcagaattttccatcctacatggccaaggcggagagaatctctgacatagaaataagattagcttctccaccatggtaaccctgctgctgactcccaacctacgggaaattatttttcacaaagaaagaatctttaattactaaccaataattaaaacctgaagccaagaacaggaagccagactttggctcttagcaatgttccttaacatcaccgggagtattatggtgaggtctgcactttccatgtggcatgcacacaacctctccacaatgagtgctctgctaggcagaagaataagatgtattacagtgtgtaggagatgttttcattaagctatggaaagagatggattatgttttataactcaagcattgccaattttttaaataaggagttcagtgtaagtctaagctattcaaagagcactagttcacagactcccattgaggtactgcaagccaaaaaaaaaatgcgttgtttgatctttatggccctcagtttccccatctataattgtcatccccaacaagattctcattgtctccagaatcaaaagagtataatgattattcatatggctgatatgaacactgggtctttgttgatcaatcaaaaaatagaaattaaatggaacttctgagaatgttcaaggcgttgaagctattctggtatgggtattggaccaccctccctttttttctccacaacaccccacaagcatacacacacatattctttctctatcatgtaaagaatgttccagaacactaggtggaaaggagccagtccctgtgtagaggcctgtgtggtgacagatgggcactgagtcatttgatacagtcagcaccttgcaggaattcttaccaggcactttaccaacaaaaaatatattatctgtgaataaaaccatggccaaggctattaaccacttcgattaatcactcacaagcggtcacaatgatcctatactacatggcagctttattggggagttttgacttgttgcttgcttgattattaataactcgcaaatccatctctcctcccgtggagagttggtagttggctaacgaagtatgagaaccatgtgttgtctcccacctcttctccctgccgtggttctgatatttctccattgatttctgtggaatagcaggagtgttagttcccagaatttgttgagtatttactgtgtgtttggccttgtgttttatatgcatgatcacatttaatgagcgtgttaagccagtgaagtgggtactttcttacccacctgtcatagacgggaaactgaagatcagagaggctagtgatttgccttagctcacacagacagtgagtagcaaaatgtgaagttcaccatctgtcatgctgccttcatttaacctggccccctccagtctcccacatcttaccaaatggcatcgccatggtcacaatgactaaggtgctaaacgttaccatccttgactgctgctcccttctttttcccctcagccaccctatctgccagttctgctaggcaatacacctgcctctctgttcccaccactggcatcctggaccaagccagcatcacttccctcctggaccccacaaaagtttcctgcttccactcttaccctctgcaatgcattctccccaaaacaagcagaaaggtcgttacaaagaacaaagtagtggaagccatatcacttccatgcttaaaaccaacaggtggctctcccccttccctgtgagacttagcctgtttgcctttgtcctgcttactcacgatgaaccagactctacaatccaggattctccctaattaaaggcttggaagactgtcacactagctcttcccacagttgagtccatctcaacttatattgcacaccctgtgtagccacttcctagttcttaagatagtctgtggttctgtatttttgttttgttgcatgtgttcccccattagaatgtcagccccaggaggatgaggccacggggatctgacctgtcttgttcacctctttatccgcagcacagcaccatggctggaaccaagtgagtggtcagtaggtatctgtgagatgactgactggctgaggattgaacacttggctttcctctttttcttttgccttcaccttttaatttcttctggccatgctttctcctcacatagctcctatctctgtctttttgctatgcttctccttatttatacctcagtcaacaccagcattttgttatgaaagaaaagctgcaggtcagtgccacaaagaagacaatttccccaggaaatgaacacttcagtacttctttagtaacttctggggagaaatactatatttcttcatagctacaaccaaaaaacagaaagcctctctatccaagactgccttgtccatcccaagaaaacagagaactacagaaagcagcaggaatgattcccttgatgcttttaattcattcatttgtgttatatgcaattaacaataggccaactgatttctcaaagcatgcaatttcaagctgaaaaattaacctaggttattttccactcagttaagtatcaaaaagattttgaaaaataaaaaaaagaaaaagaaagaggaaaaaaaccaacatgagcatgttcttaactaatgagctatgcttatccactgttccactagaagagaattttccaaatatggacactctattcacaagtctctcttgagaaacgtggtgttacagtgtcaccattattaatattaaacttgatgcaccatatttacaaatccttccaaagggaaacaaacctgccctggaaacaatgcttataattataatcgtggattctatctgttcctcacagggaatgcttaaaatatcaatttaaatgcaaatgaatcttatcattccaaattagactcatcccattgtgttgaaattaatatagaaaataacaccgaacaccaaattacaagtaattaatattgacactgtgaaaagtatacactctcattttgatatttggggaagaaagtcttgtctgtgcgtgtgccattgtgtcctataagcaacaactagaacacaataccctcagtgctagtaatcatgcaggattaacacagcaaaaatctgagagggaggacaaatggcaatgatacatcttagaatccagtaatctattctttgggtctgaggaaaagcacttaaatctgtatttaagtgactacatactatttaaaaataaactatttgaggccaggcctggtggctcacacctgtaatcccagcactttgggaggccgaggtgggtggatcacctgaggtcaggagtttgagaccagcctgaccaacacagcgaagctccatatctaccaaaaaaaaaaaaaaaaaaaatacaaaattagccgggcatggtgtcacatacctgtaatcccagctacttgggaggctgaggcaggagaattgcttgaacccaggaggtggaggttgcagtgagccaagatagtgccattgcactccagcctccccaacaagagtgaaactctgtctcaatcaatcaatcaacaatttgagtcttaaaaattaaaatatttttcataggctgaacacagcggcccatccctataatcccagcactttgggagactagggtgggagtattgcttgagccaggggtttgagaccagcctgagtaacatggcaacaccctgtcgctacaaaaaaattaaaaatttgctgggaatggtggtgcatctgtagtcccacctactcaggaggttgagacgggaggatctattgagcctaagtcgaagctacggtgagccacaatcacaccactgcactccagcctgggtgacagaacgcaaccctgactcaaaaaaataagaaaaagtatttctcttaaatgcaaaggcaaagaggacctttctttgtctcttctgtacctaacgtaagggttggctaactacacagattctggccacctgtttttgtaaataaagttttatcggaacgcagccatgctcacttttttacttgatatctatggttgcctgcatgctctaagggaagggtggagtagttgtgacaaagtccatatggcctgcaaagcctaaaatttttactatttgatcctttaagaataggtctgctgaaatcccctggtctaatcagttgtgtgtcaagatgtaggaaaatggttttgttagaaacttaagtccagagagcttcaaaacaggctccagtgacagctgtagcaccttctagcagtgtgacatctggaaaactgctgaatatcttgggggcatagcaccctcatttgagagctgagaaaattgaactcttgtctgttgtaactctaaaatcttatgaaactctcctcccttccaataaaatccctgattaagaaacaaaagctgaattagttttgttaaggaaatggaatcgtcaagtagtttgaatctagttaatttgcttttgagaatgacagacattaagtcaaagtgatgctccttttccatgcatgatgctgtatacactaatcactggggctgagtgatttcaaagagttttgcattcatttactgtcttagctgggattcctccaaaagctgactgtgagacatggatccacaaaccagcattttatttggaatttggtgccaggaagcacaggtaggggagcaggggagtgaaaaagtgaaggaagtcaatacagggtgtgcacaagtgtgtcctactgtgggcaacaggagctcagttctgctaagcacccctagaacatgagttagaacacatgaaggagaaagagtacaagtatgaacacaccaactcttatccatcattggttgatgattaatatcaggatggagagaggaacaatttcctatacttctaagctgccatatcattggtgaatttgactccagagataaagagataaaatgctgacagatggaagttgtgtcaatgtgcactgatatgctcaaagcaaggagttattatggatggggcatctaatagcatctaggacacttacaaaatcagaggtctccaatcacacatccctatttgtaaaacaattttaactaggctctcctaatacatgtatagctatttattcagacagtatatgtatgtactactatcaatgggctatgtacattataaagcatatccaagaaagaaaattttaaaggataaaatataaataaatattaaaagttaaaatgcacactcatgttcatggtaacattattcacaatagccaagaagtataagcaacccaaatatcaatcaatcaatcgatgaatggagaagcaaaatgtattacatacatataatggaatattattcagcctttttatcaccttaagatcctaaggtcctaagattatttattcagaatttcaggaaggaaattctgttacttgcagcaacagggatgaactttgaggacattacactaaatgaaataagctagtcataaaaagacaaatattctgatcccacttatatgaggtatctagagtaatcaaactcatagagacaaaaggtggaaaggtagttgccagggtctgggttgagggggaaaatagggagttattgtttaatgggtatagagttttagttttgcaagatgaaaaagttatgaagattgtttgcataggtacttaacattactgaactgtacacttaaaaatggctaagatgatgaattttatgttacatattttttaccactattacaatgaatacatcgttttttaaatcaaggtaaaacaaggcttaaaagatttcctcccaacactccaatggatcatccagcacatcctcccaagtgagcacaatccacttttgagacctttgcactaaatacctagtctgtagccctgccctcagtgtaatcagcaaaagattctgtattaaaacataaaatcctctgtccagctagatgttaagatctctgtctttaagggagataaaacagaataataggaatggcaccaataaggatcatgcagacaggtagatctgggtccaatcctgcctctatatttagttactgtgatttgaaacaagttaattaacctctctgttgtacacgttgtacattcctgagatataaaagaaggatagcaatatgccttcatgttttcattcaacacctagttattgagagctatgctacaccagaaactgtagtatattagttacctattgctgcatctcagattacccccaaaacatggcagcataaaacaaaatacatatatatattttgtttcacaccgtttttatgagtcagaaatttaagagcagtttggctgggtggctccgtgtttctcgtgaggttgcagtcagcatgttggccatgactgcagtcaactgaagactcaaccagggctggaggatcgacttccaagatggttcacatggtggctgttggcaggaggcctcagttcctccttgcacgtagctctccacaaactgcttgagcatcctcatgacatgatagctgacttcacccagagcaagcaatctcagagagggaccaaaatggaagctacaatatcttttacgatctagcctcagaagtcacacaccacaattttgaaatgtcctattggttatatgggtcagccttgttcattgtaggggactgtatacaaggtcatgaatatcaggaagcaagaatccctaggatcccaactgggaggcggggacaagtggctgaatagagcagacatagtttctaccctcaaggaccttagcaactagagggtaaaatagactccaaagaaataactacagaaataattatgatctaggtgctttgctacagcggaagagtactcggtgatataaatgtgtttaatatggagaaccagatctgggctgccagttaagggaagatttccctagagtagctatccctatgctgataccttaagaatgaggaggagttagccaggaatctggaagcagaaggaacagcttgtgcaaagaccctgaggcaggaacatgctcagccctttcaaggatctgaagaaggccagtgtgtgtgtgctgggggaaagaagtatatcagtacgggaaggaaaaatatggcatgagatgacattggagaagtagaaagagaaccgactgtataaactttctgagccatgaggattcataacttcatcctaggagcaaagggaagcttcagggtggcagggagggggaataacatgcctagatttggcatttttcaaagatttgcctgctaaagagacagattgggagtgaacaagaaaggaggcagggagagcagatgggggcttttctaggagaaagattatttgccaaagagctgttatggttaaaaggaagatagagagagagaaagaatgtagttaaagcaccctgaacttcagaggtgctccctaaatagtctttctctcttcctcttaaaacagaaaccttcagggacacctaacataagatgatatctgcaaaacatatatctctaaaaaaagcagacaaaaacacaatcacttagcgcgggcctcattaggcacctcataagttcaggcactagggtcctgaaggagtcttgtgcacaggaaattcaggaggggagtcagcagtgagcttaaagcctcgctccaccaccagcaggaacccggactgacccacagagagcgctgaatagcatttatgatgcttaatcagaaagcatgcagcgttgatctggaaattaattggatgctcggatttttcgcacatcatggagagttagatgttacaaagattttgacgggaatatatttagtaacagtatcactgatgttcagtctcaagcaggggcctgtatctactctggggctcattatattctgagtgacaacgggtgcttagtaaatctcctttgattatgatgatcaaccaagtcactcagagtgtctttaatagataatgagaaattgtaccagagttggggttttctaaatatgaaatcaaactgcaattctcatgacccactgtgcttttatttatttaatcatttttacttaactgattcactattttaataggtagttttaaaagttaactctacattaccgccataaatggaaaatctcacttgccatataaataagacaatcataaaaatagataccgtctacccctaaaatctgccatgtacagctcaggttgggcacagcacaccctgagaactgctggacctggatgtgcttgtagtcaagggtcttggaaggaacagccgtggtcatcagttcacacagccaggatacaggggatatgcccttatgtgacatagggcatatatgatatagagtatatgtccacacattccaatatcaatatagggagagaatggtggagagagaaagggagatctctcaaattaacaacaatgaatatcgactgaacctgaagaaacagatgctctttggttcatggaaagggtgtgaacagatgctcaggcctgaacactgctcagactttgcagcttcagggaccatcggctaagagacttgtcttctggacttactgcctggggtaaggaccagggctcatttatcttatctctctaatctggggagctgtgaggactagaatgggtaagggttcagtgcagggtttacagctgctgaaaggtccctgtagcatttcctttatggaaaatcctatggatatacttaaagataggtatttgtgagggtgaaacctacctacaacctcttacactgctagtgcaaatgtcaaatggtgcaatccctttggaaaaagtttggcagtttcttgtaatgttaaacacacacttagcatacaaccagcaatcccactcctaagtatgtactcaagagaaacaaaaaggtatgtttataaaatggcatatacatagcagctttatatttgcaaaacttggaaataattccaatgcccgtcaacaagtgaatggataaataaaactgtgatgtgtttatacagtggaatactatcccacaacaaaacaaacaaactgctgctgcatacagtacaataggcaaatctccaaatgttgttagctaccaacaaagacaaatgcaagagtacatatactctctggttccatttacatgaagctctaaagccggcagaattcagatacagcgatagagatcagaacagtggttgcctaaggtaggtgaagattaactgagaagggcatcatatggtgagacaactcctcaaggtgatgacagtgtccactatcttgattggcatgatggtgactcagatttacatactgctaagatgcagcatgcatgcttaagatcacatatgctactgtaaattatacctcaattaaaaaacatgatttaaagcacaacctataagcaaaagagccagtttagaaatcagttaccaccaaaaatgccctgtgaatgtgggaagaatgagtggagaagcctgcccatgtcttgcctcagaattttcactgcccacctgctcacctccctaggttgtctcaggcataaacgaagatgatagatgtcagggcacttggaaactctccaatcgctgtacactctaaaaggggtctagtttaatcatttgtactaatttcttagaaatgcatcactcttttttccttatttgcctttttaatatagaatcaaggcttgctcatcatcaaaaagattcaaacattacagaagtgtagataaaataaaaactgcaatttcccttctctctcctctccttttcctcctctatacaacccactcactttccaattttggtgacgtggcagttctgcatggatctttccagattttttttctcccccaactgcaatcatacagtacaccgtatcatgcaacctgctcttttatttaacaacatattctctccaacagtgtggatattccgtcatttgtttaaccaagcccctaatgattgacattttgggtttcccctaaagttttgctgttataaactacgagacgaatgtgtttccttgatcttcttcaaatccttgtgtgaatatccctttagaataagttcttagaagtgaaatttctgagtcaagtagtacatgcaatattaattttaataaaccttatcaaattattctctgaaaagattgaatcaatgcatagtcctcccaggagaatcccttctcattttgatctcaaagacaggaaaaataaagttgagagaatgctgaaatattcaaagattctccgatgcccttgaaaagcagaagtggagctgacatcaacatggccttattttcgctgctgacttgaaacttccataatgaggaaataaaacacatgatttaaaaaaaataaaaaaactcatcaatgagattaatgagagttgagagcctatgacttgaacatttgctggttaatagatgtagggatggaaacagtgttgtgccaattactgtaattaaccagaaatgaagacaaatggaagggagcctcttctgcccaccaagcttcaacttaaatgctgagtcatgagctactagtggaggctggaaggccaagacctgggctagtgctgggaaaaggaagtagctcttattctcccaaatgtgtgctgggtgctcagaaacagagacagtgggaccccatctctacaaaaataaaaatttaaacattagctatgtatggtgacatatgggtgcctgtagtcccagctactcaggagactgaggtaagaggattagttgagtccaggagatcaaggctgcagtgagctatgattacaccactgcactccagcctgagtgacagagtgataccatgtgaaagaaagaaaaaaagaaagagagagagaaagagagagaggaaggaaggaaggaaggaaggaaggaaggaaggaaggaaggggaagggaaagaaggaaaggaaggaagggaagggaaggaaggaaaggaaggaaaggaaggaaaggaaagagaagccatcctgtcaaggagtcccaaatatcccctgtctcatgtagctcatccttcaggaaataggacactttccaactaacacagttaggctatatcccccaaggtattatgtttttccttgaatggagtcaaacactttctaaactcgagagaatatggccctgaaggaaactacgcctgttcctgtgatgaaatgacctgacaggaaagaactcagcatcttgctgacaagtcaggaagaactcacaacctgcccagtggtcattttagtcaattttggggggaaacagttcttttgaataggtcccctaaaaaaggcttgaaagaagaattagtacattccaaagcagtgattagaaatcatcataattttctaccaggagaagagcactttattattacttaaaattactctagtccaatagccaattgctatattttatgttaacttttatttacaggaagtacaatgtattccttttggtgcactgttccatgagttttgacaaaagttcatacagtcaagaggcagaacatccccatcacccaaaaaactttcctcctgctgccccttttcccactcgcagtcctggcaaccacagatctgctttttattcctacagttttgtctcttctagaatgttatacaaatggaatcatacagtatacagcctttgagtctggctttttcaagcatttattctttatcaatgtggttgcatatatcaataacatgttcttttttattgttgcgtagcattcccttgtgtgatgtaccacaatgtgtttatctgttttccagtctgggaacatttggataactttcagtttggacgattataaataaaatcgttatatacatctacacacagatttttgtatagaatttagatgtcctctgtcttgggattgaggggctgtatggtaaaccaactgctctttaatgtctagaaaatgtgacagtcctcagagtcatggagcctagaaaacagtgcggttgtccctggagttcagaatgctttactctgtaaatatcattcttacttggatagccttggtctgtgagtaaatgtgctatgataggcgttgtgtagccgttcatcccagctctgtccccagaatcagataaggactcatgctgtgaactctgatgccttcagtccaatgagaccagaacatcacttgcccgtttttattttaggtctcgtgtcaagctaagctaagatacttcattcctttttcttttcccatcaaattttgtatcttaaaagtttcaaaaaaatttataagcaagtatatctcaagatttttaactgaatgaaataaatttaaataaaattctgagtatttttccatttgattttttggaaaatatatgcagttcccaaatttgaacaataaatgtgcatttataatgtaagattatgctcccagaaagctaaaaaaaagttagaattatcataattacataatccctattatacttcaactcttagacataatttttaatcatttatcttcaaaaagatgaatatttttaaattttttttcttttttttcaatcactattaagcacagttgagttaaatccagtaagcattctgttgggactaaagattttctgttcaaagcacacctaatgatttctctcttgtttcaattgtattaaatttatgagacctctattttatctctagtgtcagtttatttcatttccattttccacttgttttcctaaaataacaacaaaatgcaattaaaatgtgtaaataatgctgcttacaacacctccatagctaagtgtggtataaataaaagtggtatggcactagcacattaaaaaaggaggcttgaaatatcaacatttaatgtaaaaaaagtacaagtacagtaatggaaagctgaatgtttaaagatttggaaactcttggaagcatgcttgtgttgctctaccgaattccaaaggcaaacagttttattttaataatttcgttagctgggcatggtgacatgtgtctgtagtcccaacaacttgggaggtggagacaggaggatcgcttgagcccaggaatttgaatccagcctgggcaacatagcaagaccctggatctgttttctgtacctatagttttctctatgataataacaaaataataataattttgttaatgttcagagcatgagtgagctccacctgacaactcttataatgtcaaatgatactgacgtcaacaaaacaacttagacaattcttgaaatttgcttatttatctgatacatttgttgagagtctattatgtgcaagtggtatcaagtaaaaaacccagtgcatatccttgaaccacttggagagaactggaggggatggaaaagcgagggatatctgttcacagcagagtgtcatgtgggaagaggacatgtccttgaaccacttggagcgaaccgtaggggatggaaaagtgagggacatctattcactgcagagtgtcatgtgaggagaggacaaggaacagggaggcacgggggttggatgagctctcttcctggttcttgaaaatgccacgaatgttggtggtagcaggaatggcaaagagcaccatgagtcagggacgtgtcatctccaaaaggtctagggcagagtatttccttcccaagaaaccagtgtcccataattcacctgctggaacccctgtgcacaaagggattgtgtgattaatgtagattttggtgtttcatattgtagcaacttaataaggtatgtgcccagcttctaaatgaaggctataatcacttttccatagtttatgaattatgaagttggattcccatcccaaatgctgtccaagttttttggcttcaaaaccaattaaaatgatgaatagctgtgaaaagaaccagaagtgcatttaatctttcttcagaacagttggggatcagttcttttttgtcacatttcacattagctgggaacataaacttggtcttgttcaaaggttcaaactacttcttcctgaaagagaaccgatctacttaactttttttttccccagctattataaacactgagatatttacaaagtgccttgtacttctttctgtttatctcccaaggtcacgacactctatttgcatcttctcttagcaatgttatcctaaaaagaatcatcaaagcaaagattaactgttacaagaaaaaacaaataagcgagaagattacttacaaatttcgggggttggtttattatggatgcaaaaatgagtagaaactcaagtccctgagtccacctttcatgacggtagtcctgattttgctatcatttaatacaacttaggtcttaatgttctcactcagtgctgagtgtgctgggataagcaaggtgttcacagtcttgtacatttttttctttactttttatcataaaaatgagctgcagatgtcatgcagtgcagagagaagagaatgctttctgagtcagaaggtcacattttttgtactcaaccacttctagctggaaaaccttgagcaaattacataatctcatggagactcagttttcttacctgtagaatgggggttataatatttaattctcaaaactgctgtggggctcacacaaaattaatttgtgctgaattacacatatttgtaatttatacataaaacttatatgtatatgtataatagcaacagacccctgatacagtatttattattcatatacctgtccttttgacagaaggaaaaaacatcatctaagatgtgttttagacaaagtttccaatcaatgatatttggacacaacagccccttcgatgaggtgactcagctatcagtgaactcatctttgctatttttagagctgaaaaaggagaagcaggtgatactgaagttgtgtaatcagtctcagggggagggctataaactagtgtctctgtctctctcaggacatctggactcaaaggtagtggcctcaacctcgccagccattcaaaggcaagcagaactctcacagaggaggcaagggcggagaagctttgagcatctctacaacatcagagaacacccagtcaaaagagagggaaacacaaattgacttgtacctcatcaccttgacaacacaaatttagactctggctgctacattatcttctggttccttttccggagctgctctccttgagctgatttacacggttgctattgtagacccttgactgtacacccagtctttgtggaactccaagaatcaggcttcaattgtactttgagccagctacactgggccccttcaaccctcagccttctctccaggcaagtccataactgcagctgtggtaagcccatctgcaggctgccctcttcctgtcctgagtcccggagggcatccctgtgtgatcactggccttaacctctcattaagctatcaaagctaccttccactgcttttcttaaacccacgtcttttctatttccttcaacttcaaattagccattgtttccacatcatcctctcatgacatgatagggaatgaagtgatgatggctcacagcactgctggggctgcttttacaagaagctcactcaaagtcaacttattttttttttttttgaaacagggtctcactgtgttgcccaagctaggatgatacagttgcacaatcatagcttgctgcagcctcaactcccaggttcaagagatcctcccgcctcagcctcctgagtagctgggactacaggtgcgtaccaccatgcctggttaatattttttatactttttgtagacatggagtcttgccatgttgcccaggctgagtcaaggtcagttttgtcaccatggggggcatagagagacctcagcagtgaaggcctctaggaaatgggagaaatccaaccaggctggaacaaggctgggagaatcggccagttctagggcagttgcctaagtagaatgggtcatgaattcgaatctgcttcaagcgatactcaggtcaaatttggacaatgaggccaagcaaagacttgagcacagaatcaaagcacacctagagttacctatgtgcatctccgtttttgctaaatccaaattacaccttactatactgttaacttttatttgtctatatcatttgttggaatccagaaaacatacattgtttctttccaggaaaaagtcaggtataaaaataagtgtgtgttgaaatataagcacattttaaaaagaaattagctcctattctcattcctgcagcttggcattgagtttgtctgtaattgggtgtgttttaaaattaaaaatttgaaataaacgttaagcagcaggagtcaaaaataattcagaccgtaatattcatcaaaacttgtttaatagcaggaaaccctccactctgaacttttactcttctttcttgcagaatcaatccctccagcagccctcaactaccagaagcacaaaaattcaatatatttttttttttgagatggagtctcactctgtcgcccaggctggagtgcagtggcatgatctcggctcactgcaacctccacctcctaggttcaagcaattctctgcttcagcctcccaagtagctgagattacaggtgcccgccaccatgcccagctgatttttgtatttttagtagagatggggtttcaccatcttggccaggctggtcttgaactcctgacctcatgatccacctgcctcggcctcccaaagtgctgggattacaagtgtgagccgccgcccccggccaaattcaataatattatgcttagtagtcacacactttctcttgttttcttttgttttctttggctcattagacctctccttcagaaccaaagaaatccattgtgacaactctgttctcagagctgactttttccatagagagaacttcagtctgagacatgccaaggagttcttgacgctcccaaaattaacacctttcaatctttactattagagattaacttgtttcaatgcccattctcttctgttaaagcagataatattgggaaaggcaatgtctgaatgtatttctgccaagatgtcgatggtttatcaaaatcaatttcttcctgtggaagagtttaggtgcaaggggaggagagaaagtgagagaagattataacagggaggctatggatgcagaaaggaaaagcggggaatcaaaggcaaacctgccacccatttcacaaataaaagaatcagtgtgggctggatgcagtgtctcatgcctgcaatcccaatactttaggaggccaaggtgggagggtcgcttgaggccaggaatttgagaccagcctgggcaacacagtgaaactctgtctttacaatttttttttaattagccaggcatgatggcacacgcctgtagtttcagctactctggagactgaggtgggaagatcacttgagcccaggagttggaggctgcagtgagggatgattgtgccactgcattctagcctgggttacagagtgagatcctgtctcaaaaaaaaaaaaaaaaaaaaaaatgcagattcagtcagtctgggctggggcctgagattctggatttctgacaagttctcaggtaatgtcagtgctgctagtacacagatcacattttaagccacaagaaggctaggatatgaggtatgaacaaaggtgttagctcagtggttctcaacctggactatacatcagaaccaccaaaagaggttctgttgggtttgttggaggtttgtttttttttttaagctcctgatgctcaagccccaccccagattaattaaatcagaatctaggaattgctcaagtatttgtatttctaaaagctctccaggtgattctcttgtgcagcttgagttaggaaccactgttagttgataactgaaggtgctattaaaaattccataatatatgagctcatgaaggctaatgagacaccccagctaagggcatcttcctctgcaacagcaatttgctattgtacaatgggggcaaacagttggtgctcaataaatttgttcaatgaaaaaaaataagtgattggctgaatgcatgaatgaatggaaatgtttgaagtcaacagtctatggaatgaaaaggattacagtcctattatcaaaatgacaagtggcaggatgggtattttaagacagatcatcttttccatcactctttcaaataccccatagaagtacttaaatcttggcccacttttaagcctgactttgttaataactggaggagtcaaagccacaaattttccacaccattactttattccagtgtttgccaaaccaaccaacagtcactatacacttttgctactggtgttattatttacctagtatgtttctttaaattgacttactttttaacataaacaaatgtattttaaagggaaactataaatcactatttcaaatagaaaagcaactaatattccatgacatcagtagaattgacagtcaaaataaatgcaacgtaagcaactgaagcagggtgtttctgcctgccaatgcttgcctctgtcagataagaagaaggattaacaagtatacggaggtgttaaagccatgggggcacttagcagagactttgtcactggcataataaggattgcaggagcgttttgcaaggagccacagtcctgccgtgcgatgccatgttatttaacatgaaaagcaggcaccacgtgtaagcatctcatggcattttcagtcaatgattgtcaagctgtactcagaaacccaggggccaccaggtagtgttgaagaggctctagaaaaaagaggaagtatttcagattctgaggaattcagtcgtcagtgttatttgtcttatagagagtatgatttttttttaaatcctatttctataaggaacaacataatcaacagagaacaaagaaacaggttgaaccctgccattgaaatcaggagaattaaccttctcattggaggcatatttgctggtttaggcctcaaaggcattacatcaaccttggatgagacaatttactaaataaaaccatgttattaaaaaaatgaatggaccatacaaaataatatatttcatgtgctcccctagctctttagtgaagtatggccctctgtgggaggttaaattattagctaaatgtatatacttggatttaaacagaatgatccactgatgttctaggaagtaaatgcactaacttattcttttttatttgccaggtatttgcttttcttttaaataatgcatgcagtagaatatgattaatataattctgatgcagaaaagcaagattgcacacttaggagagaggtctctggagccagactgcctggtctaaatccctgctctgcccttcatcatctgtgtgaccttgggcaaagtattcaacctctctgtgcctacactgccctgcttataggatgaggatgacaataagggtattacccacataaggacatcataaggatgagtaatgcatacaaaatatctaagagtcccctatacaaaatacgcactccatatgtgctacctgatatcattacagtaaaaaaaaattacacaaaatgtaatttttactaattttaattacaaaatgtaattaaaactaagtcttccttccaccctagaccccacgcctctccccaggcaaagtactgtaaaaagacccttgtgcttcttctcagaactactctatacttaccatcaagtccatccctctcttctgtgcaaatgggagcccactatccactctattctacatattgccttttttgcttaacaacatttcttgggaatgagttcattgctagtttcatacctcattctttgccagagctgcagagttttgcatcatatgggtgcaccagaatttctttaactcatccccagtgttggagatttaggttgtttctaatatttcactattacagtcactgccagaatgaatatatttaaatatacatctttcattcatatggaagaatatctttagggtagagtcttagaggtggaattgctgggtcaaacagtccattcatgtttattttgatagatattgccaaatttctcttcaaagagattgtgccaacttccataccaaccaaccacatacagaagcacctgtgtcccctcattctcaaaataatattttaaatacattaacaagatatacaaggtaatcaagttttttagtctgtttgagctgatataacaaaatatcttagactgagtaatttataagcaacagaaatctattggctacagttctggagaccagaattccaagaccaaggtgccagcagatgtggtgtctggtgaaggcctgttcctcatacacaaggacttcctgccacatcttcacatagtggaaatgttaaacaggctccctcaggcctcttttataagggcactaatcccgttcatgagggctccaccctcatgacctaattacctcccaaggaccccacctcttaatacaaacacacagggggttatatgtcaacatatgaattttggagggacaccaacattcagactatggcaccaaggaatgctattatatggaagcagttatcaaaagattgaaattacacatctgtgaaatgctaacatatgtcctttattaatgcatcaaataacaaaatctagtggcaggtaggggtgtgctgaaaagatactttttagcataccggcaacaaccctaatgtggaatgaagatacatgttgatgatatgctcacaggtactgctaataatactgttgtttgtacttcccattcgtaattgaaggaaatgcttgatttgaggtggtggctagtgcaaataacaatgtaaatttttccacccaagttttagagcctatcttggagccagctcttagagcctcattccaatgaatggcagcttatttttaatacatcaggtcagctccaggaatgtacgcttttagggaagctcttaaaattcatgtgtgggaatcagcctccatctagcctaatacatgcttcactggccttctaaaatagcaagccgagcaagaagacatagacaggcaaaggccactctaaagataccctccggaggtgtctgcctcggctgttacttagagcaactgtttgctccttcctgcaatacagctgcactcctccaccacagggttttggaaaatatcaattaaataatatattttaaacaactttgaaaaagataaaggcatctttttaatttggggcaccctattagccattaagaattaatgttattatctcctcatctgtttagtgtttagaacctctcccaagtctgctgataatggtggcaatgagggccaaaggatggagctgcttagctctggtaaatactggccaggcacagaggctcatgcctgtaatcccagcactttgggaggctgaggcaggcagatcacttgacgtctggagttcgagaccagcctggcctggccaacatggcaaaaccccgtctctactaaaaattagccaggcatggtggcacacctgtaatcccagctactcaggaggctgaggcaggagaatcacttgaaccctagggacagaggttgcagtgagctgagattatgcccccgcactcaagcctgggcaacagagcaagactctgtctcaaaaaaaaaaaaaaaaaggcatggtggctcatgcctgtaatcccagcactttgggaggccaaggcgggtggatcacgaggttaggagatcaagaccatcctggctaatatagtgaaccccgtctctactaaaagtacaaaaacaaaattagccaggcgtggtggtgggctcctgtagtcccagctactcgggaggctgaggcgggagaatggcatgaacctgggaggcggagcttgcagtgagccaagatcacgccactgcactccagcctgggcgacagagcgagactccgtctcaaaaaaaaaaagaaaagaaaagaagaaaagaaaacataaaatgtccagccacccaggacacaactgtgtggcctgaccgttcagttgtatcactcctcttatctggaaagtgctccagtgactacagaagttgctagaatttccaaaagcaagaagaaagtgatgggaaaatgtgtcaaatccacaatgggagaacactgtgtcactagaaaattatatgaccctggcaaccttaggagtatggaagaaagatttcaaacaagtttctgactatgtatctttttctaaatttttttgaatgctgaagaaatgttaaatttcattaagttttacagccagatttaatatagacataaatccctttaatgttcgtttcagtcaaaagtgagcggaacattatcgttaaaccagtgcatgtgggagaattacttgaggaaaatcaaaataggcacagttgggaacattaagccgtggccatattagacgcaagtaggcgcaatagcaaaattctttaggctctaatggactgggctattttgcttctcagtttccatacagatgagctttgttctggggcaatatggttgcagtttgagagtctatctgaaggagctcatttctctttcattagtccatgagcacagtgcaatttcagctaatactgttacacagctcctagctgggttatttggttaaatgccttcagggaaagtagcaagacagaataaaaggacaaatgcaatgcggtttcttgttctgagttcctgtagctgtggaattacattggcagttaatcattaccacgttgtactcgtgatcataaactcctgttatttaagatgttattcaagtctcacaagaaacatcttgtcttctgtggcacaatttccttgaggtcgggtttgtgcacaactataaccatagagacctgtttcttgtgcttcgtggacatgctagtaggtatatagtgccatttgtgtgaaattgaaaatgacattccctactggtgggtgaactgggaaacagcaccctgtctatgggcaaattagaaaagatgtccccttctgggtggacaaatgagcaaaaggcagcccctctgggctgaccaattcttttttaaagcctcctccaccttggggtgtgggggtggtgcacatggcttggtaagtccaatgcagaccctagttgctccctgtgggcaggaacccctggcgcaatgcacaacctgcacaactgtacacaacagccctgattacagaatccattttcacaattttgtagttggaccacagagtttgcccctcagtactctaaaaatatctgttcaatcacatcagtggatgtccatattaaatacattggtcttctttcttatggcaagtaactgccactctctgccaagggcagtgttctaaccttggaaacaaacaggacactcgtaggttgagaaacagaagaactagaggacggtgactcctaggggcttgaccagtggtgggcagtggagtggtggaaaccacggtggcacctcttcaccatcgcaatgtaatgctctcctcagcctccatcattacctggtgagctggggctcagtatctgcctgataacccaccttcagctagcatgagacacaggaggagcaagcttcaaactcccaacaaggtagtcagcctagttcataccagattcagtggctgtagcccaggagagaacgaggtatggggcacgtatgtctcagagcagagagatctgcctagaaagacaaagactgagtgagaagctatagtgtgggctatcagagggcagcctgggagcccaagaggcctcggacattggtcagggattggcaaactctttccgataaaaggccactttgtaaatactttaggctttgtggggttttgtcacaacgacttatctctgctgttagagtgcaaaagcagcgactggcaattcataaacaaatggatgtggctgtgttccgatacaactttacttacaaaaacaggccatgggctgatttagctggtgggccatattttgtgacctttgctgtcggtgatcaaagaaagaggacacaacaggagaagtcaggtgaggcattgcccatactgcgtggggcaacgtgcttgccagcttacattccttgtttcattttatcctcacagcaaccaactagtaacagttttaccacctacattttgaagatgaggaaactacagtttctaaaaaataggaaaatttccagggtcaaaaacagcctcatttcaaaaccaagtctgtttgacttgaatgtctctcttccttcccctacatcaagctggtacctgcagacgtatttgtctagggcagcccagccagggaagcccattgatcacagaggcattaaattccagatttgaaggtatggatggcagtgccagggccaggtgcaatctcaggagcctcagaagcttctctgtggatgtaaaagcaatgggcacagccaccattgactgcaggagctctcacctctctcatcaccagccattcagatagacaagccccaaatccgaaaggtgtcatctgtgggcctgcgtctttgatagccaggcaattacagcacctcatatataaaaagccagaggaatctgtgaatataataagtgactgtcctttcttagcgtggtgcaggccatctgtttgaaaagtacacactgcaaacaatgccaagttgtaattattaaactttctagctaagagcgagtctcatctttcttcctaattatgcattcaaatattcagaaattaagccttagaattattatataccagggatgggtttttttcccctgtgcattaaacttttagaagagaacatgagccatcatcagaagtttctcccagaaataactcccagagaagccctgaggtcagcttggaatcaacccaaccttctcactttcggtgtgatggtacaatgataattcaagttcttaatgatgactctgaatcatctcgatcctgaatcatcagagattaaattattttcaccaaacagctagtattttctaaagcaggaaaatcgattaaaggatttcagtaaaaagttagagaagtccaaacaaagcaagcatctggcaagcctcggtgaccagaacattaaattcaccaaacaccacctgctccaaatgtccatgttaatggcaattatagaagactccagtagcattcaaggccagtttaacttattcctgtacacaaataactttatgggagacagcattgtaattcaaatcaataaatgactcggtttggctgtacaagcataaacagaacgcttgcaaaatatggttcctccttgctagaaaccatttgatttttagccagaaaacatacagccaaacaagaataacaactgtttgccttccttaatgttcagtgtagactgttacccaaggaattaagcattagtcatcaaaacttcattgcaaaggcaacaaaataattggggttcctgagttatcatccatttcaacattcagaggccaatttgaccccagacaatacaaggtctttcttcttgttataaaagtggttgcagagttctgagggttctctgctgtaagctctgctctcagaactctccaggtcctgcttccaacccctgccatgtccggccaaactattttcccagagtcaggagcagagccaacagcctcactcagacagaccccagtgataattatcagcccaaaagataagcccaagtggaaagtttgagaagccagtcactcaggcagcagctacaaagggacaaacactctctagttttccctcactgacttcatttccctctgccagcctggtagaaacatggtctcagtccgctcaggttttgcccctgtcctccctgtctccagaagcgccctcaagcttcaaaagattcatacagccttccagagagggagacggggacctagtgctggttttcatcatctgtccactctggcttctgcagtaacaccattcccattggcctcggtggtcagttcacccagatcctgcctaaaccctggatgcttattgtcctgaccacccgaatgtcctaggccagctagttctcagcgtcacatcctcaccaacctccgctccctgctctccactggggatcaagggaatgcaggatggagctgccccaagcctgtagctcagatgcctcacaggggcatttctgatctgcaacactatgtccctgttgtgagctgagtcccaggcctctctgaggttggacatcccagcgtgcctcttcccactccaacagcacacctcagaaggaagaggcagcctcaggggcccgctgagtggccactcgtgctggatttccacccacctcaccttagggaattttaattttttctaaagagaaacaaaccagattgggcagatactcttccaaatctactgcttaagtttcaatctcagctttgaagcccagaaaaaaaagtattaacttgtgtttctctcgatattcctaccccactaactatacctaagaatgctgttatctctgaaaaattcagaggttaggagaacagaacacccttggggaagacaagttactatttcaaaatagtatctctgaaaaaaacagaaatccaaatatcgcatgggaagtcagtgggagaaaggccaaatctgagagggtctcccaggaacacggattgcgggccagatacagaattaaacttttaaagtgaatgaaagcaatctggggtctaagtggggaaggagtcgaaaaactggcaacttgccagtagttatggtcagtggagacgagaagacttcctcctctctgaaagccaagtgttgaatgaagacctagatcctggaataaaggatcaacatgcttaagactccaggcaaattactgggccaaatttcagggtgactcctgcccaagtacagcatttatttaaataaattagcattacaactctgattattacaactactggtgattttgtcacctaaacaataaaacaaaaattaatggaattagtggagttgctcttaaaaacattatgccaccacattaggcttacaaactcaagtgtgtcacaaaacttgtgtgttatcttatgataaagcacagttcctaaatatgtctcaggacccataacatcaagaaatgccaaagctggaatgtgcctctaacccagtgtttcctggcccagtgtatactgtgaaccaagaagccatctggggtcttcatttcagacccccaaaacaaaggagaggagaatgagatgaggaaaaaggaacttgagagagagcagcttctccaagcaagcagagaagggaatggggaaggaatgggttattcactaaacaatggtggatcatctcccattacagaccagaataaaaggcaaaccaactaaagacctaaatgttaaagaaaaaaaaaacccacaaaattgcttagacagttttagtggctacataattattttatgtggggaaagattctcagtgggaaaaaggaaggtgctggatgacagagaatagtacacttttgaccatatgctgtagggcataagagttcatacagatacttattgaagtttgtaatggtacatttctttgtttgatctttcgattgatgtctgttcccgcaactaggctataagttacataagggcagggatgccaccattgtattcccgtacttagcaaagtctctgacatatattggactcttaatgatatttgttgagtgaataaataaggtcaattgtggacaacgtcagggccttgggcatggggtttaaaacccataaggggaaaggaaaccagcctatgctagtctgaaggaagaagctggttgtgagctttctgtgtaaagcaaggaaactctagaggccatctcacttgtgatgtgagaactagaacatctggccatctgtccaaggaaggattaaggaagcttaccctacatcttgggttccaggtgaaatccattaaccacaagggctacatcaacttgaaaggaagacagtcctggagaacacagggcttacatttgctaaccccttgaaggcttgaaataggatgaaatggggaagcctgaaagagaatatcaagagaggatggaaaaccccaaagacatgctttggctccaacacaattttgtgaggtttggtccagtgcagcacactaatccagcactccagggaggactagaaatgtttaaagtctcccagcgctttccctttactgcgcctctggctgtacggacctaatgagatgccttgtgtttttcagaatgccgaagcaagttacgacttcagcagcaacgacccctatccttaccctcggtacacagatgactggtttaacaggtaaactgggccttgggaggtctctttgactttaggctttggggttttattctactttgttttgtttcaggcttgactaccaccagcaaaataatccccatgcttcattaaattatattgtgatttttcttcttagtggttacattctctaaagtgaaatttttaatattacaatcttcctctagaataatcttttgactgttttgttctgctaacttgaaattatttgctactttaatccattaaagagaaaagaaaatagaaataagaagttctttctcaacccattacaaggtgatttaaaacatgctgattttgctttatgtgttgaaactgtcgtagagaagtattttgccccatgggtctatgtgtttttgaaaagcattctgtacgctttctgctataaccccataacagctcatggagtccctttcaacaaaacagtaagtgtgattggcagaggtttgaagtattgcttgggacaaagatcctatgatgtcaaactacccaaacagtccatccaagagaataattttccttcagcttgttttgccactaaacatggaaatgtggtctcttttttcttcaagtaaacatttttcttaaatggttaattacatataagagatatgaagaaataaagatgtgcggtttgctcaatgaaagaatactgtaatttttaaacctagtgtttccctgttattgacgtccttgggtgaagttcataaaaacatatgaacttcaattagttgtataaaaatatatgatgtgcagagcactttatccatttttttttttatttctcatggcactctaagtagcacataaaacaaatgttgtcatttttagtttagtgataaggaaacaggctcagaagggttgaagggcttccttggtcaaacagttaaaattcaagtcaaagccaagattagccccatgcttcaaattatttccaaatccacatttgtactattctttgctgagtatcatttctattatttgatacaggcagcatgatgaccagaatatgttcaagggtagagcctcagtggacaggaagcttagattctgtctctaaagttagcaagttgacctgagacccctcagtctcatcaagggttgacacagggtacacaggttctgagtacaaatgcagaaaataagaaaaaagaaaatgaaatttaattttgtaatattttgtaaagatcattgctgatgtcggatagcacaattcattctctatccacatcacctgcaacctgaaaatgacatacaatgcttggaggtgtgtgtttagaggatgagaatgtataaaaaaggtctgaaaacttttggcatgaagtgtgttttatctctgtgacttctaaccctagatggtagcatatatttagcaaataaaccatttcagacacaagaatgtgaagttaccaaatgtgtgccattaagctggggtttagacagaattggcagtggccatccagggcacagtgctgagaagggccatgagagggtctggcttcagcaggattgattaccagctctccgcatgaatatcagaaagtgcagtggcaacatatccactggctacttgctgtctttctgtaactagtaggtactaaattagtctttgatggattgatgtaagcacaaaaatataaccaatggaaagattatcccccaatctcattttctgaacccaaacaaaatctaccctagtcaaatcttcctgggcaatgtgctataaaaatactccttaaaaaaactaaaaggttccactccaagatggccaaataggaacagctctggtctgcagctcccagcatgatcgacgcagaagatgggcaatttctgcatttccaactgaggtatctggttcatctcattgggactagttggacagtgggtgcaaggggtcggaggatttccctttcctagccaaaggaagccgtgacagactgtacctggaaaaatgggacacttctgcccaaatactgtgcttttcccatggtcttagcaaacagcagaccaggagattctctcccatgtctgggttggcaggtcccacgcccatggagctttgctcactgctagtgcagcagtctgagattgatctgcaaggcagcagcctgatggagggaggctgagacttgagtaggtaaaaaaaagtggccaggaagctcagactgggcagagcccaccacagctcagcaaggtctactgcctctatagactccacctctgtgggcagggcatagctggaaaaaaggagcagaagcttctgcagacttaaacgcccctgtctgacagatctgaagagggcagtggttctcccagcatggcatttgagctctgagaatggacagactgcctcctcaagtgggtcccttacccccatgtagcctaactaggagacacctcccagtaggggccaacagacagctcacaaaggtgggtgcccctctaggacaaagcttcaagaggaaagatcaggcagcaatatttgctgttctgcaatatttgctgttctgcagcctctgctggtgatacccaggcaaacagggtctggagtgggcctccaacagcctgcagctgagggacctgactgttagaaggaaaactaacaaacagaaaggaatagcatcaacatcaacaaaaaggacatccacacgaaaaccccatttgtagatcaccaacatcaaagaccaaaggtagataaaaccacaaatatggggagaaaccagagcagaaaagctgaaaattctaaaaaacgagtgcctcttctcctccaaaggaccgcagctcctcgacagcaacagaacaaagctggatggaaaatgactttgatgagttgacagaagtaggcttcagaagctcagtaataacaaacttgtccaagctaaaggagcatattctaacccattgcaaggaagctaaaaaccttgaaaaaaggttagatgaatggctaaccagaataaacagtgtagagaagactttaaatgacctgatggagctgaaaaccatggcacgagaacttcgtgacgcatgcaaaagcttcaatagccgatttgatcaagtggaagaaagggtaacagtgattgaagatcaaattaatgaaataaagtgagaagacaaggttagagaaaaaagagtaaaaagaaatgaaaaaaccctccaagaaatatgggactatgtgaaaagatcaaatctacgtttgattagtgtacttgaaactgacagggagaatggaaccaagttggaaaacactcttcaggatattatccaggagaacttccccaacctagcaaggcaggccaacattcagattcaggaaatacagagaacaccacaaagatactcctcaagaagaggaactccaagacacatacttgtcagattcaccaaagttgaaatgaaggaaaaaatgttaagggtagccagagagaaaggtcgggttacccacaaagggaagcccatcagactaacagcagatctctcagcagaaaccctacaagccagaggagagtggggaccaatattcaacattcttaaagaaaagaattttcaacccagaatttcatatccagccaaactaagcttcataagtgaaggagaaataaaatcctttacagacaagcaaatgctgagagattttgtcaccaccaggcctgccttacaagagctcctgaaggaagcactaaacatggaaaggaacaaccagtaccagccactgcaaaaacaccccaaattgcaaagaccatcaatgctaggaagaaactgcatcaactaacgggcaaaataaccagctaacatcataatgacagaatcaaattcacacataacaatattaaccttaaatgtaaatgggctaaatgccccaattaaaagacacagacaggcaaattggataaagagtcaagacccatcagtgtgctgtattcaggagacccatctcacgtgcggagacacatataggctcaaaattaagggatggaggaagatctaccaagcaaatggaaaacaaaaaaaacacaagggttgcaattctagtctctgataaaacagactttaaaccaacaaagatcaaaagagacaaagaagaccattacataatggtaaagggatcaattcaacaagaagagctaactatcctaaatatatatgcacccaatacaggagcacccagattcataaagcaagtccttagagacctacaaagagacttagagtcccacacaataataaggggagactttaacaccccactgtcaatattagacagatcaacgagacagaaggttaacaaggatatccaggcttgaactcagctctggaccaagtggacctaatagacatctacagaattctccaccccaaatcaacagaatatacattcttctcagcatcacatcgcacttattccaaaattgaccgcataattggaagtaaagcactcctcagcaaatgtaaaagaaaagaaatcacaacaaactgtctctcagaccacagtgcaatcaaattagaactcaggattaagaaactcactcaaaaccacacaactacatggaaactgaacaacctgctcctgaatgactactgggtacataacgaaatgaaggcagaaataaagacattctttgaaaccaatgagaacaaagacaaaacataccagaatctctgggacacatttaaagcaatgtgtagagggaaatttatagcactaaatgcccacaagagaaagcaggaaagatctaaaatcgacaccctaacatcacaattaaaagaactagagaagcgacagtgaacaaattcaaaagctagcagaaggcaagaaataactaagatcagagcagaactgaaggagctagagacacaaaaaacccttcaaaaaaaatcgatgaatccaggagctggttttttgaaaagatcaacaaaagtgatagatcactagcaagactaataaagatgaaaagagagaaaaatcaaatagacgcattcaaaaatgataaaggggatatcaccaccgatcccacagaaatacaaactaccatcagagaatactataaacacctctacacaaataaactagaaaatctagaagaaatggataaattcctgaacacaaacaccctcccaagactaaaccaggaagaagttgaatctctgaatagaccaataacaggctctgaaattgaggcaataattaatagcctaccaaccaaaaaaagtccaggaccagacggattcacagccaaattctaccagaggtacaaagaggagcggttaccgttccttgtgaaactattccagtcaacagaaaaagagggaatcctccctaactcattttatgaggccagcatcatcctgataccaaagcctggcagagacacaacaaaaaaagagaattttagaccaatgtccctgatgaacattgatgcaaaaatcctcaataaaatactggcaaaccaaatccagcagcacatcaaaaagcttatccgccacgatcaagtcagcttcatccctggaatgcaaggctggttcaacatatgcaaatcagtaaacgtaatccatcacataaacagaaccaatgacaaaaaccacatgattatctcaacagatgcagaaaaggcctttgacaaaattcaacagcccttcatgctaaaaactctcaataaactagatattgatgaaatgtatctcaaaataataagagctatttatgacaaaaccacagccaatatcatactgaatgggcaaaaactggaagcattccctttgaaaaccagcacaagacgaggatgccctctgtcaccactcctattcaacatagtgttggaagttctggccagggcaatcaggcaagagaaagaaataacggtattcaaataggaaaaaaggaagtcaaattgtccctgtttgcagatgacatgattgtatatctagaaaaccccatcgtctcagcccaaaatctccttaagctgagaagcaacttcagcaaagtctcaggatacaaaaatcaatgtgcaaaaatcacaagcatttctatacaccaataacagacaaacagaaagtcaaatcataagtgaactcccattcacaattgctacaaagagaataaaatacctaggaatccaacttacaagggatgtgaaggacctcttcaaggagaacaataaactgctgctcaacaaaagaggacacaaacaaatggaagaacattccatgctcatggataggaagaatgaatatcatggaaatggccatactgcccaaggtaatttgtagattcaatgccatccccatcaagctaccaatgactttcttcacagaattggaaaaaaactactttaaagttcatattgaaccaaaaaagagcccgcattgccaaaacaatcctatgccaaaagaacaaagctggaggcatcacgctacctgacttcaaaccataatacaaggctacagtaaccaaaacagcatggcactggtaccaaaacagatatatagaacagaacagaggcctcagaaataacaccacacatctacaactgcctgatctttgacaaacctgacaaacacaataaatggggaaaggattccctatttaataaatggtgctggcaaaactggctagccacatgtagaaagctgaaactcgatcccttccttataccttatacaaaaattaattcaagatggattaaagacttaaatgttagacctaaaaccatcaaaaccctagaagaaaacctaggcaataccactcaggacataggcatggacaaggacttcatgactaaaacaccaaaagcaatggcaacaaaagccaaaatagacaaatgggatctaattaaacttaagagcttctgcacggcagaagaaactaccatcagagtgaacaggcagcctgcagaatgggagaaaatttttgcaatctacccatctgacaaagggctaatatccagaatctacaaagaacttaaacaaatttacaagaaaaagacaaccccatcaaaaagtgggtgaaggatatgaacagacacttctcaaaagaagacatttatgcagccaacagacacatgaaaaaatgctcatcatcattggtcatcagagaaatgcaaatcaaaaccacaatgagataccatctcacaccagttagaatggtgatcattaaaaagtcaggaaacaacaaatgctggagaggatgtggagaaataggaacgcttttgcactgttggtgggagtgtaaattggttcaaccattgtggaagacagtatggtgattcctcaaggatctagaactagaaatatcatttgacccagcaatccaactactggatatatacccaaaggattataaatcatgctactataaaaacacatgcacacatatgtttattgtggcactattgacaatagcaaagacttggaaccaacccaaatgtccatcaatgatagactggattaagaaaatgtggcacatatacatcacagaatactgtgcagccataaaaaaggatgagttcatgtccttttcagggacatggatgaagctggaaatcatcattctcagcacaccatcacaaggacagaaaaccaaacactgcatgttctcactcataggtgggaattgaacaatgagaacacttggacacagggcggggaacatcacacaccagggcctgtcagggggtgtggcagactgggggaggggtagcattaggagaaatacctcatgtaaatgacaagttggtgggtgcagcaaatcaacatggcacatgtatacctatgtaacaaacctgcacgttgtgcacgtgtaccctagaacttaaagtataaaaaaaagaaaatttaagaaaaactaaaaacactaaggaaatgtcttctctcttaaatatttcatttgcaaacttgttctcaaaattataattttaaaccagctaaaaacctccaattaggactaattagtgcttagggcaataaaactcatcattgtcagcggtaagaattcccaagtgtccaattacccaagacacagtcatagtgactcaggcaagcatgatccccatgccttagggagccaatgattaagacagagtgtccactttgaccagtaaatgggttcttttcaattatcaagtcattttcaaagatcctcacgcactatggcttgttattacaaagactggatgatgccaccactcaaatcgcagctactttcaaacataactaccattgtaaatgattatgggaggctggtgaggtgaagctcaagtccacagaaccaagaaaatccttagttcaaaacatcaccattaccctgaagatgattcctgcttgagtgaaggagaatttgaataaagcgtcccttccatgagtgtacgatatgtttatttcaaaacccctctgggatgaaatgatattatgcctgatgttttcttcagtattacttatggcttgtggcaggagggaagagaatgactgaagtatagaggcaataaaattggttatgggttaatcattgttaaagctctgtgatgagtacatgggattttactctatttttgtatgtttttgatttttttctaataacaagaagtaaatttaactagcatacggcataaaaagaggtaataacaaaactaggacttcagtttggtatcatgaaactgttttggtgtgcaagcttccaaggagcttgcaatgtcaaatgattgggcaacagatgcccaagttactacaatgcaaaaatgtagcccagactaaaataacacaaggacagctaatgcaagttgaacagttactgtatttaaggcactgttctgtgttttgcatgtattcattcaactaattctcgtagtaaccctctgaaataggtattatgattttccccttttggaaactgaggcacagagaggttaagttacttgtgcaaggttacagggctaataagaagtggaggcaggatttgatgccagtgggtcattggtctaggattttatctaaggcaataggtagagttgggagtagggaacgaatgtatcccagggcaaggatataatctggacaaagataggctggcggggaggtgcaggatatgttcaggaggtggtctggataactgctgtgggatttggaggctggtgcaggaggcagcattctaagaaggatccgcaagtgaggtggagcataaaagggttgaaaaagttgctaggagaaagaaataaattctgtggttgggtcagaaactgggccaggggcatagatgaggctcattctctcattacactcaagataatgctgctactctcagaagccccaatagcctggagcctggcacttgttgttggctggcataggacccagcatgagcctcccaccagctgtgcagacaccaaggcatcccacaggttcttcaggtgttttctgggcataggcaccaaatccgatgccccatctctgttcagcagagttggggctcttgagaaaggctggtgtcagcatgccctgaaactccagtatagggctgacatgctgagcagcgataggcttgttgctattaactattccagccacactgactgccacaaaggctagttacaatgcaggagcaattgcttcacaggaaaaggcagcggctgtccagcacgagattctcactgctgtgaaaatagaaaataaaatgcactataggggacactcaaagaagtaaaatgttccccttggttgggagactgagttcaatagcaacacatctctcctaggttttcctgacactttaaaccatcatctcataccctctgcatttactcattgttttcctttattaaactccacgccaagggtgctttaggaaaacaaacttcatacatatgcagaactgcttttagggaatgtgtatattagaatagcttgccttgtgctcgatttgcttttgttggattattcctgtttaagcagagcaagcgtatttattctactgtgaaccatttaataattacatgcagtatctgagctccagggatgtacttgaaatacagttaagacattttcaaaaagagtataattttctcttagcttgcaatgagcaaaatacatttgaccaaacaaaataataataatagtaactcaaattgtaaaaaggtagaaaatacacatttaatcagcatcagtaatgtgcaaaacagatataactgatttgctgagagctatcaggatttagcatcacattttttcccttgctggcactcaaaaaatattgactgactggttgatagatgagtggcatacctttcaaccatgccaagatgttgagtggccttgacatctgtccattgtcaagctgcctgctgctctcaaggtctgcagcccacgttttgtcaataatcttgcagccctgctcattttaggtcaatgtttggtgatgcattgcagatctgtattccattactgtgctgttgtccataaaaatctctcttgcatagcatttctttgacaggtgttcactactgaaatgtcatccctgccattgacgatatttatgaagcattggggacgcagcatactctatctattaaaccctaaacagtgagagattctaggttagatgcaattcttggctgcagaaagtttactataaattcaggaagagagaagacatttattactcaagcaaacaaaatggagggaaggaagatggataaatggaggctgaagaacatttatctctttgtgagccaatgtgattgatagcattagttaaaccttcaaataagaaaggttttctgggattaacttttattttcttattaaaagtcatacttcattctgaagaaccccaagcaacaggccacaaaaaagtgtgagaaaaaaggccctctctggttggctattttcacactgatgtaagctgataccttaccctggtgatacttaatggtttgggagtagatgaacatctttcccttatgtctttatgaactaattctgaaacacctcctggataataaaatgcaaactgttttcaaagacatagtctttttcatgtgagctttaagactacctcatcagtcgatattagctcaaaggttactgcttgtaaccaaccctttctacatccaaaccagagcacagtgaaatccaacagcatttaatttttaaatttctagtcccctacctggattagaaaagtatttattatttaaatttttccttcagctaaaaggagtagatgtaatatagatttaggggttatggagaaaattataaagatggtaaaagaaagacctatatttgggtataattagttctactttgtaagctaatgtgtacatgccatatagagattttatggtactcagacggcaatcaataactcttttcttaagagagagaaatacagcacattatgtagacaaatgtaatattatgttaattgcttggtatggaatgagtgatccctgaatcagttcccttatctataaacagggactaaagctcccaccttgaaggcttgtactgcggattcaagacaggtatagagtgcttggtacagagcatggcacatggtaagcactccctaaccgacaaccaatagagttgtgaaattcagcaaagagatttctacaggagctaagtcaaagattattcaacgacaaagaaaagtaggagaatttatgctacaggagtaaatgtagcattcacccacctttctcagacatctgctctctcatttaagcttttgacagaaactggataacagtcagctcaaggttaaactctctgtcaagattctagtgcctgtgtttctgcattgctgattgaaaaaggagttatagccaaagataccttgtatgcatgaaacaaagttgatctattaggaaatttgaaatgtctagcatctggcctcagaaagatgaggagtctgctcacttctccagaaagcaatgggtgcttgccagcagactcagggacttccccagaggcagctttgctcattctcacctgtcacctattctaacctattctgcctgagctattcatttctcatctattctatcaagtaggctcttgaaaccccaaagtcttaccctgtagagctcattggacattagccagcaaacgtggtcgacgccaaactagccaggaagtctctgcatttcagttctaatatgtctaacactggagcttctttctccaaagccaagggtgaaaagactgcagctggccaccatgggtcttctgttgtctaagaatctgtagatgcagagagactggagaccagaagacaaagacagcctcatgtgcatgaacttagccaagttgcacactggcttgctgactaatctgtcttatctccttatctctgtgaatgcagatccctgaaacactgttgtagaaactggttgtcagaaacagaactaaggagtcaattgaaacaatcataggaccagtagccaggaaaggaagagaggtaaaaaaaaaaaaaaaaaaaaaaaaaaaaaaagacgaaaaaatatctccacatcaaaattatcctaaaatccactattccaaaatgcctgaaaaaaatacacctaaaaaaactaaaaatcaggatattaatttgtactatatgaaatcggttctatgaagcagtcttgaaaaagactttatcataagttatttttagtttgttcagagtgataaatgcatgggtgacatacattttaaagaaaactaaatgatggtggaaacataggcaaaaacaaaagcatggacatgaaaagaaccaattgcagctgaaaaatacagcctgtggaataaaatctcaataaatggtataaaatctagcctggatgcacttgaggagttaattatcgaattgaagataacagcctgtttatcaaaaacctacagcaaacattattcttcatggtgaagctttgatagcattctctaagtctgacaagatgtgggttctccctatcatccctttaattcaacactatgctacatttcatagctgatcaaatagttataaatctaagaaaaggtgtgagatcattaagaagaaaattataaaatttacaaaagaataaaggagtcctaaataaatagagtggcatactaagctcagggataagaagatggaacaatataaagatatcatatcaaattaatatattaattcattgcaatttcaattaaagtttcaatagattattcagtggaactagacaaaattgttttaaaattgatatggaaaaacaagtggccaaaatagaagaagacaagtaaggaggaggaaaaaaggagaaaaaagaggaagagaatgaagataaagaagaagaagatgaggttgaagttcagcaacaacagaacaacagcaagatgggaagctttgccgaccggataccaaaacattacacaaccataataatatgagattgtagggttagcatacagagagacaaaaagatcaagaaacagaatagagagtgcaaaaacagacaccacataaaaggaaccctaatatatgattaagatagcaataaaaacaataaggaaatgatggagtgaaggtattcaataaatgtgataactatgcacatggggagaaataggcacccacaccacatactgagcataaataaattccaggagaatgaaagacctaaatggatataaatcttttaggaaaaaataaagaaaaacatctttatgatcatgacatagggactgatttcttcccttttctccccaattgatttagaagtttattttgccaaggttaagggtcatgacccatgacacagcctcaggaggtcctgagaacaggtgcccaaggtggttgagtcagagcttgattttatatgttttagggagacataagacattaatcaatacatgtgaagtagacattggcttggtctggaaaggcaggacatcttgaagcaggggcttccaggttataggtagattcaaagattttctgattggcaattggttgaattattacctaaagacctggaatcaatagaaaggtgtgtctgggttaagataagggtttgtggagaccagggttctttttatgtagatgaatctcctaagtggccactcttagaggcaatagatgacagatgattcctgttcagacctttaaaaggtgctagactctcagctaatctctccaggattggaaaaagatctggaaagggcagaggattctctacagaatgtaaattagggatggatttcttaagccactaaaccacatggaaaaataaatgattaataaagctggctacattaaaattaaacacttttgtacaaaaaaaaaagtcacaataaataaatttggaagacaagccacagactagaagacgtgcagcaaattttatggaaaaaaaggcttaatatagaaaatttgtaaagaacagctacaaatcaatgaaaaataaataaatacccttgtagaagaaatgggccaaggttattaacaggaaattcacagaaaagaaaatctaagccaaatagcctatgaaaagattaccttgctagtgatgaggaaatgcaaaatgaaacaataacataccatttcacaccaactggactagcaaaaatggtaacattcaacaatgatcaatgttgaaaaggattgagcaacaggattgctcacaccttgaaggaggtagtacatagccatataacctgttttaaatcctacaagaagacctcagagaaactattccttatgggtacatggaaataataaacaagaatgtttcttttcaaattatttgtaatagcaagcaaattgcaaacaaattaaatacctatcattagaagtataaataaataaatcacagcatatttataaatggactactacacagcactaaaaatggatgaactagaattcacaagttaacttcagaaaatgtagcaaatgaagccaattttacatagatcatacactaggaaattttatacagtttgaaacatgcaaagagtgacatgtatgcttatgcatacctgattataagttcataaaaatgttctgaacagcaaatttagtacacttgttacctctgaggaagcaaagaggggaaggaatggcatcagagagggcctcaaattgtatctgtaaagatttatgttgtttcttggcgcggagggggttgttttttgttttttgagacagagtctcactctgtcgcccaggctggagtgcagtggctccgtctcggctcactgtgacctccgcctctctggttcatgcgattctcctgcctcagcctcctgagtagctgagattacaggcacgcgccaccacgcctggctaatttttgtatttttagtagagacagggtttcaccatgttggtcaggctggtctcaaactcctgacctcgtgatctacccacctcagcctcccaaagtgctgggattacaggcgtgagccacagcgcccagccttttatttttatttgagacagtctcattctgtcacccaggctggagtgcagtggcgtaatcttggcacactgtaacctccgactcctaggttcaagcaattctcatgtctcagcctcccgagtagctagaactacagagacaggccaccatacctggctaatttttttgtgtttttagtagagacggggtttccaggctggtcttgaactcctgatctcaagcaatacgcccaccttggcctcccaaagtgctgggattacaggagtgagccaccacacccagcctataaagaattatgtttttctaaaaataatccaaagtaagaaaaatgtttggctttgatagacttggatggtggctatatgagagtcatcatactattcactgaaattgtctatatttttttaaatatttcataatttcacatatttaaataataagcctgagccaaaatggaaaccccaaagtgtcagacaggcccattcaccattaaaagacccacttctacacaccagcctcaaagtgcgcattaaataaacgaatgccaaaagtccatcatgcaccctgcacacacctagtgagagggtaggggaattcgaccactagacaaggcagccattttttttctgttcatcaaagactgctttgtactgatccttgtcacccaacatctctttttgtgggatccttcaaattagtttatgtcacttattattagaatttatccttccaaaacagtttatcgagtaggatctaataaaattataggaataatcaataggaataagattaaaatgtgctagttcatgttatcctagtagctgtaacaaataaatcttggccctgaaatattagtggcttagcggcttagcaccaaaagaagtgtatcactcacccaccagtccatctctgtgttcctggtggagcagctctcctctaagcagtgattaggggatgcagactcctttcatctttggcataggtttccaatgttcctgggcttttttgcatcaaactacttgaggggaaagagagtgaataattgcccaagggtaatttttatgggccaggttaacaaatagcatttacccatctgctcacatatttgccataactcagtcacatggccacatacaagtgcaagggaggatgggagccttactgcagcctggggagaaaagagaatgactggtgaccatttagcattttctgccaccaacaaaaaccatgttacagagtgagagacaatactgtaccagaatacctagttgaatggtgatatggtttgactctgtgtctccactgaaatctcatcttgaattgtaattgccataatccccatgtgtcaagggcaagaccaggtggaggtaactgaatcatggggtcagtttcccccatgcggttctcatgataatgagtgagtcttacaagatctgatggttttataagcatctggcatttcccctgctggcactcatttactccttcctgccaccctgtgaagaggtgccttccaccatgattttaagtttcctaaggcctcccaagcaatgctgaactgtaagtcaattaaccctctttcctttataaattacccagtctctggtatttcttcatagcagtgtgaaaacagactaatatgggtattagcaaatgactgaactaagaaaccagcaaaagcagatttaattacttagttactttttgttttagtcatggttctccagagaacagaaccagtaggatgtgtatacatataaaaagaggttcattataaggaattggctcacctaagtctggagactggcaagtccaaaatctgcagggtgagccagcaggctggagaccctgagagccaatggtccagcttgagtctgaaggtagcctgctatagaaccaggaagatccaacgttacaggtgaagtccaaagacagtcttccagagaattctctcttctcagagaaggccagatcttttgtctatttaaaccttcaagtgattggatgaggcccacgcacattatggaggacaagctgctctagtcaatgtccacaaattgaaatgtgagtctcatccaaaatacccttgcagcaacacctagaataatgtctgactgaatgtctggatacctcgtggcccagccatattgacaaatgaaattaaccgttacaattttaatctgcatgtttctaataggattacatgatagttaaagatcatggttaagagcagggctttggaagcagcagacctgagtttgaattcttgtcctgcctcctatttgagaagtgacttcacatctatctaagcttcagttttctcatctttaaaatggggataataataggctgttgtgaggatttaataggataatacatgtaactctctcagcacagggcccatctcatagtaggtgctggtaaaagaggttgttttattcatattgctggatatatctaacactattccctaagtgtagtacatatataaatacatgcttttggctggaaaaactaagtgagatgatcaaatcactctgatggaaaagccagcagtgtggatggaaaaggtgtgcctgttctttctctcaggaaatccacagggttgcgcacagggcctcaggttttcatttggacaccccagcagcccctcaatacaggctattcacaaaagccccaatacagtcaccctgacagtccagctgtgaaccctggctccccacacgtgagccatggtgtccctctagccttgttcattcattgtgtcagtaatctactgccatgataacgctgcataacaaattattccagaattcagtagcttgaaacaataagcattgattattgctcccaagtctatagtttggctggaaagttctattgatctggaccaggctaggcttgtcttggctgagctcacccttgtctccctggtcagctggcaggttgctgggggctgattggtttaggatgacctcactcacatgttgatggattactgttgactggggtgtcaggcattacaggttatgtgtctttcatcatccaataggctagcccgggcttactcacatggagcctagacagggtggcaagagaaagcagaaaagccacatggtctcctgaggcccaggctcatcacttctgccacattctttcagtcaaaataaatgacaagagaagtccagattcaaaagcccagggttgtgagaaggcttggtgttaggaacaatcgtaagaaacctctatttatggctgattgctaattagtgttgcctaatttagcaatgaaatgtttcttcccatatgttcctctggagagcccatggcattcctctcccccgcttaagggccaaaattaagatacagaagacttatttaatatctttactttgttcaagctggttcacatacacttgtcctccagcctttggtgaactgttttaggacagggacaggtttaacacaagggccgacctctgcagtgacactgggtttacatatctgggtacatgataggcgggtttcattcttgttccaaagagaattttgaggcatgaaatatgtagcctttatggaggcaggatttactttgactcatacagagaaagaaaatgtgtgtgtgtgtgtgtgtattttcaatccttgcatgtgatatttttaagggctggtgcgatagctttgcttgccccaagaggatgtcccagacagtgcactagttgatgctgcagaaatggaaaattcctagggatatgtagccaatgaaccccttcacccacatttcctgattgtttgccacaatttgaacagtgagtggaaagaccttgtgcattccgcaggccatactcgcactgtcccagcagacctgggaatgtgcccatttgattcagtagttgttccacccaccattaaaatggacttttctagccacactcagcagctcacagctgtaatcccagcaatgtgggaggcttagatgggaagatcgcttgagcccaggagtttgagaccagcctgggcaacatgggaaacccccttctctacaaaaaatacaaaaaattagccaggcgtggtgcacacacctgtggtcccagctactgaagaggctgaggcaagagaatcacctgagcccaggaagtcgaagctgcagtaagccaagattgcaccactgcattccagcctgggtgaccgaggagactctgtctcaaaaaaaaaaaaaaaaaaaaaaaaaaaaaaaagaataaataaatataaataaagtggacttttcatggttggatctggtagttccagatgatttgtaccattggaatcttttgcatcttgaatgctgtttgggtctgaaaacacagccttctcagtgattcagcttatacttgttttatttctctattgcggctttacaaaccaccccaaaatggggcgctttacagaaaactaaaagacaggtagataatggtttgctcagcactttaagtcttcacagaactttaacacaagggctgacctcttcagtgacacagggtttacttgtatatgatacgcagatttcatttttgttccaaagagaattttgagcccatgagagatctagccaaattcgtttcactgcatatctaatgtgtctttatatttttccaaagccacgggacccgatgtgcaggagaagtttctgctgccgccaacaacaatatctgtggagttggagtagcatacaactccaaggttgcaggtaagccatccctgccaaacagaggcccccactaggtatcacactgatctcaaggctgactgtggcccagcaaaaaatcccactggtgcagaaaagctaggatccacagatttggcacaagtgaaaaaaatttttttcttttaacctgcataacaatatcaatagttttaaatttttaatttaagcataatataaattcaaaaaagttaacaaatcataaataagctaatgacttttcccaaactggccatacccatacagtgatcaggaaacaaaatgtaaccagcaccccaaacatgtccccttccagttactactctgacacccaagaataatcatgatcttgttttttaacagcaaaaaaaaaatggttattgccagtttttgaaatttatataaatagaattgtcagtcactactcttctgtgtcagtgtcaataacattttaatgagtctcaaatatagactatagaatacaaggtggtgtgtataaattatttgtaaacatactcagagctcttcaaaatgttttgcacaatggaactcatctttaaaaagagaaattctgcctagaacctttttcttacatttcattgggtaggatatttaagaatttcctattgatggagcctttagaaataagagtggcaagtcactggaaatttagaacccaatatccctcccctctcagaaaaaaaaagagagagagacacagacagagacagagactgagagattcataagctttcaacgagatgtctgagaatggagtggcaccagtctttttccaagttttgcatcaaattgattcttaatttattcaggctgagtcacccaaccttgtttttcttttttcttttcttttttgtttacaactgtcctgatattttcttttcctggcaatttaatggaaccataaacctactttctgctgacactccatttccatggaactaaataaagcaaaggtaacctatacaaacccactattaacctcttttcaacactgtttgctaagaggcttgcctgaactgggtgctgaatgtcacaaaagaatacatctggaggtttctaaaatgtaaatagaggaggcttagcccctgggtttcagctctctttactttgtgcacatccaaaatgctggcattaaaatgtcaggagccattatgagctcaggggaaagaatatcactcggttaatattttataagccaggctcagacctgggatggaatctaagggaggcgggttctctactcacaggacagaactggaagcaactgaaaaattcaaacctgaatttcttgttcacacacccaaggtaactggtttttggaacaaagtaaaatgaccacctgcaaaagttaaaagagttagggggagctcacagctttctggaggttcctgggagcttctttttccatctccttcttttccttttttcctcttctcttattatttgcactctgaaaacacctgagcattgagtgctcatcaaatgtatctaattctcctgctgtcttagtttgctctgcctaaaagcaaaacctgagacaaggattccgggcaagcagttaatgtgggaggtggtccccggaagccagagtgagggagttggggaagaagacaggaaaggaatggaggccaacgaagtgagtctcatggacaacaggggccccgtcctgcaggtaattctctgaggaagtgtggagaacacccctcagaattgaccccgctaatgtgaggaggctgcggcattaatctgccagttcccatctttcattgttcgggggtgccgtcgggcctgtccagcctgcccagctcgcttgaactgagtggagctccttgagcagaggacacccccaggcaaaaagccagggagcaggccagaggacccggtgggtgcagcagcctctgcctcgcctgctgaatgcagcctgacacctcaaagacgcgactgggcttctgtgaagcccaatgacagctagggcatcacagcaacgttttgaggttccagaaaccaagaacagacatccaaagattttgagcaagggaggctcctttctttcttttcccactcccttagccccagcttggctcccctgtgaccacgtacgctggttctaactacaagggctgcgaggctccagtcccatgcctgtgccttagggaacccagtgtcctctggctccctggggcgtcagcatgaattcttgaggaagcactggggaattactcatggattacaaaaacagcagagtttatcttacaaatttaaggaaaacattttattcatcctggctggcaattccaaaagttggctggtttttaattatttgctaaaaatgagccaaaccctccagagaatctttccattcgggagctttctgggctaaggaggtctaaagcgccacctggtggccaactcggatcgttgctggtctcaaagtcgaggtgttcgttcgttacaggttaggggggcgcccctgtgatgtctgaggtccttccccagcacccctccacgctgtctccagaaaaagcccaaagttaaaatgtggttgaatcttaacccagggattcaaaaaagaagagtggagattgtaaattgagtcctctgaacagaagagagcattgagcatctctgcatctacctgagttcctcttctgttcataaatttttctcatttttccatcaaggctcctgtctttttcttgttgatttgtaggcattcttggtgtgtcccaaaggttagcccctaacccattttaatcaatgcaaagatcttctccttcatttctcttcgcgtccgtcttcatttcaaactccgtgacatgtagacccgcacatacgggatgtcccaaaagtcatcctgcagtcttcaagctttaataaccccaggaacattatttgaaagtttatttacatttccattttcactgatttaattgtataaattttgaagaaaaatattactttttttattttgaaaatgcctttattcaagtaactgtcttttttaaaaaggaccccattctttccttctttcttttttcattttaatttttaagtaaacaacatcttcaatcaaaaagattgagtcaaaaattaaaattaagtgtgttattcaaaatccacaaaaccaagcaaatgtaccacaaacaatgaccttccaaatgatggtttttgcaaatttgtcaaatgtatatttctgaaaatattaaagctcgagaccacatcaaggagtcgtaacactgtctcctgccttcaggccttttgtgtggtccatagttactgtgggcaccttcctgttgcaggggatggaagctggcggacaggtcccctgccccatatagctcacagtctaggaggagaaaaagacagggagcaaataaaaaaaaatcagataacaactcatgaaagaggacagagagtaaccagggctcagggacaagaggcgcctgagggtggggctctacagttcctcactgttctggatttctgcagagactctcagagcagccctaagagggggccaggccaggtgggtttggtcctattcaccttcctttttaaaccaaagcacacagatttacacaccgggcttcgggatgagatcacctttgattgaagattttgaaaaatatttaaaaaccacactgttgaccattgtgaaaatgccgtgaaatttctctaccagctatgaagtgctttcacatattattatcactattattattggccaatgaatctcataacactgcagataaacatattttatctgagcttttcaataaacaagtaaaaatcactgtaagtacaatgactaacatgagttttcagaacctaaaacctggatgagcatgaatttcctccttatcatccagagctaatattcatgagcacaaaaagtggcattgatgagcaccgaagtttgtgggcagatgtagtatttactggaggcagggacaggcacaccttgtgcaacaggagcagaggcagagagggtgcagctcaaatcccctggacatgcagcccccggggcaccagggctagccacagtgcatgctgcacaggcagacagagaaggctctaaatgaatggaagagacccacagagtcacctctactcattaatgtgctgtgcaggcctgcctggggtcagatagaaacacttgatgtgtgcctgtgtctgttcttgcccatcaaatacacatatcagcattgttagggatgtgaagacacagactcctagctcctttgatttctctctctctctctctctctctctctccccccacttccttccctcctcctcctcccccccttcctccctctctccctctctctcttcctcccctcctcctcccccccccttcctacttctctccctttcctctctctttccctctcctctccctctctctctaccttctctctcctacactctccctctctccctctcctctctccctgtcctctccctctctctctaccttctctctctctcctacactctccctctctccctctcctctctctctgtcctctccttctctctctaccttctctctctctcccactctctccttctcctctccctttctctctacctgttctccctctgcctctctctatcccattctctttgtctctctccctctatctacgctctctctctctctctctcccagtctgtctgcctctctccctctctctctccttctctccctctctctcactcggtctactctctgtctccaccccacattcccctgtagctcctagagcatccaggggcagaggagaggccttccctaaaaacccttgggtcacgctgagcctctgtcttggcttggtgcagttgcttgcaaaattaatactgtatctcattcaattaatgcatgcctcattcctcttgagcttaacaagattaaaagaatgtcgggtgcctggtccctgaatatgaatgagagacttgctctcagcctgtggccaccctataatgttaaaacagtcagaagattaatacacatccactctgaggttcttgcgcagcacagagggagcccatgaaggtgataagagctgcaaagaggaagagggttcaaggcacagctggaagtgccatgcaccagccctggcaaaatccagggctggcattcgttggtttgtggggcagcagaaacctgctttggccggggttgaatttctcaccttccagttgagtgggccattcagtcctggtcatcttggcactaggcaagttcaagagcatctgagcaagtgaacgccagcctctgtctatttcccacccacagagtgggcgtgactttgcacaagaagaagctgcactgaccagtttattctgtggttcattggtcacctgcattaaataaagtttttaaataaataaaaacataggtggaccaaaagcaaaatacagagtcttaaatttcctatctccttataaaatgaaccataaaatttaacatctggaaagttcaaaccaaagactaggcttattctagataatcttcctccaggagaaagaatgctaactgataactgggtgtttgttgtcaaaaatggtgattacacttatgggttaatagtagaagatggataagcagagcctgttattcattcttctggacctgttatttgtgttggggagaaaatcaactaaataaggtaataatgccagatatttattcaccaaatatttgtcaagcttaaaataaataccaagcatcatgttgatcctcaaggacatggaagtgaacaaaatagacacatgccctatactcaaagaccatgccatctggtggtatatgaaacacgcaaataagtagttgcgatagaaggttaaaggtacacaagaagagggctatgagcactgaagaggaaagtgagatcctcgagtctcctgaggactgaaagtagtagtccctcaggaaagaaagcaatttcatgtccatttcagctgcctggcaaggacctgggtggcttttaattcgattgacgtgctcgccatgttagagagtgaggcttgtgaaatagtgtccttcaggcacaacatcctttggccaccggggacaaggaaggagttttggggcccagattttgactgtgcatggcccaaccccttcattccataatcgcagtgggtggaaagactcaggtcagcttcactagcactctaagctccatgccacagaattgtgaacccactgacccatccagatgacaaagcctggagagaggcatgtgaccccgtcagcgaagttttgagggtagtgatggagagacagcacacccaacccaatggcggctactgagatccccctggagaggcctttgtggatggccaaacggggaccggaggcctaggagcaccagctctgcgggggcagcgccagcaccttcaccctgtgcccctgtgtcttaggattgtgtgtcccacactatcctggactgcaggactttgctccttcccaacattctgtgagaaatcactcccacgaggcatcagagaggaacacaaactttacagcgatgctatagggaagaaaggagaggcagccgtcagacacagaattactaatacagtttagaatagccatctctgcctttctgtcctctccgaagtccctctcagctacagtgcaaatgggagttcctctttcctgaccccacccgctcctgcactgcccctgcccctctctctgtcccctgccctctgccctctgcctgctggaatttctcctcaaatatcaaatattgattgcctcccccatctatcatatgtagtagctttatttctcccttaaaacttggctgcagccaacacccagttctctgaggccaagcttctacttagaaacgagcttatcaaagcatcgcttcagcaaaggtggtctctcccatcatgaattctagtaagttttgctaggggaataaaattgtctttaaatcattacatcagcaaagatgtgggtgggatgcagaaaggagccagtaggaccgtctgtgcctctttcttgatccctggactgcacagtggccccagagcacctgagatctccaaccattccaagtacccagggcccaagccctcctccacctccttgtctcctgcgaactggggaacccaaacatggtgtcctctgctcaacgtgtccacaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaaggtaagggggccggccccctaggccccggccactcacaagttgggacaaagtgggtggaggggtagatgcaactgggtgaaccactgtcaccctgtgtgtgagtccaggtcctgcaggaatcagacagcacaggggcttagccatgcaggaggctgactgcagggaggcctgtgatggataaggagagagggcagaaaagcctcagacgcgatgcctacctggctcctgcaaacgacagtgggaaggaaggggccgggggggggagggtctcagacagcagtccccacgccaaagctgcccatcacagacagaaaggggcctgcactggcacccccaccacccactcagtcgttggctggcagtagcacacaggattttgggtctcggcgcacacagggcggtagatccaggaggcagcagccaagactatgaccacaatgctcgtggggcagggggtctgagcatgcattctcacagctgctcctctgagattagcccaggcttggacagagctgaggagaaggaagctgggcagagcctccaaagggatgagatgcaggtcagtgctgcatagggaggggaagggggccccttctctgagacgctggggctggagccaccccagaggagacatgaccccaggctcagggaccagaggatttctgggctccagtctatcaggaagtgacttagcctcgcctgtaaaacggtgataatgaggggtcactatgatgtataaatgagataaagatgcaactgctcggcactgagaagtgcctgcaaagagtcagaatttgtcccagtctcgactgccgcttaagcaaccaccccaaaacttcatagcacagaacacaactcctttactacgcttgggatgctctgggtcaggaatttggaccgggcacactggggatggctcatccgtcctccatgattcctggggcctcagccgatagattcgttacttgagcatccattaccaaactgttgcgtcttcatgagctgttctgatgcatccatctacttgccacgcgtggcacagctcccacccctaggcttacgcagtcttctcaggcctgtcctggctgccaggccagcagttcccccccacccacaccgtgctcccagaggactctctgtaatcagcctggacgtgggactcacaccacaaggtcactgccgtgtgtggagtgagttgtctggtgttaagtgagggaaaggacagtgtgtgagattttgtgtgtggcttttggaactccattttgggaatgtttttaaatttgcttcttagattttggtaaatttcaaatagatgaaatggctatagaaaccagcactattataaatattttataaaatgcatctgctccacatacacatttaagttatgtacagtctgtttatggaaaatgcataaactcattacttatacattgataacactaaaataagtgaatgtacagaacgctatgtttaacgcaggcataaaaaagagaatattgaagaaaataagagtgggcaattgaaggctgcttttccatacatttcttgaggtcagaaaacatgtgttttcctgcccagaccatcctcaggaactggcccggggtttgagaacatagtggatgagctgttcagggggcaggtatggaattaatgcagacacgaaatggtacggttgagaggctgaaagtcacatcgaaatctatgactacaatggatgccattggtgcccaccaagatcccctttaccaggcctgggggccaccccagctgctgtgagtgttggctgctgatggctcacagtgggccctctcacgaagcattgccttgacgatggaatcttctctcccagaaagttatgccccccacacccagggcacagcccacagccgatgactaaggcaggagcctgtttgcctccaacagggaggagtcttcaatgcaatttatggtccagagccccctgtgggccaggccaagggaaagctttacccaagactacatagttttggagttccttcccctctgtatcttacttcacttccttgctcgcaggttgctcctgagagccctccctcaatgagtctggggcagccgaatctctgcctcaggctctgcttctagggaacacctcccacaaacactgcctcaaaatttaccccattaggtttccctttttcctttggctgccaggaagcttagaactaagtgtgtgcctattaccattggttttttagactaggttttcttctaccttttttttttcttttgagatagggtctcactgcatcacccaggctggagtgcagtggcacaatctcagctcactgcagcctcaacctcctgggctcaagtgattctcctgcctcagcctccagagtggctgggactacaggtgcatgataccatgcccagctaactttttgtagacatgtttcaccatgttgcccaggctagtttcaaactccgggactcaagagatcctcccaccttggcctcccgaggtgggattacaagcatgcaccactgcacccggcctcttccaccccatttttctccatctcttcaccactcacagcctccaaaatcatcccttagcttctgtccctgtgtccgtgtttgtattcctagtgagtctaagcctctgaatgctaggcaatgtaaaatttgtaaaagaattgatgaaatgagctcagtctgattagattatatttagccatgagaaatctaactttggatccttactaaattgttgcttgcttacacacattcctagtcttaccagactaaagcatctcactggacaaaaattggcaagttcacatgtaacttcctcagagtctcagccctaaacaatagtaaacaatatttcaaaccaagtggaacccttcagcgcagtgggtggccaactttggtacacaggctggatctaacccccagacttgctttgcaaagacagtttccttgggacacagccaggcccttccaggtctttgtgacattctgggcacctccaaccacagctgtcacgggtcccaggggaaggaagcacatagggcaccaaatgaaggggctcatctctcagaatcaggcttttctggatgctggtcaacgtctctgtcttcactagagagccgacactgcacagcagcaggtccgtcctgttgcagggatatttcagcaggtggagagctcttgacagtggagagacctgagttttaacctcagtcctgccccccattggctggggaacttcagactagtcgatgtctccattcctcactttttgcaaaatggtctgagtcagtgcttctcaaagtgtggccacagcccacctgggagagtgaaaaatgcaaaacctcagcgcctcctcccctcccacagatgccgcattttaacaagatcccattaaagtttgcaaggtgttgctctacgtgatcttgaggatccaaatcatctaaccctgagatcctaagaccctaacatatggtttcttaaaacctacaatgaatagaaaagggcagcaggggtgacacatttccagaaaggaacagccctgtatttcctcatcagacaatgggttggacgggtgggctgtgtgatgactgagccacacgccatttgtctctgtgttgaagaaacagaggcctaggtagcccaaataaattggtttctcgtaagaatgcaccaggagggccttggcatagtggctcacgcctgtaatcccaacactttggggggctaaggcgggtggatcacctgaggtcaggagttcaagaccagcctgatcaaaatggtgaaaccccgtctctactaaagatacaaaaaattagccaggtgtggtggtgggcacctgtaatctcagttactcaagaggctgaggcaggagaatcacttgaacccgggaggcagacgttgcagtgagctgagttcatgccattgcactccagtctgggcatcaggagtgaaactctatctcaaaaaaaaaaaaaaaaatgcaccaagagggatcagggcaatgagatagattcaggcaagacctcatagtgcctgggaccagacagacatcctgatccaaggtggctgcaggatgccagccccaagaatgtgtggaaagccacaggagggctctgcggtcacggggctaggccacactcaccctgtttgcttctccccggtttcgtggctccggctctccaactcacccttccccttccttgaggcttatgcttagaggtgtttccacttggacaccaccccattggcacccttgcttgttacaatctgtcagcctctgctccagctgccacctgcccttgatgctttcagggaaattttggctcaaaattaggggaaacaccccaagatgagcctccaaaaccaagaagtgtggttctgttgggaaggtttggaacttgcagggtcagaggccagtcagatggtttctaataaaacccctttctttctcctctgaggacatcaaagggtagttgtctatattcacagtcttcttaggcatctgatggagtaattttttctgagctgttgaattctttcaaaggtctgaacagaaatataagactgtatgcccctgtattaatctgttttcatgctgttggtaaagacatacctaaggctgggcaatttacaaaagaaagaggtttattggacttacagttccacatagctggggagacctcacaatcatggtggaaggtgaaaggcatgtcttacctggtggcagacaagagaagagagcttctgtagggaaactcccctttttaaaaccatgagatctcatgagatctcataagacttattcactatcaagagaacagcatggggaagactcgcccccatgattcagttacctcccactgggtccttcccacaacatgtggaaattcaagatgagatttgggtgggggcacagccaaacggcatcagcacctcttctgttgtgggttcaattgtgtccccaaatattcatatgttggggtcctaatccccaatacctcataatgtgaccttatttggaaatagggtcattgcagatataattaattaagatgatgtcatattggagtaggatgggcccctaatccaatatgattggtgtccttatttaaaagacaaaaaaaaaaaaaaagaacaggaacatctgggcacagataggcatacagggagaacagcatgtgaagatgaaggcagaggggctggggatgcatctacaagcccaggagagccagagatggccaacagcccaccgggagctgggaaaggaatgggatagattccttctccagaacttctaggaatggaattgaatctattatgtctccagaacttctagagatggattctattcctagaagttctggagacggaagtgtcagcagggttggctgacacttccgtctccaggatttctaggcaagaaatttctgttgtttaagccactcagtttgtggtcctttggttgttactttggtcctttggttgtggtccttctgtagcagccctggcaaactaatgcaccttccagtcttagaatggatcatcaaaaaggaggtttggcagtgcgggaatgacctgctcactgttcaaggtcaccttgatgtcacctggccctctgctttacagccaagatggtcaatagttgatccaattacgacttttttcttctagttcaggaccttgagaagtctccctccctcccttctctgatgtagcttcctcgaaggaatgagcgtgtgaaaatgctcacgatgcagtcctaggagagaaacatgtttccaagttagggagagtgctgtgctgaaatgctcccaataacgtcacactgggagcttgaaattcaacatggaaattgacgaacactaaaaataaagcccttttacgcccccttcagggagctggttgttaaacattgaatagcacacctctcgttagaggactcttctgacttcccttaaattatagcacttacatacctatgtgttctccctgcaagtaacagccacccttgccttcatgagtctggaagttccctttgcgaagtggaaaagctggaggaaaaacacctgaaaccccaaggttttgtttccccaaaatgacaagtttcccaaccagagtcctaagttaccccaagactgtggaggacaacttttctaagtcaaggaaagatctcacactttaaggaattcaccacttttacattaaatacaaggatcccaaaaacacaattatgagatgggaaacagagtcctcgaagtgaacatcatggtgacagcagctaaatgtccattgctacactgttcaggaaatagtgaagacgctttattacaaggttatgccagtctgctgttgaaattcaacccatctgaaacagcaacaggagcctgacatttgagtgacacaatgcggtttacagagaatgtctgccaacaggatcgggtggcaggaaagtgacgtccctaccctgtttcaatgcctggtctccttaagaagcatttaggatgaaatttttgatgcacagacagcctgtttccttattgcattattcattgtgtgactggagagaaattgttacacatccaagccccagaccaggtgacagcaggtgcccaggggaacagttggcagattccccctttcctcagcagacatggattttcactgagaggcactttttttgacacctgaggccaaaagagagtcgggaaggtaggagatgtgtgccctctgtccagactgacagtgcagatggtggcagcgctccacatccctgggtgcccctgtcattttccacggacttctgcacttctccactgcctctcgaagcaggatatttctctctcctccatctgtagcctccctggctgcaggtgaaaaggccctttcaagtgtgattgtcctgcaaagcatgccgagcccgctgaagcttaagagaaaaattgttatgactgatcttcagatgacagcaagtacatcttttagaaagtggagtgagtatgatgaaaaatacattatttcacatttgacttttccccaagaaatgggaataaatttccccaagcaatgggaataaatttccccaagcagtgggaataaatctttccttgtttcaaggtgacattttttggacaacattgtagcattttggaagtgagggttcattgtgcattagcgaaggttttctcctagtgacttccactgcctggtctactctaaggaaaaatccacttctgaaaggcaatcttcacacaaacaaaggagtcagagaattacctgttacacaaggcacttcttacgtttgtctttcaattttatcatcctgtacatatgttttgtttgaccaacatggtaatgattaaaaggaagagaacaaagaggagatggataagagacttttatcggggcatgcactgtttgccatagatcccaccattcccagttgtctgatggctgcttcacacaaacatcacctacctgactccttagggatttgaagtttgcacctcctacatttgcttagtaaatacttgagagaagcagtgaggagtgggcaagaaggaaatcctttttttcttttgcttagtagtctatgtgttgggtttacagttacagcatttttcacgttgtatatgggaagagggtgacagtcagaggcccctgaattaccagagggttcaataattgacttctgtcttagttttagatctcctagaagcagatcctgaggcaagatttgggatcaagtagtttattgggaaggtgaagagaataccagtgatgaatgggaggtgtggcaggaaagagacagggccagttaagggtatgttatcctgccagtcatcgctgtcagcaactggagcttaatgccactgggaaacttcagaaaaccacaccaaaacttgagaacacaccccaaaggtatcccaccctgtgggaaaggagctggaataaaacccattgatgaggtttgttcccaaaaccttgtaaatgccccagtgctttcagcctgaggacagatgcacagagcagcctttcagcctcttgggaggaagcccttagacaaaaagatgcatatgctgacatttggaaactcccaggcacagggaattctaaagcccaagggatatgggctcacacacaactcccaaagtgcagcttaagcaaaacctaacctgagacttcgagtcatcactctctggataaataaagcactggcaaggtgatgtgtttactgttcaggaaaaggatgtagcccttgcaaagagggagctacaaaaaccagccattatgggacacagcatcttattttgctctgacaaccagaaggggaattcgggtgacgctagaaggtcttgaaagtgacaactgattcatgaacgtctttccacaacttgaggaaatgcagccacccagggcaaccctggcacaccttttgctggctctgatgactacatcccaacttcttcttaatcactcttcagagttgctgctggagggaatattttaggaatatttaaagacaaggctacaaaaattctctaaggtacagatgagacagcgcattgattgtttactccctaaggggctgcaaagggcaaagcacagaactcaggtcttcttccagctggaatgtatggacagggaccacttacaagaaaaccaccatccaggaaagcaggggacagagagctgcctggggagacagtgattaatcaggcatgggcgaggggaggccacagtgcctcctgctgaaatttaatcagagccacgggtcgtacaccatggcggcgagtgccagggcctctggcagacgatgaatgcctcctgccaaggagctctcacgaatactctgtgagcccagatttatgctctgcagccagatgaaggtcgcaactgagcagaactgctgcagcgtggaatctgcagttcagccttggaaacagctggtgccgttaccgtccttcctttcatttctgggataaagagaactaagagaaaagtctggtgggtttcgggtgatccttgtgaccagccgtctcattttgccagggactttcctgtttttagcattgaaaagtcctacatctcaggaaacccctcaatcctgggcaaaccaagacagttggtcacccaccctttggcgctattagtagcgttggcccacctgggcccagtgagaaattcacccgaggttagaagttgacatgaatgtaaactcagcagcacctctgacatcagaaagattcatcactacaatggctggatcctttgagcagtgagacagaataacacaggattctgacctccaaggtggttacacgaaaaccagacaataactaaagacaaccacaggcgccatcaaacactgaatcgaggtgaggatttaaatcagaggccagggcaactgcatcatccttagcttggcttttccagagaacctgataccctactcccgctgaactaccacagaacccacagggactctgcagagtctggaactgaccagtgaaagttccaaactacaaaggataccatctatcatcactcccactcacaactcattgattaaaatggcttataagacctcacccaaccacaaagaggcctggtcatgggctcagaccgtggacagtttgcaatatttagcaagcagcagcaatgactaccacaatgtgtaccgaaacagttaggtagctcaagaggtaaccagttgacctagtgaggacaaatgtgcaaatgtcgaagatgtttgtgaatagtttgaataaaatttgccaaagatgttcatgaataatttgaataaaatttttcatgaactacgagtgcagaaaggcaatattcataaatcaatacattgtttcatgtgcaatttaaaatgtgtttattttaaaattcatattttaataacagattaaagtaatataatggaaaagtgtctgcaagtctaaatccaacacatcaaagaaaaaggaaaaactgagtaaatatatatgcacatagataatgaaaatctagctcagtttcttaatacaggaagagctcttacaaaccaataaaaggaataccatgaggtcaggcgaggtggctcacacctgtaatcccagcattttgggaggctgttgtgggcagatcccttgaggtcaggagtttgggaccagcctggccaacatggtgaaactccgtcatctctactaaaaaaaataaataaagaaaaataaaaattggctgggcacagtgctatgtgcctgtaatcccagctacttgggaggctgaggcaggagaatatcttgaagctgggaggcaaagactgcaataagtcgagatcacaccattgcactccagcctgggtgacagagctatactctgtctcaaaaaaaaaaaaaaatctatgaaagaaaaaaacataggcaaagcatattatcttttggggcttggggctttgctaaataataaagcaagaatacaaatgagcaggaaagacacaaaaagataaattcaactttagtgaaaaaatatataactcaaaacaataaggtactatttttacccaccaaattggcaaaactatttttaagaaatgacaattctaaattatgacgcatatgagctgaatatagagttctcatgcactgctggtaaacatataaactgttaacaaactttatcaagaacaataatatggcagatggactaagaatcgtcattcattttttttcacccagaatttcctcttttagaaacactgcctaagaaaataaacatacaaagacatatataagattatgttcattttaaacataaagcacttttttaaaaactagagacagcattccatgtacattcaagaagaggtgtaaataaattgcggaatggctatttcataaaactaataaaaaattatggtgtagaagagtatttaatcacataaaaaaagtcaattatataaattgtgagaaatacattttaagcaggccaagaaagttgatctatttttattatcccaatttcactttcaagcccgttcttatactttgcatttatatgtaaaattggcaagaatccacaaaatatcaccagtgattatctattcatgtaagattataaaggacttttatttccttcatcttctatattccaattattctataataaatattattttcatagtaaagaatacaataactttttccaaggtatgctaatgttgtattaagaaattaaggtgactggaaaataaaaattactataattgtttacaaaaagataagctctcccaggcttgcctcaccaggggtctgcaccctgcacccataccaaccccagaccagcacctgttctggtcattaaccctggtggctacccattggttagggtggagggactgactcactttagccacaagtttctcagagtgggatttccacctcctcaaatgtaggcaatgcgctggggacacagcaagccactgcaccagtctctagctggaatgtcaccttagctgacggtaagcaatttgtaacattctttttatattatgagcaaaataaaaaaattgcttgaatgtttcagaaattttgggcttgtgagaggctacttaaggccatgcccagcaagttccaactcactgctctcactgagcagggtttctcagcctgggcatatggacattctgggcaaaatactgttttgtcggtggtgaggaggttgtcctttgcatagaagtttagtagtctccctggcctttatggactagatgctagtaaaacacacatggttgtgatcaccaaaaatgtctccatcactgcatcctggagaaaaagtccacactagttgagaaccagggtggttaagtacactccatagtacctaggttaaaagtttccatttggtaaaaacttttgagaaacactgtaatcccactaaactccaaaagactggcagaattcaaagtggagttgcaccactcacttaatttcacctaaatgcacttgcctttttttttttttttttttcctttcacccaggctggagtgcagtggtgtgattatagctcactgcagactccagctcctcaaactcctgggctcctcccgagtagctaagactataggtgtgcctcaccacgccaagctaattttttcttttgtacagatgggggtgagtgggcctctcgctactttgcccaggctggtctcaaactcttggcctcaagtgctcctcctgcctcaaggctccacttcccagagcactgggattacaggcatgagccatcaggctggcctacttgcctcaggcagctgacagccattccactcactgagcatgagctgcaggattagggtggagaccccgccccccagcagacagccccacccacagtgctggctcttgggtcatggcctccctttgtccttcagctccagggccaccctctaatccatgggtgaattcccatttcccttttgggttttaggctttcctttaacacctattccctggataaaattccctctgttgacctgccaagtgtggcaatatttgcctggctgaatttcaattgatatattgtatatttattgggataatgttacatatatataaatatacatatatatatgtatgtatgtatatatatatatgtatatttgagactgagttttactcttgttgcccaggctggagtgcaatagcgcgatctcagctcaccgcaacctccgcctcctgggttcaagcaattctgactcagcctcccgagtagctgggactacaggcatgcaccaccacgctcagctaattttgtatttttaatagagacgaggtttctccatgttggtcaggctggtctcagactcccgacctcaggggatccacctgcctcagcctcccaaagtgctgggattacaggcgtgagccactgcacctggcacatttatatattaacatagggaaaattgacatctctgtgatcctgtctttctattcgagaatatggccaatatctttccatgggatcaaatcttcatcttcgtccctccttccatagagttcagagaggttcaaagccttatttagcacttccttagcttttttttttttaagtttgttgaatttcttcccttttttttttttttttttttttttttttttgtgacggagtctcactgtcgcctaggctggagtgcagtggcgcgatctcggctcactgcgggctccgccccctggggttcacgccattctcttgcctcagcctcccgagtagctgggactacaggcgcccgccacctcgcccggctaattttttgtatttttagtagagacggggtttcactgtgttagccaggatggtctcgatctcctgacctcgtgatccgcccacctcggcctcccaaagtgctgggattacaggcatgagacaccgcgcccggctcttcctaagtattttatcctttatgtggccagtgtaaatggggctgcctgtagggtggctgtgaagactgaataggataatatgtgaagtacttaacaagtccctggcatgtagtaagtgctatggaaatgcttgctgtgatagtcaacctttgttttctgcacttcttcctctaacgggttatggtttagatgtgagccatagttgttctgtctcgatttctgcctagctcctgttcaggtgaagctgagaggcagaaatggatcaagccttaagcagatgcccaagatcaaggcactggcaggttcagtgtcttgcaaaggctcactctctgcttctaagatggtgccttgttgctgtatctcatagaggggacaaacactgggtcttcccatggtggaagggccaaaaggggcctagctatttccctggagcccttttataagggcagtaatcccattcatgaggaccaaactctcatgacttaattacctcctaaaggtcccacctcttaagactatcatgttgtgtctcaggttctaatatatgaatttgggggggacatataagttcaaaccaaagtagggtggcatgccagcaacagccccatcccataaccagctctcagtcctcttatggaggtcccttccccactcatttctgcccccagaactagagaattttcctcactggcccatcttccccagaagccagagactttttggtgctaaaacccaatcaccagaagcaaggacacaattattattgcttcatgtgtcctatctagcttaagaaaacaaagtttaatattcctagaaaacgaagcattcttgtgggcaagtctcatggtttaaaacaaaattaacgtttgctgtttactgttcacggttcagaaacaggctgacaattgctctctgtgtaacagtgagctggctgcataacaaactgccccaaaactcagtagcttaaaataacaatcatttaattttgctcttgggtctacaggtcagctgcgttgttctgctgatctgcaccaggctaggctaatctcaggagagtgagttagagactgacggatcgaggatggcttccctcctgtgtctggcagctgtcagcaggggcagtgaatttgactggaatacttctctcttatcaatcaggaggctaacctaggcttatcttcatggtgcaacggagttctgggagagatcagagaacataggagttcttgggactgatgtttggaactgatacagaatcactttcccccacattctattggccaaagcaagacataaagccagcttggagtctaggggtaggaaatagaccactcttcttgatggatggggctgcaaaggcatagtgcacagggcataaatacagggaatcatgaataattagggtcacaatcaatctaccacactccccacacaaagaagagaatgtttagcatcgatttccttcattttagcaaacgttgcttcatctcactagcagtctacatatggactgattcaggagaaagttctgcagatggtcaacctcactcacccatttattgtgaaacacatcagttgtactttgctttttttttttttttttttttgagatggggtctcgttctgtcacccgggctggagtgcagtggcacaatctcggctcactgcacctcccgaatagctgggattacagacatgtatcaccacacccagttaatttttgtatttttagtagagacagggtttcaccatgttggccaggctggtctcgaactcccgaccccaggtgattcacccacctcagcctcccaaagtgctgggattacaggcatgaaccaccgcgcccggccacacttttgctatttcttgataccgagcccaaatctgagtctgtttgagagtgtgatcctccacaccaactgtagggatatctatttccctcgctgtcctggtttctgagagcagttccttgttttggttggagttttccagcatagatttaccaagatgctgagaatagttcccagctagtggttgaataaatatttgttcacttgtcgattcaatcaatcacaggctgattaattcccagtgctgttagaagtgattgaaaatgtcacatctgattgtcaggcggcagagagcacttggaggtaatccagtcatctctcttccttctggcttctccactcttaaaccactgattctgtgtcagtttcaagcgtaaggaccatggacacctggtgaccacacagggagagactttccctgacaatctcttctgtcttctccctctagagggtaaccaagccaccctgggccaggctgtggagtggctggaggttgcacctgccccttgcctccggcactgcatggctgcactcctatccaccctcccagcccacaggtgaacactaagcagccccaggccccattgccttggggtaagaaagtgggaagcaagaaactaatggtccaatcctgggttgtttaggtagagaggaaaatactcagaagacaaggaaaaggatttttaagaacctctaagaacatggtttgaggagaagagccatgctaactgtagggacttatgcaaagtttgccatttaaactaattagcatgtggcaataactactgtgcttactactgtgtgtttaaggttttattcactgtgtgttttacttgatcatattagactttcctcctacatttggagttcccttgctcaagtaaaatgtcatatattatgtgtttaaaaggattctagtatccaattgaataaaaaagaatatatacatatgcacacacacgtaagatttttatatatcatggagtaaatgtatgctttatatttataatgtctacatatcatatttaaatttatatattgatatatagctatttaaaataaaaggtatatatcttctataaatgttttgtatagcttatgtagctaagaaaaattatatgtccatatacttgcattttcactaaaaaatgtctgatacataaagagatgtaagaatgagataataattacctctagagagttgttttttattttcctttccatacagttagacttttcattgtgagcatgtaccacctttctagcttttttaaaaagcagtttatttgtaaattttaagacagttcttccaattttcttacctcattatccccagcttaaattgtaaattcagttgacttttttagattgaattcttcctggaaaaaaaaagtttcccacaatgccctgccagaaggatatggtgtccaacccagtttaaaaagtgcacccagtctttaggttcaactgctgaagaagcccaacccctgggctggagacctcccctgccccctcgcagcccaggctgtgggtagcggcagcgtctcccctgctctccccagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggtgagcacgtccccttctgtccttgtttccttagggccactgcacctctgtgtcagggtgggatgctgggacactggcttgctcccctcctgtcccctccctcagagcctgaactaaggctctgaagggaagaccccttttctctatgcccagtcctgctttctaacaaagcacagacctcccatctgcgagctagtagcatgatcggtgaggactcctttctggatcgttttccatagattttcttgtttattgtttctggcttacaagtaatgatgaagtctggtttaccaatcagttgccccattccatcacttacaagaataactaactcattgtaagaaccaaggcatcacactgtaaccctgtctgaaacaagaacccatctgtttatttatagcaatttaaaaaacaacattcacggatggacttttctggatccataaaccccgtaaaattgcacacacatctgttattttctcagggaaagagttgtgattttcatcatattttaaaatggagccatgatttttagaacaaaaagattaataatcacagatttattgtttgttgctcttttctgagcaaagaaaaaaaaatcttcctttcttggcaactaggtataatggtgaattttccaagcccctgggaaatacatcatctgtaaagcataataagcttttttggatcttttcctctctggagattttgctcacagatcagccttttcttacacctccaaaccaggatttagtaggtggttcagtagtcatgcatgaattatatcctgactggctgcacccatctccactgaggcttcttgagacaggaggacaggagctcaggacaaaatcattagtaccatccagtgtttcgatcccacgctcccacgtgggatcccaacttggcaagatggccatgcccctgcgtgagcgaggagaagccctttacctggaagggacgcagaccttaaaagcctgtccttcccacgagccctcctgcattcccccttggtcttggggaggatgaagaatgtgccagctcctcccaaacagaagggggctttgacccctcttatcctgtaagctgtatggacagaaagggagaagggcagagcagacagggacaggtgaggtgacacttcactctcacgcctgaaagctccactccctaccccaaagacctctcagtggtgtaaatttgtcctcgacccgtatttatgactctttctacttgggctggctaaaggccttgagtttcctgtgagtactataattttgctcaatagatgcccttaaacctccctggtaatttcttcctcaaaataataagctctcttgaggatcctacagacagaggaagaattcccgtcgtttatacatgattttaatgaacaccctggctctcacaaacattgaaaatgaggtttttcactttgtgaaagtcctttaaaaatctgtttaccagtctcccctctaaataagagttgtggaggtgatacccacatattgggttgtcttgactcaacacatctcagaatctctccgtggattttagatgtagagaaacatgttttaatagcctgcccttctagagagactttagctgagcatgttgattctttcctcttcgggaatgccttctttcccccaagaaggaaaaagaaatgctgatgaagtggcctttggcctttcaagggccagtcccaatgcaacaaaactagggtgggggtattgacatcactttccacttcataatgtttccttttaggtttcaggaaataaatctctctgtagtctctggaatagccacagatatgcttctttgaacaactcatttatcttgtggacactgtaactataactgactatatatccccttttacgtgggctactaggaagctcagataaaatctagggcaaaagagaggcatatggatgctaagtttatccttagtttcatcttaatcttcttgggaacaaagcataggttaaataaaaggagtaggctgggggcagtgactcatgcctgtaatcctttggaaggctgaggcaggtggatcacctgaggtcaggagtttgagaccagcttggtcaacatggcgaaaccctgtctctactaaaattacaaaaattagccgggcatggtggcacgtgcctgtaatcccagctaattcaggaggctgaggcaggagaatcgcttgaacctgggaggcggaggttgccatgagccaagatcatgccactgcactccagcctgggcaacagagtgaggctgtctcaataaataaatgaataaataaaaggagtagataatcccctgctccacattgtgcgggggttcaaaatagcgtgatttatccactcattactcattatcttcccttccaggcaaccacagatttgtacggcaactgcactctgaggcattctgggacatctgcagctgcccccgaggcagctggtgtgtttgcactggctctggaggctaagtatgttcatagctctgggtccagggccagctctgcagggtggactaacacgtgtctctctgcccacatgccaggtgtccatggagggaaaagttgatgtgagaggccatgaatagtcagggccaatgaactctgctgtgcatttctaagtggcccatgtgcccaccagcacacgtgcgtgtgcatacacacacacacgcacacaccataaaaccacattcctgggagcacacaacacccagcagcacgtattagcaacttactcagatacccagtgaaggcacagagatatttctttcttcatcaaatttacccctctatcctctgtgtatccctgggctcttctactccagtgatattcacaatcagctacttgaagacaaatcaaattgccaggctggtgtttcagaacatgtggcaaacaaagtggtcccactcaagatttgttaatttgtgaagtggattcactttttaacactgaaacaagataggcaaagtcacgcagtgtagaccaagatatgggctttcctgggagaccttccaagctgaaggtaagaggagaccatctcctatgtcctcaccatcctatggagaggccacatattgctactgctggacacaccttggatttgagtagcagtggaggtacctgcccacctgctactctactttcttttaatgatacctgaggctggccttatgttcacagaatgaacacatgggcttcagacaccacacacatagtgtgagtgtaagtgccggctgtgtagggaattgtcagagaatgcagttcccagcaacttgtgagaagttggattcagtctcttggggaaggagagtagagttgctaggcaaccagggctcccagcatcaatctctaggcagccctgcttgtctctctccacataggcagtgcattttctgatttgcaaaggaggcaggagttggttcctagaatagaaaggggcttcaacagattacctagttcaaccctctaccttcacaagaaaaggcataattatcctccctttacagataagaccccaaattgagagtgacttctctttttggacaagtctaaactttgactcttctaacaaaattcagatagaaaatttatgatgccaagacactggtcaaagctcaactattaggcacagagacctctgccctatcaagcacagaaaacaaaatttactcatatccaatgtacatttcctgaagataaaactgttcatctcagggtctgagtgggccctggagcctgagctggccttgctcactgcatccgcaaggagacaattagcacagcctgctgcctgtagctgagctgtgcagagccagggaacaggagtgctccaaaagcgagaagggtttccggttgccctttcaacctcagaagtcaggacttgactcacagtcttctggatttttgacaaacaaaatcctatgcctatgcctagatccataggcacacaaatggaagacctaaataaatcaaagtgggggagtgaggctgctggactcctagagattcatggctctgccttgattagtcaccattcttttagcacatacgtccagatatcctacagaaaagaatgcagtcaccattcaggcatgctttgttttgaagcaatgatcatgaacttaatattctctgctggcataaagaggaaaaaaatataacacctggcagcttgtgggtaagtccatcacgggagccggtcctaaaattcttcaaaataccaactttctgaggttggaagcagaccctgagatgagattttggtgcaagtgatttattaaggaagggatcccaggaaaggcagtaagggagtaggggaaacaagttagggatggggaagaatccaagcaaaggttcaacttcaaaagttctggcctcagtctaatcccgagtgtaaattaggcctcagagtttgttctacctccaggcaaggaagcaggactgtcatattcttatatgagtcagtcatcggctaagagctactctggagaagtaaactccaaggcatctctagctttaggcaaagcggctccaatagccaaaagtgaaaaccattggtcaggatgagatactccaaatgagagcccagagggatgaggaatagggcctccacagagcagtcccaaagctcatctctctcttatcttgagataaggttacaggaagtcctcatgcataacaacaaattatctaaatgtatgtccatcaggaccttgaaagagagagaacaacacttcccccatcatgactgtaggggagaaaaagaaaaccatctctctctcctaaccagttgtcactttgtagtttaatatcataatgtacttttctgcctaatgcttgaaaatgcctacttgagtcacaggaaatattgctcccatctcccagtatcaccaatatcagagaaatttcaaagaattttagtgggggatgactgccaccttcgaatatttaggtttctctcatatgacctggtgctttctctgtggtcctagagggtgagctaggctcgaggggtagatgtcataagaagatcagtttttgactcaagaaaatcatctggagtaaagtggtccacatgctggactggaacaacatttccaaaactgaccttccaggggatggatttttaatgtaaactctttagcgagtatagtatatagaaagaaattcattaggtgtggctccatgacattttaactaaatgaacagacccatgtagccagcacccaaatcaagaaacagacgatttatgtgccctgttgctcagcagtgcaagagattcctccatgttcctgtatgtagttataggtcgttcattctcattgttgaatatcattccattgtataaatggatatttggattgtttccatttggggctactatgagtgatattgttaggaacattcttgtacatgccttttggtgaacatacagatacatttctgttgagcgtctactagggagtcaaaatgttgggtcattaatatacatatgtgcaattctagtagatatcgtcaaatagtttcctgaagtgggtgtacccattgaccctaccttgagcagtatatgagaattacagttgccccacatccttgccaaaatgtggtattattagtcttctatattttagcattcttatggatgtgcagtggagtcatattatagttttaatttgcacttccctcatagctagtgaaattgagcacactgggtaaagttttttaaaaaatacattcccaagcctcacccaagcctcatagaatacaaatccctagggatgggtggcccaggaacctgacttttcaatgcctgttccccgggaatacttaagctgccagcctgtcgctgatctgtgaactagggtgtgaggatgatcaataaggcaatagctctgtgaatctatgactctgggtgcagagtgtgggtagctggcttctgcctctgattaggtgttggtattcagtcaagatttaatgtttctgcatgaaacaacgaatccaaataataacagagacaagggtttatttctctgtcatgtgaaagaaaatacagagataaggaacccagggctggtttagggtaccggggtaccattgtgaatcagggaatccagctctttctagctttctgctcctttgctctgccactttcatgttctctagacgtgctggaactccagccaccatgtttacatttcaggcaggaaaaggagaagcacaaagggcaaaaaaataaataaataaacaaataaaagagagagagagaaggagagagagaaagaaagagaaaaataaaaaaagaaagaaagaaaagaaagaaggaaaccagctgagtcagccatgttgaaggggttttccaaggagccccacccagtggcttctgcttatttctcattggctagaactgtcacatgaccaccgccacacttcaagggaggctgggaaatgtaattttatagctgaatgcattgctgttctgaataaaactgaagttttcttaataaggaaggagaaaagatagatatggagggaaatacaactgctaatgtcttctggcatctaagtggacaatcactcatctctggatctctattgtcttatcaacaaaaggtagcaagttagatcatcaataaggttccaatgacttcctggaatattttagctctgcttctgaaatattgtttttttagggaagttaatattttaattggatgtctggtgatttttaaggttgaatatgccttaaagctgaaaaacgttcatttacatacttttaaatattgaggtcaatacttaggaaatagtaatctaatttactttaacttctgatatatgtgatatatgttatcattaataataataaagtctttttattcagtgtccagcactgtgctaggtactttacatacataatttacatttacatcctgcaacaaacctataaggccttatgcccattttaaagatgtaaaggctagagctcgaattgttaaagtaacttatccgagttcacacagttggctttaagcattaggatgcctgttccactgggctctcggtggaacatagaaaaggccctgccactgtcttgcctgtggggctcaccactcatcctgccatggcaatgggttgcagtgaatgagttagctcttcctcaaacatgatgcacaaaatcaggtttcactttctttgagatgagattttccacaccacaactacaccagggagtcatgaaaactgaatttcctctcacgtccttataggacgtgagcaaacaaaggctatggagaaaataccagcttgactcacaaatgcattatttttctcagactggaaataatccaacctttgaaattattttttaatcctatcaaaatttagaggatagactcagaattttaaaaatgaaagaaaatgaatggatcttttacgactccaaacatctcttatgatgaagagaacgagacccagagaagtgaaacaacttgctccaggtcacacagtttacattgtcagataaagatcagatccaacaagtaaagggattaaaattctcctgttgacttctagaatttaccagatgttaggagaagtgattcctccaaccttaagactacagcatcatctttaaaacatttccattttcaatttctctaaagatgcatgtgctgactttaaattacttttgctgccttgatcattaggaggaaaatgttaattgggttcaggggaacttgatgctgtaaatagaagtactatgctctgaaagagaatggtgagggaacagccttgcacacgagaaaaacaatccattctgttagaagtcaggttcctacaaaggataaatgcttgaggtgatggataccccatttaccctgatgtgattatcatgcattgcatacctgtatccaaatatctcatgtaccccataaatacatacacctactgtgtacccacaaaaattaaaaattaaacattaaacaaaaagtcagtctgctggtcagccacttcctaagagatgcttgctgacccctggacccaagtttctcagatttcctgatgatcagaatcctggagtgcttgttaaaaacacagataccctaagcccactggagatccatagaatcagaatccccaggggagcccctggaaagctctatttttcaccagcgcccccacccccaccagtgccgtccaggaagttaggaagctctcccctgaacgaggtttgctgcatactgaaaatactaaatgtttggaggaatccatggaatcaaaacctctgaacctggacatcatttttttaaccatccccaggtgattccaatgtgcagacaaggttgagaaccactgtcccagactaccaatgttctcaaacatcactgtacagaagaatcatttggattaaatgcaaattctcaggcccacaatctccaagatgctgattcaggacaggtggaaattcacatatgtcactaatggtcctgacacagggggattgaggatcacagtgagaactcctgactaggataacacagaggctccactgatgcctccctcagcatcctgagctcccccatcatgacagccctcacattttcaatactgagttgtccctctgtccccctaggctatcagctggtggggacagggacatccgtctgacatgcccagagttagcacgatgcctgaatgtggtagacactcaacagacatccatacaatcacttcattgcgcagtaccttctcatatatctgcatcttattttcccgactcatataaaacatttgagaacagggaagaacatgtcacatttcttgtcctacagtctccaaaacagtgacctgtatatcgcagatactccataaatttattttttaattatttaataactatcacctgtaattcttgggctgctatggtacaattaaagcaggttgatgaaataaatacctactttacagaatattgtagtctgtcaattcctaaatcattcagaagggatactagaaggaacctggttttactcttcagacatatgcaaatagcaggtcaaacagtgtcatagactcagttacactggagagtgaactatgctgtggtttatctcaaaagtgaaaagttccttgttctgaaacattatttctctctctctcatgctctctctctttctaaaatgcaccccatgagaataaatctgcagagaaacatttaagggagcccttctccaggcatcagaagtacagcccattttcatggcaaagatgagaaatgagaaacctgctagccagccctctggtcatttagatcctcatttgtcaacacttctgagattaataaactcagaatccccttccagcaaaacactcagtttttagccataatcaacttaaggaacttttacaccattttacatcatttacaccattttacaccacttacatcattttacaccatatgtccaagacatgttctgaatctcctcaaataagcattgaccttccttggaacttgcttcttttctttttttctttttttttttaattatacttttaagttctagggtacatgtgcacaatgtgcaggtttgttacgtatgtatacatgtgccatgttggtttgctgcacccattaactcatcctttacatgaggtatttctcctaatgctatccctccccatccccccaccccccacacacacacatgacaggccccggtgtgatgttccccttcctgtgtccaagtgtggaacttgcttcttaatagaagaaggtctgcattcaagagcacatggatcatttgaactcttggttctgattcagatcttccaaccaatgaactttgcatatgttgaaattttatcaaatgagttatgttgctcctggtcctttgaattgtttgacttctgaagagaactgtagtgcaaggttttgccaactttttgaccagaatcctcggtgagtaataaattttgcactgcagctcagcacacacacacacagctaccctccaagtatttcatgaaaaaatagcttcctgtattatgtgcagtgcatactgcttttctattctgttccattcattttttaaaataataacaccaaccattaaatcactggttctcaacattggctgtctgttggaatggtctgagaagttttaacagtttccaatgcctgggtctcactcccagagattctgatttacttggtctgggatgaggccctaggcatgagatcttcaatgcccctaggagaaaattttcatgggcagtcccaacaacctgtgcgataacctggcccaaaaacaaatcatgatttgcaatttgaaaaacatagacaatgtgtagtaatagacactaatttccaaaaacaataacatttacaagaagactagtttattcactgaacaatgtgccaaggaccatcctggacactaaggatataaatatgctaaatataatttctctacccttgaagaactggtaccctccttttcaaaaatggaacacacccacatgccagttcccagatgaagggacagcaagaccagcactcagaagctccctgtatccccttccagtcactgccccacgagactgaccactaacatgacctccaacagcatagattagtcattcttgtttttatattttaaacagatggaatcatactttatggtctcttttctgcctggcttctttaggccaacatggtatttgtgagatttttccatgttgttcagagtacctggagttcattcattctcactgctgtatagtaccccacattctataagttacacctcaattagtttactccctatcttttggatggcatgtaggggtttcacagtttggggctaggagcattctagtacacaggtctggtgaatatgtacacatttggtcaggtatatgcctaggaaaagaatttccaggccatagcttaagcttaactttagaagatacagccaaacagttttccagtttagttggaattacttgcacgctcatccacaaagtacatgtgttccagttgctccacatcttcaacacttaacattgtcagtctttttcattttagccattccggtgtgtgtgttagaatagacttttgaaatcaatttatgtaagtaagaaaagcaagaagatttctttaattgacttatatagtggttttgaatggtgcatggacaccctcccttgaatttgagagttcacagagattccaaaatcttacaagaggtctgtgtcctgagtaatatttctcttaatcattgtgcctctctccctctctcaccctgccttttgcccttgccctcttgctctctgcttcctgtatccagcctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagtaagtgggggtagtggtccctctgctgcatgtggaaagtgcccctgagatggctccatggcattggcataatatcacattccctcttcatgtttgggtcaactgtattttttgtttgtttgtttgtttttttgagacagggcctcactttgtcacccaggctggagtgcagtggcgtgatcacagctcactgcagccttgaacttctggtctcaataatcctcctgcctcagacttccaagtagctagggccacaggcatgcgccaccacaccctgctaattttttttattttttgtagagacaaagcctcactatgttgtccaagctggtctcaaactcctgggttcaagtgatccttctgccctggcctcccaaagtactgggattacaggtgtgagccacaatcctcggcctggatttgactcagggacaaccagtttccaagcagagctgcaggtttgcataaatccaggaggcaccatttacatagaacacagaacccctgcttttggttgtgagccttaactgtttcagtgatgtatgccattatttctaagggcacaaatcaaccactataaacatcacccagctcaataaggagaacatgactaacacccccaaaggccccctgccgtgaccactgccattaacatccccatgccagcgtagccatattcttacttctaactccatagcttaacttgcctgttccatacttactagaatcatacactatgtcctgttttacaactagattatttcgcttggagttatgtttgtgagatccagtcatgtttaatgtgtacttacagcttttctcattgctgaagagtgttccagtgtatgactataacacaattcgtttattcattctacctgtgggacaatctaaggacttgattttccgctgagtgaggtggattttgccacttggagggatttgtgtatggggttccctacacagaaaccacagcgttagtcaactgcacccacttcccttccaactgccccaccttggcaagtggattggtcagtaaggatacttcttaatttctctctgtcctccttgatgcattagtaaaatggagatagtaatttttattattatcactgaggtattatttacatgtcatcaaatacacagaacttaagtgtatcatttgagtgttgataaatgtatacaccctggtaactaccactgaatcaagagatgaggcattccatcaacccaggaagattcgtcatacctgcttccagctcgtccacacgctccacaggcaccctttgtttttgcttctctctctgtagattcgtttcaccagttttcagactggactgtgtccagtttctttttctcagcatgaggcttgtgagattcgtccaggtcaccatgtgtagtcgtagctcattcattctcattctaccttgagaatacacctccgtggcttacatcatttaaatggtggtaaaattcattccctgccagggtcatatttccgaggaccatcgagcctggccagagtccaacccctctcagactttatcctcctcgccactcttcattggtcctagacttgctgcatctcttctactcagttacccagacctgaattccaatcttgacttcaccaacttagacaatacttttgacatttctgaccctctgctttagcaattctcaacctttgtgccctgtctccctttgacagcatggtgacgtctatgggccccatcagtctaatgttctccaaattcattagataaaatgcactggattgcaaaggaaaccaattatgttgaaaccaattagaaaataaattcatgctgaaatatatgtccccttgtcagcacattaagtaaaaagctctagtggcaagtctaatggccacaataatttcagagcagcagtgatgactaattgctgctgcaggatccatgcagtggctgtggtgggacacgaaaatctgccagctctttgatgacaaagtccgaggaggagctaatgccactctgctttgtggcctgcattcataatcgaaagagaagaaaagtttctgttataatctagtgaaaattaaaatgtggaattttttccattgaaattattagaccccctgaattctatccaaatgggccccaaaataagagatttttttctctttcctcaccagtaaaacggagctaatgtttttcctccgcaggctgctgggagactttagcaacacacaagtctacagcaggcacacagtaggcacttaataaatgtaacattgcctctccttctcattcatgactagatgtgaacacttctagcttacacctgtagaatcaaaagacagtaatctcctagagtttttggtgaaataattgtctgatttttatgcaaattccaaatcagatatcctctcagcctaaaatatcctccaatggacaagcatgtgccctgggattcccatcctcccatgggccagcagcctgccatagatgggctgcctaccataggtaagcatcctcccacgggccagtgtcctcccgtagatgggcagcccaccataggtcagcatcctcccacaggccagcatcctgccatatacgggcagcccaccataggtcagcatcctcccatgggccagcatcctgccgtagacgagcagccaaccataggtcagcatcctcccacaggccagcgtcctgccgtagacgggcagcccaccataggccagcatcattccacaggccagcatcctgccgtagacaggcagcctaccataggtcagcatcctccacgggccagcgtcctgttgtagacaggcagcctaccataggccagcatcctccacgggccagcgtcctgttgtagacaggcagcctaccataggtcagcatcctcccacgggccagcgtcctgctgtagacaggcagcctaccataggtcagcatcctcccacgggccagcgtcctgctgtaggcgggcagcctaccataggtcagcatcctcccacaggccagcgtcctgctgtagacgggcagcctaccataggtcagctcctccacgggccagtgtcctcccgtagaagggtagcccactataggtgagcatcctcccatgggccagtgtcctcctgtagacgggcagcccaccataggtcagcaccctccatgggccagtgtcctgctgtagacaggcagcccaccataggtcagcatcctcccacagaccagcatcctgctatagacgggcagcccaccataggtcagcatcctcccaagggccagcatcctcccatggacaagcatcttcccatgagtgagcatcctcattgtttactcactgaacccctagaaagtggcaccaagtggattactgccaagctgagtattttttttccatgaaacagtccatgatttaagaaggcctcactctaatcagcaccacatggaaaaaataaagcttcagcccaagccctataataatctaaaaacacagagctgcccaagtcccaagtgatgttacaaatgtcctataataaaaatagctactctgcacagttcctcaccattttccaaagcttctgtgtccacacatcatttctgttcactcccgtatccctcctcttggcaggacagacttctctgagctctaaacaagttgattgacacagtcaagcccacagaggctgtaaatgtgagactggaagtcacttttattgagtgccaactgcatgctatgtgctttcatacacgtaagcttcacagccaccctattgttgagggtgtgccttatactcgcacagtcgaggtgggagcaggggtgaatattttgcagccttaacaacaaactggtcccatgctgggtgtcagggagaaacaccaactaggtgtggtatatgctaggcccatttacattactgtatttaatccttgtaagcccaggaggtgtgtcctatcattattactttttatacacaaggaagctgagatccagaaaggataaaaaaaaaaaaatgtgctcagagtcacaaagggcagagcaggacttgaagcaaagcccatctaaacccaaaccccaggctcttttcactacatgaccttgaccttaatcagctcccgtgcatacaggtcctacattaggccgtatgtgagagcagccctactgtgagctcacagtgccattactgatgacaggaggttgggaaaggtcaagggcatgctaaatgtcatccagctactaagcagccaaactgggatctgagcccagtcactttgacccctcacggtgggctctcaggtatctcagtgactccccctggagaaggtgaggcttgggtaggggagggagtttcagtaaacattcccctggggattctgaaacacccacctagtgggtgctcccatctcccaaaccccatcactggcattccagaggcccttttcactggtctacaatgccaaggtctgccgtgtcttttgggaatgaacaaagagacaagactgggaaccactgtccaaatgggggatttaaggctaaaccctactcatcataactaactttacccaaagtcaacatgaaatgggcgttgacaactgtttcccttgttagagttcagaataatttcttgagaaatttggaagtgcagtgactttctgcagtggtgaaaatgttctgcactgtccaatacaatagcttgtggctattgagtgctagaaagtggatgaccgtgattaagaaacaagagttttcattttatttcattctcattaatttaaatttaaatagcaacatgtggctggtggctaccatcttggacagccatgtctaaggcacatctggtagttacatcttagcaggagggatgctgaattgtgcaaaccgaatgggaagtggagatttaataacataaactctatgaaggggtgtcaagaagatgagactgcaagaaaggcttgctggtccattttatagcctcatgccttcccccagcacgacatccaattgcagcatcctagaagcctaaaggcagccttgggagggtgctagtaagaactgctgctaagaacttctctcggaaagtcactgggatagcactttattccactatctcatttaatcacaggaggttggcatccctagtcttaatttaggtgagaaaacaggatcagacaaataaagcaaacggccttaactccaatgtccttatccattccacaaggccctggggcctggtacctcattcccttattgcaaaaggagaaagacttacgatgtctgtgcctttacagacactctgcaagcagggagtgggggctggaatgtccctcacaggcagtgcaactggcacgatatctacacttacttgcatataagcaatatttacaattaacaaaaaggcagcaccgttgcagtatttaggggaagagttagcttggaatgtactgcggccctcttagtcaagctacgtgtcaataccaggctatattttctgagattgcactggacaagccagacggacttctaatgatcgtcaagcaccatatgattatgagagagggcaggaggggagcaccgcgggagagaaggagagagagggaatgagggcgtatgctgagatgaacggcagtttatctcccagtttctgaatatgcttagcattccatcataatctgcatacatgtggaatttaaggccagagagaacactggaaataatgttatccaagtccctgtaaggaatctgaggtccggagatgtgatcatcccaacatctcacaactatccaggaactttatgcaagatcaatgcagtgttttcaatgaagagaaatgggaaagcactatatttcagcactaactcagttggggcctcccaatggactgggccctcgtctgtcatattcatggtgtaaccctagtgcctacaatagtgctgggcatatagtagacaggtgataaatattttttaaatgaatgagggaatgaaaatattcagccagcagcagccggacacaagggaaatgtctgactgctggcaataggaccggcgggccagcaaggcaaatgtgggaaggaggctctgccttggttggaagggctctgcctcctctcagtgccctccggtccctcgtccacccccacaccagaacttgttctcagatgcagatgagttaggtctagggcaaatacacttgttgaagaatgcagaggctccacagggagatttggagagcagccccagggctggctgtgccgcttgacagaggaggcccttgtgaccacgaagcacactcgaggagcggtggggtacaggaatcaacagccgtggcaatcgccactctccataatgtgcagggctgcacagaaacagcttccaaggtggagtgagtggtgattgtcaggtttgtgggtttccttggcattaatcttcccggagatggagtcaatttgaaaagcaattttctaaagaggctttatcaagagagtcagtgaaggatgctcagctacaatcaaaggggaaaatacacctggctgtgaccagctgcaccagctgtgtgtagaatgagcagagccagcccaggccggccccatcagccagctgggagtgacctgtctaacacagctgcccccagcccctctgggcaccctgaggggactgttcactgagctcctttaaggctgtgccaaaatatgtgatccagctctgaagtttaagtgaatttggaaataaatgttaaaacctggtatcaatgccggaagcagcatgggagtgagaggtcagcgtgtgctcggccctgtgccacctgggggactgtggaccagcactcccgagctgcagaggcttcctgcacaagttcatgcccacctgactctgctacagggggaggagaaaacctcaccatggccacctgctgcgtgtcgtcatgtgactgccacaaaagcaggcatcttgggcacttgagaaagagtggctgtcattgttactattgtgattattctatcaaaacaatcacagccttataactttttctttttttttgagacagagtcttgctctgtggcccaggctggagtgcagtggcacgatcttggctcactacaacctccactgcccaggttcaagcaattctcctgcctcagcctcctgagtagctgggactacaggcatccaccaccaaacccggctaatttttgtatttttagtagagctggggtttcaccatgttggccaggctggtgtcgagctcctgacctcaggtgatccgcctgccttggcctcccaaagtgttgggattacaggcatgagccaccacagcttcataactttatcttacagttgaagattcataacacaagaagcattccccagggcctcctgggaagcaacacctatttcttgacacaaggcagtttaaacacttacttgcaatgatacacaataaaataaagatacaagccaccccgacaaccccaagtttgtcttttataagactggaacactacgattttgcatgttatctctaataggtcaaagaagaactcttttttttttttttttttttttttgagatcgagtctcactgtgtcacccaggctggagtgcagtagcgtgatctcagctcactgcaacctccgcctcccgcgttcaagcgattctcctgcctcagcctcctgagtagctgcgattacaggtacacaccaccatgcctgactaatttttgtgtttttagtagagacggggtttctccatgttggtcaggctggtcttgaactcctgacctcgtgttccgacccctcggcctcgcaaagtgctgggattacaggcgtgagcctccgcgcctgacctaagaactcttaaacctccagaaagcatgcttcattttctgcagcaaatgagctccagatcatggcctggaaactaacaccctgtgactatttaaaatgtttctgcagagcctctttttgttccaccaccaacctcctcctatttaaccttcttataaattgataattcctgagcatatatctcctttttgctttaaaataagaatgtttcattccttttcttctcataaaagcaatacatggtcactgtaagaaaatcagaaaatgcaagtgagcaaatgaagagagaaacaagaaacatctggaaaatactgttcctaggctctcccaatgccacgatgccagccaaaaaaacctgacctgtgaggggagaatggtgttctttctctaccaagttcgctgcctctggaattcacagcatgcttttaatttaatttcatagtaacttaatattctcagaagagtccagccacatgtctcctctctcagcagacccagctcctgtgcaggaagcagttcacatggcagggcaggatcggggcgtttttctagctggcagtctctccgtggtgctaaaaaagccagactcctcagccaacgtgaaaagagttgttctagtgctgggatgatctcttatgatggaaggagagaaatacagattggaccaaacctgagatgaccttcaggcacaccatggctaagggggtttcagtagatggtgacagtgcctcttgttcaggtccccttcactgggctatgcaccaccccagctactgtgggcattggctgctaactgtggtcttctgcctgtgtctctgaagaatcaccctcaggggctatggaaacctggctgaaataagaatacataaaacccatgctcctgcctccaagcaggacaactgtgtggtggcgttgatgctccaaagccagcatggcctgtgacccccaggcacaccccagtgtccaaggcttctaggaaaatgtgtgattcttaacacaagtttgtgtgtttgtccctactcccacctgtctttcggctttccaaggtgcatggaatatgtctttcagtctccctccatctctcccttgcaccctctatcacaaatgcacaccactcactctcaaataagacctttagcctgggcaatcggtggcctgtgttctagtttccccttctcagcctcgctgtcattttccctcccttagtcttagtcgctaaggccttccccatgagcgtggggctcctgggagaaacagatacgacagccaccatagaagattcacacagacaggaacacaccggcccttgttgttctgccagtgaggctccttcttgggactcaaattccaggctcctctgccatgcccttaatgtcaaagtggtcgccggcctacatctatctttacaataacttcttaagggctttttaaagaaagcaaaagaagtgaggtgactgagcccacagatggaatgaggcccatattctgtatcaccaacgatgacataaatatagtcaatagtcctcagacactgtgcagagggatgtggtaatcagtttccaattgctcttctccagagacagataacacctgttttaggttgggttgctcggaagcagagcctgagattgggtttgagtacatgtgctttattgagggagggcttttcagggagaactgtaggagagtgagggatttgggaggggcagaagtagccaagaaaggatgtggaaccaggtatgtgcatgtggcctgacccaccgggggctttggagcatcaacgccaccacacagttgtcccgcttgggggcaggagcattggttttatgtattcttatttcagccaggtttccatagctcctgagggtgattcttcagagacacaagcagaagaccacagttagcagccaatgtccacagtagctggggtggtgcacagcccagggaaggggatctgaatgaggcactatcactatctaccaaaacacccttagctgtggtatgcctgaaggtcatctcaggtttagtctaatccatatttctctccttccatcataagaagtcatctcagcactagaacaactcttttcacgtagcgaaggaccttatagttaattcacagaaacttcatgtatggtgggctgtggtcttatttctagcaaaagtggctgtctcatctctgattcttagccaattgaagaaatattttcagttttccacaaggcaagcaatgccatttttctgccagagtttctacaaattgacttgtaaagggtctgtcactatgactccagtccacaagggtcctgggtgcaaattgggacagaaaacaaattttcttagaattcagctggtgttctgaattcttaagataatagtgaccactgcacttgacaaatgattagtgatgttttataatatctataatgattgccactcagttacagtctttggttgttggcttgtgaatttccttcttgaaacttttcaagaagccctagactacaggaaagaaaagagagctcaaattcaacacagaactcagagccagggtctctcttcctgttatcattctctgcttcctgcaactgtgcttctcaaagactcccaaagcccctctggctcaactctagaaggaaagcccgattctgggcctggctgcttgtctgcctagaaaccctgtgatagaatgtgtcatttccctcataccttgaggttctggatgaatatttcagagtcctccagagaggtggccagaaaacctgcaaaacaaagctgcagtttccccaactgcttttcctagagcctgtgagccgggaaaaaactgaatgcccttgaaacagaaggccaagagactctctgcctgttgttgttgttcttatcagattcaaattcaacatacataaacaatttagacccgcactgtccagtacagacgcaaccagccacaagtggttatataataacatattagattagttaaaattgaataaaataaattgaacattcatttcagcactcacatgatctatgtttcaattgctcattagccacatgtagccagtggctaccatactagagattatatatatagaatatttccatcatcgtagagtgtcctattggccaatgctggtctagacatttgtaaatatactatgtatatgagtatacatgtatatacacatatagacacgttatatatatgtgcatatataatgtatatgtaggataatttatcttgccagcaactgttcagggcaggaattaatagctcagatcatgcaaatacttgcccacaactggactcgtactctgagactctttgtgctaccctacacagctgtccactgctgggctagagcccaatctttagttattcatcaccttacctgttttgtttctgatcttgttctgaataaatagcaccatctttgagaaatccaggttatggccctcattaccccgacccgcaaagttggcttaatgcctgctttccaccaaatggatggtttccccagatcctgggaacagaaagaccaaccccaccatcactggatccccatagctgatggacactccatacatgattcagcatcagtatccgggggtgggagaggggaatacagcagtactccatgaaaccgtttaagtctatatttgtaaagttcctccagagagtattaatgaactgcactgtatgtttcagcaagccctcccaggttcatggccttggttcctagggcaatgcagaaccaaggcttgactccaactgggcacatgaccactgtctttttgtaaatgtgctttacaagatgtgtgtttaaaaatattttacttatactccaaaataaaagccatattgaggaaggatatttgcataggcaatgggccagtacatgtgccaagcattgtgcctggtattttattttattttattttatttatttatttatttatttttcagcacaggaagataatatttattatattttaactagaaacagaacagatagcaagttcacgaggtatgaatatttttttcttaaatcaggcttaaacaacaataataaaaaacaagtctgcatatatatgttggtcactattataatcttcaagggcacaaaagccagcagcataaagaaacatgaataatgactgagaagttttgatgtgccaaaaacaaagatcactgcgttgaactcctttattttgttaatattattattaaacatttaacaggtattaattattgttatttggcaaaatatccaacatgcacatggtattcctacaagaatcttgccttaatattgttaatattaacactaagtttattcctctccaaaattcaatgagttatgattccactctctgtaagtgttagtgttagtggtaatatgcaaaactgattttgtgtgcagggttaagtagcagattgacttcgcatttggtggccagctgtgtaccctaatttttatctattttcttaataaatttaattacatttcataagccctgagataacctgctaatgattgtatacttttaatctatactttattccactcaatttgaaccccacataataagtcttcaaaattatttacagatggttgtaattaaagcaatgacaaaatttactacttgtatagataagactgataataaggcctttaactaagagttgcatattttacatgcacttttaacttgctaggagcaactcttaaaattacatctatcattctgtcagaaagcagttaagtgcttttcattttgcttacttctatatgtgtaaccagactcacttttttcctcccgtgtaaaacaactgttttttttccttccccaaatattaatacttgtcttccaactgaacaattgctaaaaggaacttagcatttacacagcacattgataactatagtgctcagcagagacatatgcccataataggcatctgataaatgtttgttccacatggaatgaattgtaaggcagctgtttgagtcatatactgttcatcatatactgcaactaattttgtttaactaggaaattcagtttaccagatttaattcaccctcaagtataaatccaaaaactttaaattaaaaaaaatcgatttactaatcctcagaaaaagtaaacaagttaatcatagttgttactatgctattagttgatagaaaatttttaaaaattactttccactaaatattgtgtacaactaagtgaggggaagaaagttttaaaaaatgaaaagatattagctaattctcatcattttctccacatttatccttgcagcttatttgttcatatatttattcctgttaacttctctagctgaaagagaattttattatctgaatggagttccccatcaccttacgtacaaaatattagtgaaaagctagtgtaaatgtaagattgtattttcatgtcatgccatatttctgcatttattttttgctagcattaaatttttcgtatttaaatgatgctgtatagaatatgagataatctgccaattgctatgatattgcttgcttacaatattcagtttttgttgatagctttaaagtatattgcacacttgtcatctagcacactaataaataactatttttgaaaggatacactgacaaattcttaagttaatggctttaacccaacatttttagtcagttaaagaacagcaatggcaaaaacattgacaatacagttcatggtccagttctcccatcttacggtacaggttccatcagatgtggtatcccaaaaacaggagctgctgtgcgaaagccatatgcgctcttctggaccactgcacatttcacaatacatttataagcttttcccagcttaggcagatgtgttaacgataattccactatgcttgcggtccactggttgatgttgttgtaattataatcttcaccacctaaaaccccgtctgcacattctttgacaatattgtgggcttcctcagcattgaggccaacctcgtcgcagtggcgatggtactcctccatggtagcgcctgttctccctgggggcggagctacgcctgtgcctggtatttcatacatggtcttatttaaccacacaagaatcatacggccgggcgcggtggctcacgcctgtaatctcagcactttgggaggccgaggcaggcggatcacaaggtcaggagatcgagaccatcatggctaacacggtgaaactccgtctttactaaaaatataaataattacccgggcacagtggagggcgcctgtagtcccagctactcgagaggctgaggcaggaatggcgtgaacccgggaggcggagcttgcagtgagccgagatggcgccactgcactccagcctgggcgacagagcaagactccgtctcaaaaaaaaaaaaaaaaaaaaaaaaagaactatccacaatgacagtgaaacttcgagtgcttaaataacctgcccaagctctcatgagcagtaaacatagaagcagaattctaatccaaatgggtttattctcaaagtctggagtcttgatgttacaccacgcaatcctcaaatgcggtttccttttttccttctttctactgcaagaacctttgagcttctcccactccaagaaggccatctccagaaaggagattgcctgtaaggacagcctagagagtacttgggcttaacctcgctccaactctcgccaaagactcccccaaagtctcctgatcattcattggactgcctttcactggaattaatttacccattttcagcttttctttttttttttttttttttttttgaggcagagtctcgctctgtcacccaggctggagtgcagtggcgcgatctcggctcactgcaagctccgcctcccgggttcaagccattttcccgcctcagcctcccaagtagctgggactacaggcgcccaccaccaagcccggctaatttttcgtatttttagtagagacagggtttcgccatgttagccatgatggtctcgatctcctgacctcatgatccgcccgcctcggcctcccaaagtgctgggattacaggcgtgagccactgcgcccggcccagcttttcttaatggtagtaatggcagtcatattagcaacagcttctatttatcaaagcacttagcactttgaaagaaagacattatgagttcctgcctcagtctgggttgtcccagaagtccaacctgagacaagacttgggtgctgacagttttttgagaaatgatcccaggtaacacaagtgaggaattggagatgtaaaataaggaaggggagaaaagccaatgaagagtgcattaatgagcgagttgccaccgtgggcagctgagctcagtcccactagggacactgagttgtcacgctgaggaatagagaaaccggggtaaaaacctgtcagtcactgggagagagctacccctcaaaggttaaatccctgccacctttgggccgccctgcacgcaggctgtgcaggcttccacggaggtgggaggaagcccagggggaacacggggagattctcgtgcctggggtgggaagcagtggacgtgcaagggagcttcagctgcaggtgaactcagaagggacttaggagactcaggagggacatcacagcatctactacattctccttccacacagaaggttccaagcgtaagtaacttgctcacagccgggcgtggtggctcacacctgtaatcccagcactttgggaggccaaggcagctggatcacttgaggccaggagttcaagaccagcctggccaacatggtgaaactccgtctctactaaaaatacaaaaaattagccaggcgtggtggcacatgcctgtaaccctggctactggggaggctgaggcatgagaatcacttgaacccaggagctgaaggttgcagtgagctgagatcacaccactgcactccagcccgggcaacagagtgggaccctgtctcaaaagacaaaaaaaaaaaaaaaaaaaaaaaaaagagataagtaacttactcaggctcacacagccagtgtgggaactaaacccaggtctgattgatcaaccccaaagcccttgccctttccgccacctgaagctgccctcaaaatcccttgtaaggtgcacccaccactgcttatcctatctcctcttcactctgccctcaggaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatccatgtcctatgtgtgactctaaattctttatttctgtcattcaaatgggtgatatcctgaaaaaaaaaaaaaaaaaaaaactgggacagctttcccctcatttttttttttgtttctgagaaaagaacgtattttaaaagccacatagagtgactccaagaacaattgtccatggtctcaaacaaggggctgttacataacaagaaaatcaaagctgaggacagggtgtgagcgccacatctctgaaagcacaggagacactgtgctataaatcctttggggagcgatgttttgaatttagtgagatttaccagggatgtagattaaggtgatgtgattcaaaagatgccattcatagagagccctagttactgcatggggaaagagatccaggaagcatgagtgctggatattttactaccaatgccaagataattcactctactcagccggcgtggcaaatataaaacttacagagcgtggctgtgctctcaccagctgctgctctgagttatgttaaaatccgctagagcagcccaaatttttctcagtttgtatagagttcatcccagccccaattttctggggctcctcacatagctacccaaaagagaaaaaaaattaagacaagcctggcaacacacctggtgaagagtagtttactagcttttcaaacaagaatgtcccttttcctaagtcactttgaggtgtctcaatctgatctgagtgagaggcgacaggagtatttttttttttttacagctttacacacacagatgtgggctttgatttccaagtaatataatggaagagaaatctcatactcccccacagtttgatgtcattaatgtgttgggaaaaaggcctctgtcccggaagagtcatgggaggtgaaaggggcacgtttgaagatgcgagcgctatcttcacatagttctccagttgtatggagcctcttctgccaagagagggccatgcaattcatcccagaggaacctgaggcctgaaggaggtgagagaagacctctgtgaggaaagcacacagtcaccttctcggcaactaagcagtccctgagaccatttaacatgcaacccgaaggttatggtcaatcccaaaagtcaccactccattcccaactagacattaccaaagtgacctacccagagattgcttctcatccccagtcccaatgcacatccattcccaagaaatgctttgtcttcagcctctccaggcaccatctcccttcctgtgggagcagagagcttagcctggagcacctttccttcaagccagcaacacagagcactaggttcaattccctgaaggtggccactttaagagagaaatctgaaaaccccatttgctttcttttctcccatattggcatggatttctgtcttctctaacaccttgtgaccttctctatatcatgctttaaagtgtaataatatgattttttaaaagaaatttattacttgttgcaaaggtctttttaaaccagtttagatttcaagaaaaaataaatggaaatcatcgaaaattcatttcacattaatggtctaaaaataaaccaaaggacattatgtgtgcatgtgtgtataagtgcacacagaaatatatatacatatgtagactatatacatgtgtgtatatatgtgtatatatacatacacttgtataaatgtatatacacatatacctataatgtgtgtatgtgtatttattgaagaaacagataccatactcatttctaaaagaatattcagagaatatcaagatgattctggctgaaaaaggccagtggaaattcaggtgaaaatgttcatcaattcccattgcatcacctctgtaatttttcagctctctgtataaacattaaatgtcttatatagcagcaaaaatataaaatagttgtccatattttcacaggtgtggtgtaatttataaaattagaaagcaacttatcagctacttaagagaaatggcaagttttgatatgagtatacaatatataaaaatatatatagtgctatatatataaatatttggtctctatttcattttttgcatcagtattaatactaaaatatgtctcgctagtgatgtttttatgatatccctgatcctaactgaagagacagttatttatagtcatttattttaaaaaatgaaaataagtgaataataattaggttaacattgttgctccctgtgacaaaattttataagcaaatttcaaaagacatgttgtaaattaggaggctcaacaataaaacattatgctccagaa

SEQ ID NO: 1527 - DNA, 257626 bp, Homo sapiens
gagctggtgctctcccccagcccctagggaattggagctgaggaggagctgaaaatgcagatttagcatcaagcacagacctacactcgctctttctctccggtacacacagctccccacattcgcacccctgcccgcgcgccgggccgcctgactgcacggcttcccctccagccagatgctggagaacacacactgattcgctgctttccaagaccctgttcagtctctttctctatacaaagatttttttaaaaactatatataagaattctttatttgcaccctccctccgagtcccctgctccgccagcctgcgcgcctcctagcaccacttttcactcccaaagaaggatgaagggtggttgtgtctcccagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccgaaaggtaagctctcccatgcatttcgcatgttgtttcaaaacggggggacgggggggcagccctgcgcaatctcattgcagatttgcaagttttctctctttctcatgcgatgcagatattctgccatgggctctttaacacgatattgcctccggtgatctttcaccggttatgtaattaaaatgtccttcatctgtactagtaaggtcatcaaaataatttactgctctttgacttgatggcgaaaataggataacacctttcacaggatgccatgctccggggatgctgtccgaggtaccaagttctcgaggctgcctggggatggagggatgaagccctgaacagctaagcctggcgttggctacttggccagggaagtctcccccacccccatcccccggagaaagaatagtttcctacagacgaggctggacgtttggacactgcaattcacctcggtgtttctcccaccccgcgccgggaggacttccctcccagggacttcggtccctgctcctctccgggaacaacggcttcctgactctagatttggaaagaaactggtctctaaaatcggggcggaacttctgcgccctcacccccgcccacgaccgcccacccctggagcgcacttctggttggctccctagttctcaactcccggctacaggagctggagaggtggattttgagggggattccctacggagaagtcgaggtgtcctctcctgatgcgtgggcggccagcctggctttcccactagagcgtggggatccccattccaagaagttgccagagttcgacagtttgagcagataggtgagcctcccagctttggacaccttggatctcctttggagactccagggtactcatcctgggaggacagagagaagggcgctgggtgggggctgtggctgacctgcgtgtctctcctgcaaaagatgtatcagggttctccagtgtccttaggggacctggcgcaggctggggtggagtgtgggtgcagagagaaggtggggcgaggggaacccaaaggacagagatgtggctaccagagggctgggtggaggtccctgagattttaggctccatctcgctcctgatcccaggaagagagaggagtgagatgagcggtgggtgcttttggttattggttttgccttgaagggccgcgcagaccgaagctcttattagtctcttctgtcctgacttcccaagcctcccgcctctctcccagccaccgccagggctcctccaggtgtgggggcctctccctcctcctaagggcgtaggcagtaccggaatttcgaccccagaagggtctggcgacgagtttgacagaggtctgggaagaggctctgggtccgccggtggcgcgcgggcgggtcttgcggaaaggaacttgttgctctggaaagcgtgggtggagcaggggaaagaaggcgccggcggagggagcaccccgctgtggttttggcccgtggcctgccggctgttttgagagacaccaacacaataaagaagccgaccttccttcttcactcccccccaccccaaacttggcaagacccaggacccaaacgccattataaaatataatagtgattattattagttatacggaagcttacgtgctggagtccttacatagatttttacttaatcttctcaacatctctgaggaggctactatcattattgagcctatggccccgttgaggaaattggttcagaaaagggtgcgagataaaaacaggcaagggcttcaatccagatctttcagaagtgaacccatgctctttactccttagtacccacccaagcaagctaggtgctttcaggggatgtggggcattgagataagttgaaaagggattttaattcttgagtgtgatcttgctgcagaaacctgtggctccctccccctcccccacaccttttcatgggtgcgggggagtgggagggagccataggtttctgaaaaccattgttctcagtggttttctcttctctttgctgccccctttgaaaatgtgcccttaggatcagagatcagataactaggcctctttgtccttcattctttcttggagaggagcacactgattttgcatcacaacctgaaacctgcagttcccatctgagagacctctctccttacttctccataacctctcaggtagtaccccacaaccaaatccagtgattttttttccccttttacacgtttaagtaacagggactgcctggtgcaacatctgcctagaataaacctccttttggatccatgtcttgtccattcttcaagacctaaattcaaacctttcctgatgctacagaccacagtgagctttccctcctccaaatttttatgcgactgataggcaaacactgcactacataagctaataaatgccatcacttttcctcattatttcaggtatataagtaaatatgggttcagttgttgtatttctacttaaaaggtaaatattcagggatgatacctcctatatttctcatttcctccctgtaaccagcacattactgttttgccagccttgaaggaaacttccttgtctgtatttattatcccaggtttcccagacaccgtcctatcttgctttcatcatactgttttgtacttttgccaacatttgttattgtgcatcttagaggcccttatgtccttctccttccttgctctgatgcttagcatgcttcccaactccctactgctccctgctccgaggctcagtgtcagacacaaaagattctcagtggttatttattcatccatatgaaaggtcagcaatggaggctagaagaacatgctttcttattaaattatctcattctaagctcacaaatctatgagagaaattactggcatcagctgtaattctcagatgaaaaccttaaggccttgagaagttaagtatctgcttatatctgagaagtaaaagaactcagacttaaaaccaaatttgcttaactgaaaaataattgcttttctacatcatgctgcctccaggaagccttccctgactgccaagaactcttcccttgagacacaattttagagctctgctattttcccttttctttttacttttattatatttatcatttattttctattaacacatgaacatgtcattagctaatgggtacgtgtatttatgtcttcaggtagactataaatcttccaagaggagaaatgacatactatatctttatatagtctccatatctagcatggtggcctgtatatgaatatttaattgtttgtcaattatttgattgattcttataagaccatgaacaaacatttgttttctctctaaaatgaaataaaagcacctataactttacctctgaaaaggttatggagattaaagctttctattttatcatgacctggccctggcccaaagacctatgtctatcagaaaagatacttaagtctaggagagtgaatgagtttacagtaatgacaaaagcattattccaaagagtgccttaaaattctcaaaatgctactaattttaattgatttgaaacagaaaacaaaaattatttattgaagcaacctgttgaagattaaccaaaaatcaagtgagagttagggtttaaaaagaacctgatattatcctaggggtttcattgtattatggtgtgttttatgttttatccacagaggacagatgctgaaatgattacacaagtaaaatcatgtgaccatttttataatgtgtgagaattttttaattttgaaaacaacctaataatcattatgctgccaggtagtaaaaaattaataaatttctggtcgcttcacttttattaaagtataatttaggaaagaacacagcttagggaattttcacaaactgagcacacatgtgtaaccagcacccaaatcaagaaataaaatattaccagtatccctaagtccttttctcactcacttgctttgttttcaggttttagctattataaatatagcttttgtggatattaaagtctacgtattttggcaaacacatatatggccttctacagggaatcctagaaatggaattgttgagtaaaaggatatgcatgcatacagctttataagaccatcagttttctattgctgtgtatcactaaaaaacttagtggcctaaaaccacacaagtttgttatttcacagttttcatgggtaaggagtctggcacattttagttgggtcctctgctcgagtcttcacaggctgaaatcaaggtataggctgctgggtcccatctagaggcatgaccaagaaacaaccctcttctgagcattttcacggctttaaaggaattgagtttcttgtggttttagacctgaagtctttattttcttgctggctgctgggccaggaccactctcatcccctggagacctctccatagccctctcacacctcacccttcaaatatctgccttcaggaagagcccactctccttgcaaggttaacctgattcgttcaagcccaccaggattgttttccttttggttcttctgatgaactcagagtcaactgatttaggactttaataacatttgataaatctcttcacctttgcgtaatctaatcacagaagtgaaatctatcatcttcacagtcccacctaggctgtccacactcaaaaggaagatgattacatagggcatgtacatcagggagcagaaatcttgggggccatctcagaattctgccggctacagacaaacagccacatggctttcctaagtagttataccaatttacattcccttcagcagtatgtgagagttccagctgctccacattctcaccaacactagatattttacatctgttttcttttagccattctggtggtatgtagtagtgtctcatcgtgactttaatttgaatttccctgattatcaactgaagttaaacacctcttcatatgcttattgatgatttggatatcctcttttaaacacatttgtttcagatgctttgtcctgaaaagtttttcttttgggttgtccatcttcactttttatttgtaggatttctttacctatgatggatagaaatttttggtcagatatatgtattttgaatatttgataccacccatttaatgatatcgtaatgtcacaacaatgttcaatccagattatatgcttttacttctactttgtcaggcagccaattgtaagtcaaaggaagaattatcttgcagtatttccacatcccctatcccaaagttctttagatcaaaattgacaatatttggaggaaaaaaataaaaacagcatatagatttgatcataagcattccctgaaagatttcaatctaagaagactttaagggacagttcttctggaactaaaagattttccacagtagctaagggaaaatagcaacctgtaaccttgcttccctagacatggctgccattcatgttgtgccttagatcgaatccaagctaatccctcaagacctgtctggttgacctagaccacagtgttctctatccatttggtgctttgatgatgtataatcgattcctttccctgataccagtcatagccatcagaacgctcactgtccccaatacacctcttgtggctgaagaaaatgaggaacaataatgttgaaaggtaaagatgacaggatttggaatcagatagcactggaaacttggctaggttactaaatctctcagaggctcattgtcttctgaaaatggttaataaaatatggtggctgtgaaaaataaataatgtagttagtgcatgtaaagttctgggcacagcactgagtgcataggataaaatagctattactgcagtagtaacaataagctggttgtgcactagtgacactcttttcctcaaaaaagtagctgtgggttatacttgtgagggagtgacaactgattgagtaaggaataggaacccagcccagcagcaatccacccatgggctagtcatgacccatgagatgacctggcccaaattcagtaaatttaattcattatagaccatggtaattatctcagccaattatactggattcctcaggaaatctgactggctagttgctctagagaggagaatgcagtacagttaccatgagaaagcccattcaggccatgggaaactcagacattttatctaagtttctaatagctttccaaccccagtttccagcaaaagacgcctgtaacaggctgaagagctaagcaccagattcattgctccttcttcatgggctgcagcaagaccacatttcccagcctgccttgtaaataagcgtgatcatgtgacaattctagcctgtgtaatgcaagcagaagtcatgtgtacttcttccatgcctgatgcataagaattctctatcgattgtttctctgtgttctgctctcctctggggcttgatgtaattgagaacagtacattttgacaccaaatgccaaagcagcatcacaagatgaaaggagcccaggtccctggtccgtgaattagaagaccttatatgagtgagaaataaactgctattacattaagacactgagatttgggagtactgcccaaactaatatgctgtcagtaaatatccctttgcttaagttgctagagtgaatctctaaacctcgaaggcaaaccgagccagatcacaacaaaaattgttccaaagttctgtgagagcacacatattttcacaatatactaccaaacaacttttcaaatatttgtgatttgtcttctccagcaacaaatagaacccattctacacactgttcttcctgctggcaaccaacgtgccctactcataataggtgtttaatatgtgctccttgactatgactacagttggaccacaaggtggtgatttgtccataatctcaggttgaaggtgctggaaaaactattttttaagaaactgttcctgtagaatccatttctctataggcagccattcagctaggaaatagaattaagtgacaaccagcaagtgggcaactggcatgcttctttgtttctctaaaattccccaacttcgatattatcagtagtagaacagatgagctctttgaacaaagaaagtaaagtctgcagttacaacctgatcaaaatccaaaagaagggaaagaggggaaatacacctttttttctcaattgaatgaatatctagaaatcaatttctatttcagaaggtcttattagctatagatcataacgtcatagcacatcagatagtgatgctatagttaggttcacaataattatatattccactcaaactaactgctcaaagaggtctggctttaagaataaaacatgaaatctgaagttcaatttttcattgagttcagatccaacgtttcaaaaagaaactctgtgctgaatttgtgaattattatttgagatacaaataatcacgggacagctcaaaaactgacatttctatttgactttccttattaaggtgtatttatttagctaaagtccacaagtgattaagaagtcaagaaattacatctgagtcaacacttcagtctgaaatgtatagttgtgtattaatggatggtttatatgcgagacacatatgaaaataatttaactgccttgacaattttttgtcactgaagctaatttgaccacaactttttggaaattgttgtgatgtgctgagattgtcgataaaaataattgaataaaacaagttcttacattgaaagtagaacaatgacacactcttaatttcctgacataaagtagacttcagactgttacagcgtattggcagtttctccattagaaaattgacaagaatggggagaaaactgtaggatcctggggttgctctttgtttacaactttaaatttgacattaacttccataaatatccaattgttctcctagtttttcctaaatagattcatttcatgctcattttgtatcaaaggcaaaagagtccaaagaaaagtgaacaatatacagaatcactattggaagcatcaagaacataaagataataacttaggtttaaaacatttgcaaagtgttgtaagtcattagagaaaaaagttttgacctggaatatttgggtttcactcttctaaagttttaagtagagggcaaagagatggtcagccttgctttctgtgtaaacacagtgtctggcaaaactaagtctacaggaaatatttgttgaatgaattacttgattgatgttggtattagatgtagtagacaattgaatatctttcctcttaagatttaaacaatgacacacacaaacaaaaaagtgaatccttccatttgtgagatggtaaacatctcaatgtcaagacagtatttttacacattgcaatattcatgaataccgtgagtggacataatcaaattaaatcacgagataagttaggaaccctgataatatgaaaaatgtaataactttgatatttttgtcagaatcactcatcattattttaaaaaataccaagtaataaaaaaatacaagaaggtcttttttaattatctcaaatctcattattcagaaataaccattaccagctttagataaactctattgcagatacttctgtatgaatatgtatagagagaagagagatatataaattgttttatagagctgagatctcatcatatgtgctattttaagttttaaatcattcagtttaattattataaaatttaacagaagagaaaatcaaaagaaaactatggaaattgttaaacttcagataaatatgctatacaaaggagatattatttcctaatatacctccctaaaattcataagaaattattgtgtctcatatttaggagtttgtagttacatattttatacatacatggtagataggttacatatatttaattacatgtttacttatttaattacataattcaacttttgtgagttatggactcagtgctttgtaaaatggggaaattagcatcctgacactttctctcagcttccctacttccacattccaatgtttgttaggtatatcattatttttgcattgtgttacatataaatattaaccttctactaataaccataatttatagtattgcttatattagttctttcttaaaattctaatgttaccacaagtccttttatcagaacttcaattacaaattcatttttattcatcttttgagtagctaggttttactgaaacatgaagaaattagcctaagcatgaaaaaggagctgtctcagtttcagattaaaggggaaaaaattggcaggggaagtcctgtttttaggtcacagaggagaatgtggtgataatatccacttaggaatcacaattatttcagaggattaagaggcaaggtcaatgttcagagggaaggaagaggtgttaggatgggggcttcaaggagatggaagttcagacactgctagtagacatgagagagggagtggacaaaggacagatcatgatttctgggcagtactgcagaggcaagtgggaaagaatggatttatggtggcaccagcagacatcttaagaatgtcttaagcaacattcagattagggttgagaggtgagagaaatggaatcttccaaataatagagtgtcaatgaaatagaagaataggtaaattggaaataacagtgagagagatgaaagggagagagctatggttggtgagtgggatattgaagctcaaggctccaaaaattgagcacttccagataatgatgaagttcatggaagtgaattatcaaagtaaaaaggagatgaaggtgatcaagacactaaaagtaacatgcacaaggatttgttcacatacacctcattcatgctatggcaagaaataggattgtcaaggaagactgttgagagaaaacaaagcgaagtcctaggacaaaatgttggagaactttggacatgaaaggagaaagaggaaccaggagaggagtcagaacttggacggttagagatatggaaaaagaatcaagagcacacaggcctgtgaaaggaaaggaggagagagttaagaaggaaagaaggaagcaacctcagccactggttttagagacaaagtcattgttgaaataggaggagtcaccctagcacagtggaagaggagacgagtgttaatttgggtccccagatgtaggccctggaataaggacttaaatgcaagtagtttacttaaagagtgattctacaaaatactggtagaggagtggggaattgagataaggaaaggaaggcaggaataaagggtacatcataaagcaagttgtcactgtgggtaactggaactcaatcccactggaaaactgggagctggtgtagaatatgtgcttcagagttatcctgcctgaggggtgaggaagttggggtatttatacacgcattgcattgacatattaattaatgattgagagttactccaggctgatgttaacactccagcattttgtcctggcatatgctcagacagagcagaatttggccatccagaaaaatacttgcaaacagatgcagaggctggcacccacaaaatggtaaggcctatccaagaggatctgagtgtgaaagtaaacatgtctgctacaggaaaaaagcccaatcatgaaggaaagcatcaagtgtgatgaagtggaggtaccaaatatagaccatcccttcaagaggtatagtggttaaaatagaaaaatagtgttacagtcacttgatgtggttttaaaggtatttatgaattaataatttcttagcacttgtcagaccactggagattgctatcccaccagaatattgtgacatacctagccaatcaagtctgcattactctaactggtttttccagtcatttacatttttacaaatgataattataattatgaaattacagcctttcagaacaggaagggatcctagaaagacattaatttaacccttcatttaataaatgaaggaaataaatgagggaaagggcatcgaacactatgtttgtatgcttaactattccaaaaagcatttgagccttgttgctcattggcggtggtttagacaatgcattattgatatcactgaaccagctttccagactggatgagatagacaactagattgggtgagactcctataagtgattagccacatacaccaacttggtctgaccatactaattcatttcaggtcctcctgatgtgcttttttggtttgtttttttaccattttacccgtagaatttttataaattctgattttccaaacaaagctattcatagactcaaggattccacaccaacaaccattgggtttacacttggtaaaagacagaataggaatttatacttccttgactactcccttagtgactaaacagtgctatatatttagtaagcactcaataaataccaaaataaatactgagaaaaaaatttaaaggcttagcatcatcattagattttcactgcacacccagccgatgtctcatgagatggtgcaatcaggaaaaccaagtatgctaggaagggttataggaacatcctatttagtgcctgtgttaagtggatttccttaattgcccttaatagcctaaaattttgtgacttaatcattaagaatccagtgacagaggagaataaggtgacccacaaatcctattcctctttgcctttagcttctcctctatttctgtgggaagaaaaaatatcacttttatcagggcaccaccaattctcttcagtgatgatggaagctcaaacccaagaaggtagttgacatccaagagtcaattctagtcagttccagctgactatgtttctaggaactgtcagccaagaatgggagaccaagagagaccttgaagaacctaaaatgtgggaagaaggatgggaaacaagccatttgtgatctcttgaagttcagtagcagcactttaggcagaggagaagggacagggatccttggagagttgtgtcttaaatgaggtttgtcattaacccaaatttggacccagcagccgaagccagaaacaaaccattctggccataaactagaaaatgaggagaggaccaaagaagagttatgggagtttcaagccaatggaccaagaaattagcaagagctacagtcataccacagggacgtatagaaggagaagattattaaggtcattcaacaaacatatactgagtaagttcagtaaacaaacataatgcaacacactaagacatggatttgggaacaagtaagcaactgggattcaatcttactggcctaagatgattccaatagatagatgaaaaatcaaaccccaaggtgaaaacactttttttttttttttttttttttttttttgtgagatgaagtctcactctgttgccaggctggagtgcaatggcgcgatctcagctcactgcaacctccgcctcccgggttcaagtgattctcctgcctcagcctcccaagtagctgggagtacaggcgcacaccaccatacccagctaaattttgtatttttagtagagacggggttttaccatgttggccaggatggtctcgatctcctgacctcgtgatccacctgccttggtctctcaaagtgctgggattacaggcataagccactgcacctggcccatgaaaacactttttaagtctctgcttgtgttgcatttactaagtttcattggccaaagcaagtcacatggccaagtttagagtcagtgtgggaggagactaaccaagggaatggatacagggagatatgaacaaaacatggatccaatttcctactacaggcccctctgacagttacaacttatctgtgttgtcccatcaaagggtgaggaggctgggatgtttaacctccagctaccatttcttcttggttgatggttgctcctggggaacttcaaatctctcatacttctgcctgctgtaagtagaccaagcatgcttccactgccagagaacaccctcaggagagcggtgcctgaaagacattggcatctgtatgtactctgtacaggtgacctccagggtggaccaagggaaggcaggcagtgcatcaatatcatgtgctacacagaggacctaaagttacataaaattgaggttcgtcagaggctagaaagaaacagtttgtgagtgaggctgtatgtcagatcccctctacgtgtctcattacctaggtgtcactctagacttgatataaatcagtggttcagtctttagggggtacatcatagtttgaatcccattgtggactgttagcccagccctaaaatagttggtgtttgtggctaatccctcataggagtgtcacacaatctagttgtctgtctcattcagtctggaaagctggttcaattgtatcaacaatgcattgtctaaaccacagccagtaagcaacaaggctcaaatgctttttgcaatagttgttaggcacataaacatagtgtttgatctgctttccctcacgtataaaatgaagggttaaacgaatgtctttctaggatcagttcgcgctgattacagacaaatgggagtgctccatgtaaacaagtccagaaagtttttgtgatagatttaatatatagtgcatgtgaggccgtgactgtcagcagaaggaaagtcttcacaaagcaggcaataatacattgaggtaaatttacaatgaggcttataatttcaagaggtttaaaggaagaggtttataaagaaaaccacaggatgtgcaatgaaatgggcacggtttttcggaggattgcaagtagttttgtctgtctagatgacaagagactgggagatgaggccaaagaagtgacctggggtcagttcatgaccagtcacccatactatgctgaggaatttggattttgcaggtaggtggaaggaggcatcgaagggtacttgggaagtgtggcaggatggccacatacaggacatcctaggataagaagttgagctaatagtgacttggagaagccttgatctctgcctggtttctttgtcctgtggaatcactaattctggcaacaagtagcacatcatttaatagatgatgccactaggaagtcaggttatatgtctttgattccattgtcactggatgatggcatcagtgatactaatggcttgattaattattgtccttgtagtcacactgaacggctggtagagcagccagttctatccatgaagattagtccagctaagaacaaaacaattaaatgcacctcccctgacatataaatatatgaatgcagaacaaatcccgtaacttagaagccaagaagaaaagaaagaacagtggtgtatcaccatgatcctagctcacctaataggcacattactccctgatattccaaagaaataatgctcatttttaattttttctttctggaatgatatatggaaatgttgcctgaggctagaaagaaagtttgtgagtgaggctgtatgtcagataaccactacctgtctcattatctgggtgtcattctagacttgatataaaacagttgttcagttcttagggggtacatcatagtttgaatcccactatggacagtgagctcagccctagaataatggataaccatggacaacacaagctgcttcatactgttttcctgcttatggggaagagtggatcctggaattacagaagagaattgagcattatccgtggagaacaaatgcttaggaatggcataggagtaggcagggctggcttacagccaagtgtactgagtgctaagtcagtgacttacccctctctcccctagtttcccttccacacagcctcttacaaatcagctaattacagaagaacattcatacatgagttcttattttattaacaagtgtgtgttgagccctatgaagatgaggcacattgaaaggggttgattctacagacagaaagataacaggttcaagtttatgcccaaggacaagcacacttatagttctatagttctatagtctagtttataagaattcatacaatctgaggtctctattttgctattgcaaatgtctactttatgtgttggggtgtgacaaactgttttagcaattggtctctcgttctaaatgcaaaggaccttctcagaccatgctaacctggtgacacatcctaataagttgaggctgaatgagatcttttgtcacatctggttactcaaagacatgatgtcctcactccacaggccttgtgctattgagagaggagctgaagtcacacataaataatttaggctcctccactgcatgaaaagcatctgtttaaggagctgtcaagctgtccacctctctagtgaaatcatatttactttattcatctaaataatgtggcttgtttgccttctgtgtgaaattgtcttgcactgtttctcattggtgggttttatgggacagcatatgattttctgtgcatccatatgccactctacctctgggaatggaatggcttcttgttcagtagttttgattattatagccctttatagcttatgagtcattgggtttactcaaaatgtccagctcctcattctcatttttttctctatggcccagccatgcccgtcctgaaaaatttttaaaaaggaataataaaaataaataaataaaagtcatgtactctatatttcatttccaatgagttgcttcttgtttgggtaattttttattgtattagagacaaggccttactctgtcacccaggctggagtacagtggtatgatcatagttcacagcagcctccaactcctgggctctagtgatcctctcacctcagcctcccaagtagctaagactacaggcacacaccacctaatctgactaggtttttattttttctaaagacaaggcctggcaatgttgcccaggctggtctcaaactcctgggctcaaatgatcctcctgtctcagcctcccaaagtgctggaattacaggccaccatacctggccttgtttggataattatagcaataggagtccaccgaagtaagttgtgtttttttagttatttggcattctcacacttggatgctcagaaacatgtgagcaaatagcactgaatgtacccacaattatgtcttgtgctcagtttgtaagtcactattacgtaggtgagaccagagcagttactgtgaagtggaggtagctgcatttaagactgtgaacagcgcatcaagaagcacacaccacaacgtgtgtaatgcccctgccatgatacatcacttcaatctaatgatgagaaagcagatgatcccaattgagagacagtctgcaaaataactggcctgtactcttcaaaagtattaacgtcataaaagaaagacagatagactaagaaactcttccaaattaaaaaaagaaatgacaaccacatgcaacatgtgatcttggattgaactttgggccagattttttatttttttttccataaaggatgctattaagacagttggcaacatatcagtgatgtctgtaaattagaaaatgatatcacattagagttaactttctgatgttgatacttatactgccttgttcttagaaaacacacacacaccatctacaacttattctcaaatgattcaccaaagtaatacgtatatgtaggaaaataattttttaaatgcagtaaaatgttaacaattggggactctgggtgacatggctatatgagttattttcactattcttgcaacttttccataagtctgaaattatttcaaaagtaaaaaaattactgctaaaagaaaaaatgtgtacattgatgcaaaactaacattgaggtctctccctctatgaaatagagctgggttaaactttgtcaccaacaatgggtttctgtcccagctctgccactatagagcagtgtgaccacatccacataattcaactttttgaacctcatttttctcatctatgtaatccagatgtcaactagaaatacctggacccttgagatgtagataagatccactcaaatccccataatgtaccctgtagaagtcttaacccttcccaatattcctttaaattctaggagtggagctagattttcgttttacttctggatacagttttctacttctaccaaaactttccagttaataaattatgtctccttcctacccaaacaatcattcttcacaatggttactcaagtgtaaaattcagccaactcccttgatttcccttcaccaaaaaactcttaccattcacccaaggcatctgtgactagaatgtattttcctgaagatgtcacaggtgccaggaggggatttatgttgcaaacacaaagaactttaagtaagcacttgctttgaggagtcatttcatcccctcatcactgggcacgggcggtggcctcttcctgcccagcctcacatttcttgccagatcctcgccaccttcttttatctgccccttggtttctttagtatctcctcctctcatgggtgtgggcagattcttcccaggcagagcaggtcagatctccttgctctctaggcacccatgacctcaggtacccaccaaccatcacagaattatcccaaatagagacagtttcctcccgaagaagagctcagatgattacattctcaccctcagagtctctgcaaagtgagacatagtgctagatacacgtggaggtcatctccagtggaaatatgctgagattctatgaagtgcacctgctttaaaaaaatggaaattactttttcaagcagacagatatcaaacacaagttcctttcctctagccttgttatctgtgtggaatttaatagggtaccaataaggtttcactaacaaattacactttatacgaccttgccaaatgcagcattcttgtgggttattctagctttttaaagggatatcttgcttgtgaagatactagcatgtaattttctagcttagacatctacttttcacccccttttctcctttatttagaaataactctgaacccaaagctgatgtttgggagtagttaacttcttctcttgttttctatagctgctccaaagagcttggacctgactacagaccaaagtaacagagaatgctagcctcatctgtaattgataggatttttttttttgctagaatatctgagagtatttttacctcgtgttcaatctcatgagtttcttttcattccatatctcttatgatgtgccttctgtcttgtgcttagcagagtcctagacagctcagagctaacaagtgcaatgtgcatcactcattggatcacaaattgagtttggccagcacaatgctttcaatctgtttgacttgtggaggagcacgtaccctccagtttaccacaatcctcaccactttctattgtcttttacctgattcgcttagttagacagcctgcttgacccccaatatattaaatgtcttaccaatgcccaaagaactccataaccttagtcatccacactgaatagcacaactacttaataactcttgctagaatctagaacctcctgatctttttaatttactcagcaggtatctatgacatgatactctgcacctaggacatgagcaaaaccggtgttgtccccatagagcttgcaatccaggcattccgaggactgtgttctgagagataattctttccagcataccaagataattttgaaagatgaatatttaggcaacatgtcagtacctcaattttctttttcatttaagattcttctgctccctactactgtattcgaaaccagcctagtggatggctcttcctataagcaagaactatttccttactataaagtgtgtacaatccacttggctgtgggttggagcggctctattagaattgactggggatattcagttggaggttgacaatgagaacacgacaaggcagatgatcagagaaattacagtaattactcacaatcagtcttcgatagtaagtcacaaaattaaaaaggagaatgtaagtcacaaacgtaaaaaggagaatgtaaaagtatgaaccaagagaggttccatgttcctggtttaacagtggaatagtaaatgcaggatatcctccagaaaatgcctgaatgaatggtgcctctactctctgctatggaagttagttgggtccaacgcattccatgggggacgtggtccaaagtggacctgaagagtgtggtctgtcccctagtggtcctaggctgtcaatcagactatcccatccttgcctgggagagcagctgttgtttcactgatgataaataattctgcttgaaaaaaaaaaagtggtttctctttagtgatggaaatagatacttaatttgtgttttagattagacatagtcactcttatgttgttgataattaagaaataaaatcactctggaagttgttcttctctctccctttgctctgaagttgaaactcaggcctgtctattaggtacctttagaattatcactgagatcattttaccttgcacacaatccagggaaaccagtaatcatctctgggcagatatcagtaatgtgcaaaacccatttcctacttgacttggaaggagaaagaaatgttaggaagagtgaaaaatgaatggggaaaaagaacacatcagttcttctccacatggtctctcatcctccagcagcctaccccagacctaaattcaaatgagcttccctttctctcccatccctactcctgggcatcatgttctgcctataagagattgcatgcaattgaaggaaataaagaacggtctctgagaaagtcaataaaatgcagagcttatccctgttggtaaaattcaggtccccaaatgaaatggacaagcaattatcaactgagccagttttcaatccttggtgattgtttcgtctgccagtttttgtttcttaaacctcttgacagcagtccctcttacaaataaaattataaaaatcctatatagcaaatgatgtccagtgttctaccaaactagatcccgactaagcctgactgaggaccatgaaaaccagcacagtggacaaacacaaagaaagcagccaaaggaaaagtgaagagtctgatccgggaagccttaactgttctgagggttctgaatccatttgagaatctgtaataagcagtagactctcctgagaacaagcgaatgcacagatgcacaaaatttggaatggaggccatgccaaggtcacagaccctctggagcatctacagattccctaagggaagagaactctagtgtttaaaagaagcaggaaataggctccatgagaatttaacacttctttttatctgttcacaattggttgccagttccctggagttccctactgctgggaaaatggagtgtgtgggttcagagaggtgctatagcttggagccatagttttcaatgggaaaaggaagtaagaggaaaagaaagaagacaatgagaagtgttgctgagatccatacatttttgtggcataatgagaatttctaaaaactctgcaagtctgacttagcagcattattatactgtcacccagcctgaatcttcaagctgacaatttgctgcgagttcttcattcacttctttttctccttccttctggaaccatgcatattttgccttaagagaacaaagtgatgatataaaaaagggtgtgtgtgtgtgtgtgtgtgtgtgtgtgtgtgtgtgtgtttcaatgaagaaaacatttcaaaacatactaaatgcccgcagtatgagaggcttcttactaggatactcaggtgaatgtttgggaatctaccactgtgttcaatatgtctttgctatttgcaagatttgcagtctacttaagaatctcaggaatgcatcgatcagccttacatccttgaggtctgtgtaggcagcaagtaccttatactactgtaagtcacatagcatctgtctttctctccctgcggtggagcttatgattgcacaaagctcttaagcagctgcttctcagatgctcagaagacagtggatcttgggtctgcactccaaaagcaagagacaaaaaaggcccagaaaaataaccaatgcctacaggttagtcttttgttaggttcatgatcagtcaatttacctgtttattgcataagagtaagctcgtcagaggttcaaattttagctttatgagaccaattagctccattttctttcatagccaagaaagaatcccaaagaatccagactcaagggtcccaagatcacagcagtggggatgtcacccatcaacctggctgtccttgagtcccactcatctccatcaggaattccaggccaaaatctcatggattcctagtcatggttacaaaggggctgggacgtagagtaggaccaccacacaagcagtgtggatttacactcaggagagctgggatttctgcagagagctcccattcatctggtcaggccctggcaccccctgagccacagtgtcttctctaaaaaaatgaggcagctagaccaagccaggtatgcaactcagtagcctaaggtaacacaaccgtggaaagggagcttagtgtgtgaccataggaagtgcaggggtaggtgggttctgatttgaaactaggaaatacatgacctttctgaggtcattcaaatttaaattttaaaatatttttacatttttaacttgcatcttggaaataatttagactttaaaaatgttgcattaagtcgggcgcggtggctcacgcctgtaatcccagcactttgggaggctgaggcgggcggatcatgaggtcaggagatcgagaccatcctggctaacatggtgaaaccccgtctgtactaaaaatacaaaaaaattagccaggggtggtggtgggcgcctgtagtcccagctactcgggaggctgaggcaggagaatggcgttaacctgggaggtggagtttgcagtgagccgagatcgcgccactgcactccagactgggagagagcgagactctgtctcaaaaaaaaaaaaaaaaaaagttgcataaatagcacacaggtacacctatgttcatggcagcattattcgcaatagccaaaaggtggaagcaaatcaagtgtccatcaacggatgaatggataaaccaaatgtggtatacagggtggaatatttaaccgtaaaaaggaaggaaattctgacacatgccacaacatgatgaaccttgaagacattgtgcttaagtaaaataaggcaggcaccaacagtcaaatactgtatgattccacttatataacctaattcgagaaatcaaattcataaagacagagtgtagaaaggtggattccagggctggggggggaatggagagttactgtgcagtaggtacagagtttcagtttgagatgattaaaaagttctggtaatggataatagtgatagttgcataatgtgagtgtacttaatatcactgaactattcacttaaaaatcattaaaattgaaaagttgatgttatatatatttatcacaataaaaacattacttttaaaaagaagcagagtttccatatacccttctttattcagcttccccaaaattaacgtcttaggtaaacatagcaaaattaccaaaggcaggaaataaacattgatataatactattagctacaggccttattcaaaatgttccagttgtcccactagtgtccttttttctgatccacgattcaatccaaaatatgattatatttaatagttatgtctccttagtttcctctaatttggaaaagttctgcagctcttttttgtcgtttatgaacatgatgactttaaagagtactggtcagttatgagtttgtctgatggttctacctgaataaatacacgttatgtatttttggtgagaaaatcacatgaacaatgtgcccttcttagtgcatcatagcatgactcatcactggtgaagttaacttagatcgcttgggtaaagtggtctctgccaggtttctccactataaagatacatttcccattgtttattattgtatctcacctattaattttagcatctattggagatgtttgccggccacaattactattattatgacattttctgaatgatgatattcaatgtccatcatttcttctacatttattaatggcaattccactgtaaggaagagttttccctgcacctcagtttacatttaatttcttattttaaaaaaacactaaaacaagccagaatcatggtaagatatgttcctctgatacccactggcacttaacaactccaaattttctttctagtgttaaaaattctaagttctaggccagatgcagtggctcacacctgtaatcccagcactttaggaggtcaaggcgggcagatcacttggggtcaggagttcaagctcagcctggccaaaacagcaaaacctgatctctactaaaaatacaaaaattagccaggtgtggaagtaggtgcctgtaatcccagctactcgggcggctgaggcaggagaattgcttgaatccaagaggcgaaggttgcagtgagccaagattgcaccactgcactccagcctgggcaaaaaagtgagactccaaaaaattaaaagtaaaaaaaaaattatcagatccataatgcttcctgcaataagaaacaaaaggtcaaatttcatactacctgatagtgttcaaagtagaaagtttttggaaagcaaaatacagcacacatacattttcttcctctcccctcactttttttattttattaaatcttaatattatccagagtatatcagcagggttaagtagagaaaacatttaagaaccattgagcctggaattatcacacgaaatatttatgttaaatttgccatggggaatatggcttttagtgaacaggaactaaatcacaaaagctacaatgttctaaaaaatttttattcacagaaaagacccctggttaagttggctatgccttgaagatcatccagtatctgctgatctgagtccaggcctgtccccctgtgccagggatgtcccttgagagcctttatctgagctgctccaagacggtgtcatcagttgacagacagaaccaatattattgtagagttttatgttaacacagctgtgaaagctgaagaaataaaacttttttttcagctagctacttgtttctgtagtccattgctgagtaacaaaccaacccaaaatttggtggtataaaacagcaattttattatactcatgaatgtgggaatttgtaatccaggcagggcacagtggaaatggcttgtctgtggtccacgatgtgtggaggctcagttgggaagactcaacagctagaggatgactggtatggctggagttggaatcatgtgaaagcttcttaatatgtgcatttaacaccataaatgggatgacttgaaagctgcgctcttccaggattgtcaggcaaagcactacacatgcttctcaatgttgcctgggcttcctcataacatggcagcctgagaggagttggacttcttaaattgtaggtcaggactttaagagcaagtgtgttccagggaacaaggcacaagtctaatggccccttatgacttagattcagaagtcacatggcatcacttccaccatactcgtaattaaagtgatcatgttccccagatgcaagggctggaatcatggacctcatttcttgatatggggagtgtttaaaaaaaagctgtggctttaaacagccacactcttcaaaattaaaacactagaaaaatataatttttaacagaagtggaaaagagtctcttaagctgactgccctcccctttctccaaaaagtctaagaaatattccccaagtatccctctgattgaaataacctctcctttgggtttccatagcagcttgtgaataactctgctacagcacattctattctaacaataaaaagagtaacttatgcttgagtgcaagatattattccaagcacttttcatgcattatctcacttaattcccataacaaaaacattttataagtaaaaaatctgaggcccacaagggttaactaacttgccaaaggtcatagcgctgttacgaggaagagcgagaatttaaaccaaggcaatctggcttcagaactcatgttcttaaaccactccaccacagagtactgttaatagattgctgtgtgcaaatcttccttccctgtgaattgtgagctatttgtaggctgagaccatatcatcattacctttgtctctccagcaccaaacacagtgcctggcttatgacaaggaacacaaaaatacacaatagaaaaatgcacaaaagagaagaaactaaaatgtcaataaacatatgaaaagatgctcaaactttcaaaacaattaaaaatattcaaataagatgaaacattttgcctataaattggctgcagttaaaatatcattaataaatgtcaatccagtgttacttagagaatgggaaaaaggatatttttattcttatttacttttcggtgaatcttggaatatacaaccttatagggaaacttttctgaagtatctatcaaaatgataagtgttcataatctacgacttagagattgaattcctaggatatatcctacaggaaaactctcatctatacaaacagtgataatcacaaagctgttcatcatagcatttttaatagcaaattgattaagatatagttcacatgccataaaatttatcctctaaaaatttgcaattcagtgatctttagtagagttgcaaagttgtgcaatcattaccagtatctaattttagaatatttttaccacccttaaaataaatcctggaccattaacaatcactcttcatttctgtcccctctcagccccaggcaaccactaatctaatttccagctctatagatttgtctattctggacatttcatataaagaagtgatacaatatatgaccttgctgtcaggcttctttaacttagcattaagttttcaaggttcttccgtgtttttaccatgtgtcattgcttaattcctttccatttagaaataatattccattgtacatatatatcattttgtttactgttttatcaattgatagcaatgtgggttgtttctagtttttgactatcatgaataatgttgctataaacatttgtatacaagaatttgtgtaaatgtatgttttcatttctcttatatgcacccgtacatggaattgctgggtcatatgacaagtctatatgtttaacattttaagtaactgccaaagagctttccaaataggctgtaccattttactatcccaccaacagtgtatgagggttcaaattcctccctatccaggtcaacacttgctggtttgggtgcagttgggcaggggttgattttacccattctagtgtgtgtaaagtgatatctcatggttttaacttgcattctctgatgtctaataatgttgaacatctttctgtatgtttataggccatttttacttcttctttgaagaaatgattcctctaatttgcacatttttaattggatttcttgaatttattgttgaattgtaaacatttttaaaacattcctgtgcgagatccttatcagagatatgattttcaaaatttttctccaatctgtgggttgtcttttcgtttccttcgctatttcttttgaagtacaaatattcttaattttaatgaagtacaatttatgttcttacacttttggtgttgtatctaagaaaacattgcctaacctaaagccatgaagatttatttatatgttctattctaagagttgtacaatattagctcttacatttgggactactaatcattttgagttaaattttgcatgtggtatgagataggaatccaaattcatttttttcatgtgaatatctaattgtccaagcacaaaactgtgcttgaacagactattcattctcattgaattgttctagcatccatgttgaaaatcaattgaccataagttgattatcataaattatttctggattcagttttattccattaaactactatatgtctctcctatgccagtaccatactactttgattactttagctttgaagaagtgttgaaattgaaaaatgtgagtcttccaactttgttcttctttattaagattattttggctattcttggtctcttgagtttacatttgaactttaggataagcaaaaatgacagctgagattttgaaagtaattgtatagaatttacagataagttagggagcattgccattttaaaaaatccgtgaacatgagatgcttttccatttatttagatctttaatttctttcagtgatgctttgtacttttcagtgtatacatcttgcacttcttttgttaaatttattccccagtattttacttatttgatattattttaaattgacttatattcttaactttatgcttggattgttcattgcttgtgtatagaaatataattgattttgcatgttaatcttatattctgcaaccttgctgactcttttgtcaattctaataatttttctggattcattataaatttctatgtacaagatatgtcttctgcaaatagagatagtttttcttctttctttccaatcttgatgcctttatttctttatcttgcctgatggcattagctaaaatctccagtacactcttgaatggaagtggcaagagcagataactttgtcttgttctggtcttaagaaaatcattcagcctttcaccattaactatggtgttagctgtgagtttttcatagatagatttatcagattgagaaagttccctttcattcctaatttttttttttttttgagacggagtctcgctctgttgtccaggctggagtgcaatggcgcaatctcggctcactgcaagctctgcctcccgggttcatgccattctcctgcctcagcctcctgagtagctgggactacaggagcctgccaccacgcccagctaattttttgcatttttagtagagacgaggtttcactatgttagccaggaaggtcttgatctcctgaccttgatatctgcccacctcagcctcccaaagtgctgggattacaggcgtgagccaccgcacccagccttcattcctaattttttaaaacgtatttattataaaagaatgttgtattttgtcacatgtttttctgcattgggatgttcatgtggtttttgttatttattctattgatatatttattatagtaattgattttcagatgttaaaacaactttgcattcctggggtaaatcctacttggttatgatgaaaatcctttttatatgtgactggattcagtttgctactattttgatgagcatttttttgccatatttgtaagggatcacaatctgtagttttcttttcttgtggtatttctgtcttttcttcatgtcagggtgacacaggcctcaatgaattagttgggaagtgattcttcctcttccattttttggaagagtttctgaaggactggaattatttatttaaacattagtagaactaatcaggattagtagaattcatcagtatttattttgcagaaagttttaaaattactaattcaatctctttactgctattgaggctctctgataaatttttaaattctgttatgtactttttagctccagaatttctgtttggttctttcttcttattatttttatctctttattgatattctttatttgatgattcaccattctaacactttcctttagttctttagatatggtttctttgaacatatgtctgggtatagtgatatctatatataatatcatgtgaatatttatagttatatagtttagtctttgtctagtaagtccaacatctgggcttcctcagagagtttttattattttttcctctatgtgtggagcatatgttcttatttctttttgtgtctcacaatttttcttgaaaatttgacattttaaatactgtaatatgacagtttggaaaccagagttacctctccccaggttgtttgttgttgtttctaggttttgttgtttttactattgctatttgttttcctgcacccccacccctgtttttttttctttttttttaattatactttaagttctgggatacatgtgcagaacatggaggtttcttacataggtatatacgtgccatggtggtttgctgcacccatcaacccatcatctacattaggtatttctcctaatgttattcctcccctagctctgcaaccccacaggccccagtgtgtgatgttcccctttctgtttccatgtgttctcattgttcaactcccacttatgagtaaaaacatgcagtgcttggctttttgttcctctgttagttgactgagaatgatggtttcctgcttcatccatgtccctgcaaaggacatgaactcatccttttttatggctgcatagcattccatggtgtatatatgccacattttctttatgcagtctatcattgatgggcatttgagttggttccaagtctttgctattgtggaacttaaataaatttacaagaaaaaaaacccatcaaggagtgggcaaaggatatgaacagacacttctcaaaggaagatacttacgtggccaacaaacatatgaaaaaaaatgcaccaccactggtcattagagaagtgaaaatcaaaaccaaaatgagataccgtctcacaccagtgagaacggtgatcattaaacagccaggaaacaacagatgctggagaggatgtggagaaataggaatgcttttacactgttggtggttagtgtaaattagttcaaccattgtggaagatggtgtggcaattcctcaaggatctagaaccagaaataccatttgacccagcaatcccattactgggtatatacccaaaggattataaatcattctactctaaagatacatgcacacatatgtttatttctatttgcttatttaatgtctttctggactaattctataaagtctgtaatttctataatgtgccattgaatctgcttggttaacttaatagttagccaatgacagggcagaggttttcttaaagaccttgaatcaataaggctttttgtttttaccctttgctaaggggctctgttgtgtatatcgggacatatcctcaattctcaagcaggcagttttaaactctgctatggccttcacctcctgtttttaaagagacatcaagtcaactaaaggtgagcacttagggccttcttagatatttcctggttgtgtgtacagctctgcccatgtgtatggccttctaagtgtccaggaatatattagagctttgtaaagccttcaatggacatcttattccctagattcttttacaaaggtttttgtccagccttttatttgccccagttcatattgctacttcaggaaattgcaaccttaaaaatttgccactgattatttttgacaaattccctggggagtaggacttttccaactgagcaaaccctgggacagatcaaataacaacaaatcctataaatggaacttttccagatagcttccaggcaattatttagggatggagctttttaaataactctaaacccagtctgcaccctctactatgtatttggctactggttttcacagctgctgtgattgtgaggttgttcatgttcaaagatgctgcagagctatgaagaagaggatggtcatagggcaatctaaaacagcacagagtttgccattatcactgagattcaacttttttattgaataaacacccttcgggttgctgcaaacctcttgtcaatttcctgtgttctgaataagttgatttggcaatttttttcagagttctatttgcttttctatagcagtagatttttgaaggttcttattctatcatacctgaagtttccccaccccaacacacagcattatctttgaatgtaaaaaaaaatggaagcatcttaatatgcatcaataatggaaaggctaaataagtcatggtatagcccatgtaatggaataatatgcagccattcaaaagaaggaagtagtctaggtgatgaagtaatatgtaccataaaccccatgacacgtgtttacctatgtaacaaaccttcacatgtacccccaaacccaaaataaaaatttgaaaaaaggaggtagtaagtgaaagtctgtgatagcatctgagtgacaagagaagaaccactttgcataatatgtagtgtgtgtgtgtgtgtgtgtgtgtgtgtgtgtgtgtttaagcaaggaagaagatctaaaactcactcatttgactattaaggaaataatcatttgctcttacaagtaggtaggcctagaggaaaaaaaacaaaaaggtaacctaactccaatactgccaaaaaagaaaacatgaagaatttttactttgttatctgtgtttttcggttttctaaatttactctacattttctttatattaaaaataaaataataataataaatattctttaagaaatatttgagccacactgaggttctatgtgatctaaaaatctcagattggccccatctatgttagaaaacttttctatcaaatcaaccacatctgcttcccttttcttccaaacactggatggcaacacacacaccaaaactttcaatagccaatactttgagtagtggaatgctttttgatttagggactcttttgagaatctgatgaaatcatgtgtcctatttccaaaaaaagtacatatttacattatttgtctataatttgtaagcattcaattaaattaattaatcaggttaagaactgcaaacagcatgtcttcatcaatgtgaagacgtggagaaaagggagagatctgggaacttcaagcccctatatttatacagaagagaaaaagatgcccagagaggaaaccacttgcccacaatcatactgatggtaacagacctgagccacatccaggcctccaaactcccaggtcaaggctcttcccaccaagttaccttgaatcatagaacaaatgattggcctgtttaggttctccaagactcttagaggccctgtgccaaagacaacctctcattactgtgacttctctgactggttctgacctgatttcaaggatccttgagataggaaggtagagggaaaccagacctgccatccaactggtatttactaaatttagatgttcacactgtgctcagcctgataaaaggcaccaagggttcacagaaaaagcccaagacacagacagacagttgaagatctgtcacagacagctatgaagacatgactacaaaacatcgcagcataattctgaagcaaccaggtggtacctggggtatgcacactagaccaaggaaggcaaggagaatctgatgcaggtgtgaatgtaaaggcaaggctccatggaaaaggaaagggaatcaaaggatgtgcagaaagttaaaaaatgggggaaagaatagaaggtatttggggagcaggaggagagtggacaccacatgaacaaaggcaaggagaagagaaggaggacattgatagggaaatagaggaccaggactgacaggaggtttgccagtggtttccttgcatacttccctaccccatggagcccctgcaagcagccccagctttggtgtccctgtccctgggccaaccccagaagctaactatgcctatgtctacttgactctccacagcttccctttgctgaaggtctgtaccacttttatcacaatggccttgcaaaggccaagagaagacgcagcctacaccacaagcagcagctggagagagaccccagggtgagttttccccagaaacctgcctcccaatctctgctgccatggctgagcccaccaagggggtgtggaggggctggcagggaattttgaagtaaaggcacttaatgtactatgatagggcaaatgaatgctttgcagagtcatatcagggactctctgctcctttgtctctgcataataaataatcacaggcccctttgtatggctggaggaagaggaaattgggataccacccttttactggctatcttctcctgagttattattgggtgaggacttcgggttgcctgggaacatgttttggcctgtgatggatgggaagacaacaagcagtttaatgagtcattttacggaaggtttctactggtgaatccacatgctcagaggaggttgccatgccccacgttgtgaacggaaagaatgagagagccagtcagtgagcagctcacagcaggcagtggacttctcagtatccatgcatgactgtggccatgagactatctcagcctttctttttatcctatattttctagcactgatctaatttgccttcatgtctcagctgtctacttgatgttcatcacccccatttttttaatcttcagtctttaccttgctcttggactccaggtcccattttctactccctgtgatggctcaaattcaactttcccccaatcaaacatatcatcttagcaacaaagtggcttctctcccagtgttcccacttcttgcctttcagaataggacctttagtaatcatattttccaccatcccccatacctacacactcatccaattgggtagattctgatttctgttacaagaatcactaggaaggaaagtatgtaataactcagacaagttgttctctgtacattgaaggcagcgtaacctctttctcaggactctcagggaccagctgatgaaaagcgtgtcagatgtttgagttaaggactttcacatgagattcttttgagctgatagaatctgaaaactcattcttgtggggcttttcatgtgaacatttccctgggtttaatttgggcttcaattaggaattcagataaaacagtctctcagcagattgccaaatgacaggccacaggcaattttttctttaacttctcaagagttcccaccttctctaaagaggaatttctgctctaggaagccactttaactttacttttgcagtaacaattaagctgcctgtgctgccagccaaggccaagtattcttaaaggatctgtcatagaagccggcaccaagacctaagggagaagctctctattctatgtgataataaccttggccttggctataccaattcattacctggggatacccttgggcagtcatatggacagggatcttgccctgaacccaaggtgggcaccagtagacaaagatcaccctggtgcaccgtgacatttgtcttccctacacttcaaccctatgccataaccttgccatttatggccagttgttttccttttagttatgtattttcttaaaagtcccattggctactcttcttccacgattaaaggcgttgctccaagattattcagaaacatataaactgggggcagaatgaaagagacatttaaaaggcttgggctgggaaagagaactgaggcacagtagaactcaaaagtccctgtttggtcagagagactatttagcaccactggcctgagcttttcccattctaacacatatgatctctgaaatgctgattcttgaagtatacagtgacacttttaaaatataaaatgggactaattgggtaataaaaagaagagatcagtcactggtgattctaatcatttgtctttctcttcaaaatattatctgttatcaccaaaaggggtgcctatttccccttcattatctattataaggatccaggtagccaattgcctctatctggtagttgtaaccatctgccttgcccatgaagaccaacagaaaatagcagaaaaactaaagaagaccaagtatcctatatcttttccctatcttgtcatcaaggttaaatgctggggatgttgtcaataataaactcattctaggaaaataaataaagcacaaaaatctcataatttttttcaaaacgaaaaaaaaaactgctaatgatgactgcctttttccaaaatattagattaaggtctgagtctttcctgcatgatgttctcgtggttgtctaattttggcatctgctgatagaaaaatagagtggcaactattctgaaccaaaaatcattgactatgaacagtgcaaagatagtaaactaaagattctgccttgtgggtttatagctgttaaacaaaagggtaaataagtctagagtaggaataccccaatttgggggttctcaaacacattcaaacaggttgcaaaaagaaaagtaaatgaaagaaaaagggagagaccaagtagccagaaggaggtccaggcttttatgtcttacatagatgtggcaagttatgctttataaacacagaatttaagagtaagttgttttagcattccctgaaatgtactgtctcctagaactgctaacgttaactacggttgcagccccagcccccagcttccttctccttcctgtccctgcaccacttcccagcctgtctcactcactgtctacaggcttgtggtaaggaacacaaagcccagggagggtggtctgagctgctattcgctttcagggcttcatctactgaggtagctttttgaccaaagaaacctccaagctctgctagcaacccaagaaataaaaaagaaaaaggtagaaacccaaggtactttttggctttttttgacttcagaccagaaatttcaatgatgtttgcctctcatgtaacaactaatttttatgctaaaaggaaaacagaaaaaaaaggactagaaagagctaaagtgctactttccatgtgctcatctttgttcatcaatatgcagacaatagctaagaaaacagattctgatgtagactgtgttaaagatgttcgcttctctttccagttcttcctgctaaaagattagctgactgccaagtatcatcatttagatgctaaaaagcaaaagttgtgtcttgtttatttcagtaatatctttgcacagtgagatgttcaggaaatgactgagcatgtcaaatgaatgaatgattactattttttcttcagggttttaatccatgtaatagtattgcccttctcattttatattttcctccgtatcccaaaatttgtctccattaggaaataaaagtactatatagtcttctccctagcacctcttttacatacattcttaattgtgggtaacagaaaccaatgactgtttcattacttccaagttttatcacaaagaatcccatgaagaaccagttcttaatttccaaaacccaatctgccttcttcctaatcatattcacagtcgtggtacaggcaccaaagcgggacaatgtgtctggaaggttttgataatgaaaataatttgaagaggtaataaatcaattcaacactgaaatgaaataatgaaactaaaaataccttctcaacatcagggtcaaaaacaaatattttatgcccaaaagctctgtaagatttgttcaacattagctagaacaataccaacaaatcttaaagccaaacctatcttcagtccctggtcaacatatcaaaacctcataaattctacaagtacctgaaaagcttccgaagagtagatttatttaagataatatttgcttcccagctctgtcaaaccatacttgcacatctgaaatagaatattaaagtgaaatatattttaaaaacatgaaggactcataattctatgagtaacacacactagtcttatggaagcaaaataatttaattaaaaaataacctgaacttcatttcttgagagaggttatatttgagaattaaaaacatttatttcctttactaagcaattttactagaccatacaattattcctcatttttaaacatgtttcagttttacaagtcagaaacttctatcagtccaataaaaactttccttgcttctctcatctcaaagaatggatgatatttcctttgtgttctatatttagaagctatatctttctagcttctttcttatccaaatgtatccacatgtttaataaccataaaaggcagccacacgttctggtagtgatctgtttttggtctttaagggtctattcttgaatatatctgtggagttttcaagatactgccaataacccacaaaatttagcttcactggataatataatcacttcagaaatctcataataccactggagcaaaagaaaagtttcctattctttaaaatcaactggacatgatttatatgatttgtgtgtattgtggccaaactcttctttcctttcaattatagtagttaattatttgattatttattataaattaaaagggaagagaagggaaaatgctgttatcttttggaaagtctattttcttttctttctttctttcttttttttttcctgagatagagtctcactctgttgcccaggctggagtgcagtggcacgatctcagctcactgcaagctctgcctcccgggttcaagtgtttcttgtgcctcagcctcctgagtagctgggattataggtgcgtgacaccacacctggctaatttttgtatttttggtagagatacggtttcaccatgttggccgggctggtcttgaactcctgacatcgggtgatccacccgccttggcctcccaaaatgctggaaagtctactttcaaattgaaaatgtcacggagaaaaatctcctccccctcttttgtcttgaccacaccttcctccagtggataactaatggaatttgaggtgacctctacttaccatcaccatgactgcatgagagcctcacagtctgggggctgggtaaaaatagaaattagatagttttagtgcctttttaagggatttatacccaaagaataggctgttttttatccttatacttgttaactctaagaggataaggtctgaggttgtgaggtgctgctctgagaaacatatagaaattttccaatttatcttccaaatgttttattgaaggaaaaaaataaagcatatagatttgattatattttacttattaagaaacatagtcatggtaagtttattaatattatgagaaacacaaaagggaaaatagcattttgtatttttctagaactttttattctacagggcatttgtggctgctatttcttcatattctcatttccttgtagcataaattggacaaagggtggattctgagttccccaaattctcatggtttgtaaggagacttaaccactccatggtgctgctctacactgatttgtattccataattttccctgctcctctgcacaaagagaattatagagcaggaagagtcttaaggaaacattgattcagcccttgaccttgaagcattaaaatataattttaccattgaggcaaaatagacccagagagagagaaggtgacttccctggggccacacagctataactgataggaagaaaataaaactcgtgactcctctcaatacgaagtctgatttaaataaaaaactaagtgagaattgatactgcttatgaatctgtcgttctttaaacaattgtttgcactaattagtcactgaattttctcaattaaaaataatgtgctgaaaagaagtgaagttgcctcctgagtttatgtcacttatgtgaattcagtgagctcagctataaatggaaaagtgaaaaagaagagggaaataaaaagggcggcacttgagctcactgttctgctcaatttgcttatgccctggagtggccttgaactgaaggcagctgagtatgcagttggcctcggttccctggtgaccctcacagtggaagcatttcacctttctgggggtgagcctgtagcatttaaagttaatacttttgatacaaaatatttcctaaacgcaagctgacttcttcatttgctgtgagaacaatgggacacgaccagggtccattgtgaaagggaaattccacccttgtgatgtattgagacacaatatcagtttctaacccttaaggagttttcaaagttaattttaaccatgcataagttccactttgcacactttagaattcactccctaaggcgtgattcttctaggagaaattaaacaaagatggggtcttcattttggatttcccagaaacagactctgagatgcagagttgtatgccagagacttcttggagagcaaggaagagaacactgggcaaagggagaagctgagcaaatgggctttcaacaggggcctcagtcaattttacaggaaactcagaaacaggggtggcccttcagagttaccccagtgtgaggcaaaggaaccggacctttgtgcccccataatgaccagttattggcatgggtactccctcaaaggaaacatagtcttaggtaaatcacgtcctgctaccaaaggcaattctcagtgaaagaaactctgagccacatttagcagctggaggaaatgtgtgagggccctaaagaggaaatctggagagtgcaccacagttttcattacacctgccatgcccacttcactcaatttgtctgtaaattcacatttgattcaagaggcattttctgggatctttgacctttctggaagagtggacatggcttcccagatcaggagctctccgtgcccaatccagctccccatccacccctgctgcccttttccagagattgaactgaactaagaggggaaaacatgaatctgtaggcacatgagctggaccatattttgaacacaaatagtgaagccaagagacccaagtgaaacagtttctgacctagcctcccatctgtggccaaattcattttctagataacatgccaagaggtcagcgggtgtaaaccattcatgagtgatgcaagttgagagttacttgacagcatcaggaaaaggagaaatgcaatgggggaggtatgcataagaagcagggcagaggtatcttcatggatgccccaacctgtgggaaaaattcatctgttctaatcctctgctttcagaatgtggcagggaggactttcagcatctcctctgggcattgcagatatgcctggcttcccaactcaaagagctgctgctggtgctataattaactatttgtggggaacaggggagaattatttactacagctacagaaaggcacagggaaagctgctaatgagtaagcctggtttttttctagatgctgtttttttctagatgttcatttttaaatgatgggtactgttcgtgctgtcatgcttcctaaaggaaaagtgggaactctctgggaggcatcatgctagcaaagccagagatctcttggaagttttaactttctttgggagaattcttacaagccctggtatagagaaaagttaacacagagaaaattggtggctctgtatcgtctttacaattcacaaggtgaagagtctctaatggtgggctagcaaacctttaggacttcctgggaaaatcttagatgtttgaagggcaaaattctcctgatctgcctcacctgattccctccccaaccttccccaagatgcaaaaggaaatgcatttatatatccaatgtgtatatatatatatatatatatatatatataatgcatttatatagcctctattatatcttctaaaaatgattatatgtgtatgcttattaaattcataatgtaactctcttatttagttgttggctagaaaaccagcattcattcagcaaatagttatcaagtccaaactatatacagggcactcttctgcatactgaaatataacagtgaacaagacaaagtcctcctcccagggggcttgtatactagtggcaatgaaggagagaaacaaaaaacagatgaccaagcaattgtatgaatggtggtcaaaatgctatgagaatgagtagagcagagtatgggaagagggagagccatagaggggtgtttctattttataaaaagcatccaggtttggctagtctgggaaagtggcatttaaatatagacctgaaggagatgaggaaggtattcatgtggatatctggagaaagggcactccagacagaggaaccaccaaggaaaaaggcctggaatccaagacacacctggtgtgttccaggaacagcaagaatgcgagtaaagctgcaaaggaatgagccaaggacagtggggaaggagatgaggttagagaggaaaaataaagcaagatcatgggcgacatgataagctggggaaagaactttgaattgactctgaatgagatgtggcttctgtgcctatgggcaaataatagacaatggggtagaggtatggatgagggacaactggactagagagatccatgcaaggcgattgcaatatttcagaagagaaaagccagtggcataggccaggatagaagtggtggaggcagtgagaaacaaatcagatctgggagtatgttgtgaaggtagtcttcaaattcgttgatgcatttgctgatggattagatgaggaatgggagaggaagtgagaaggcaaaggtgactcctaagttgttggcctgcattactatagaatgaaatggcacttatgcatatggacaagatggtgagaggagcaggttgatggggagtggttagggaattaagagtttagttttaagcacgttaacatttgagatttgtattaagtaaccaagtggagatgatgtgaaatgaacagatggacttaaggatctaggagagaggtcagagttggagatataaattgagaggcatccatctattgttagtgttcaatgccaggagactagttgagcttacctacgaaatgagtgtagatatagaagagaagatttgtgggactgagccctagggtactctaagatttagaagtcaaagagataactggggaccagcaaaggagacagaaaagcagcaagtaatctagaaacaggatcagaggtcaagagaagaccaactttagccattgtgttctagctcgtctacattttaccatagtaacttggccatccctataattatttcttattagaggtatcaatgtttcttcacttttcccctctctgatctatttttcaaacgctttctcaacggatattgaaatacatggttcacacatgaacttatgaaattaaaggatactgatgtgtttgggctgggtagtgtgctttaaagcagcaggaggtcacatttgactcagaatgttgagaatctagctcttaaacctgcaatcccaactaggcactaactcagagccaagaccgcgttctgcaagctgccaggtgaagttaccaggaaacagcctctgtttgacatgtcaagggaagaacctgaattgggcacctctttttaattttgagaaactataaaagccatgagaaagatcatgtttgactgtaaaccaaaaagaaaaaaccttaccctccaattaaggaaaataaaattataagttgttgttgatttaattctgatcatattttcatagatttcagaaagatatagtttttaaaagaatttcctgttaagattcaaaattttttctaggatataatttctcactcctcaaacctctgcttcaaaataaattttattcaatatttagcataaggagactataaagttccttaatggtgacataaatgaacagttataatcgtatgtctatctagctactgaatatttctaagataacgttttgtgaggcaaaagtggtttgaagttggtgatgcctcaaaaaaaattttttttaatactctttagaactctttctgggtattttaaaattggtttagctatttttcctttttgatgcctattgacatgtttgtgatcacatctctttctataaacaggtttcacggtcttaaagccaaaccaagggaattttgaaaatgagtggaattgaattcctgccatttccagtaatttcaaagctttatgggttcaggagaggataacagtgcagccaggtctagaaatgagtaaacagcagttaggcaaagagattcatgtctgaataacaacccaattgctggagtttatctaattggtttgccattatctgtaccaaaaacattgtgtttttcatcttctctacgatgagcatgtcccatttagcaataaagaacttattgcttgagagaaaacaggtaagacaaaatagttttccattccccctgaaaagggagagcagtccatcccaagtaaagaatagtttaatggatgttaatttttaaggacaacttagagaatcaacatgagaaagtttcttctcccaacagaagcaaagaaaagcaattaaaacctattgtgtggaaagagacccaaataattgtctattagggagaaaaggaacatgatagagtccaatttgaggtcattcttgagttccaatacttacactgacaccaattaactgtgctctccttgaacaaaccgttgtttcccccagtcttcagttctcttgtctgtaccatgaggagtgtggactagttagtctgtaaaatgccctctgaggtcctaaatctgagattccagggactaacctgaagcctctccaactggttaatatcaaagccacgactaaaacccagcaattctaaccagtttgtgatccttcctttacatgtctttcttttcatctgagaaatagggctttttctttaaaccaatgctataaagtgtttgcaagaactagcatttatatgttggtatcctcaacttatagaacacaatttcaaatcctgtactgttcaaaccaattcaatagtaccctaaaattccatttcttgtctcgggggaaatattagattatgagatagaggttattcatccacttcaaagataatagctcctctatcatgttttataaattgggatttggtttaagatttccctggtatcatgggtgtgaaggagtgggggtccttaaaataaaaaataatgtttgaaaacctttgatagctaaacaagttcgattctttagcctagtcaatcagtgtatccaacagggataacaagcttgatgcctacacaggccatgcaaataaattacaaattgaggtgggtcagttgtaagcaaaacagctactcaagcaagagaataaacggcaaaatgatcttctcctctgtgtgaggaacacaacagagagtggtggggactgtggtgaacctgagtgtacacaccctcttaaaaggaggaagcggattcttattctcagctaattgttacctccaataatggacgccctggttgccacatctacaattttgaagaaaagtagcaactaccaatctttgtaaagattcttttatctttttaaaaaaattagtgattaaattaaaatttcttaacacactgtccaatctaaagaaaatacatcatcagaacaaatttttccatgcactaccattttgcagtccctactctacaacaccccaggacaggatgaaacctgatagaacacctctatgactagtccgtgacttcattatttgccaaggtagtccacataaaagttcttccttaagggaattccaaagctacttccttgtagcgttggttcataatccacattctcctttctgaggccaaattaatctatcttccatgtgagaacccttcaaacatttgaaaatagttatcatgccccctggaccttcctagagtaagcattcttagttctttcagatgttttcattgaatttggcacttctttcccatgccttcctgattacacctctctgaacattactggagaacaatacattataacatccaggtctgctctgattatttcagagtagtattgcatgctcacttcccgtatctcccacattttaaaagctattcttctattagcacatcttaaaatcattttagcattttgtggaagtcatagatctcacattgattaatagtgaacctacaattagctaaaatttctaggttcttctaaaatacactcataatccatccttgaaggatcgaggtattggttctaaaacaaggaacctttaaaaaggatttattttttgaattttcatcttattagagttcattctgacctgtcaagattttattagatttggattcagtctcctttccactttcttgtcatctatgattttgatcagcatcaatatcttcaacagttcttaagaaaaaagttaaatagtacaaagaaaaatgacaaagttcagaaccctctgccaggatgatatgaatctattaatatagactctaaggagtatttcacactgaccccatattaaaaggaaattctaaagcacccaaagttctgaaaaatcattcaagttaaatgaaaaaacagtgtctcaccagggaggctatttgaagactgtttatatggcttaactccaacactctgaatctggttgatttgtgtgtgtatatggctctctgagaaatcagtttatttgccatggaacaatctaatttggtcattcacatgactaaaagtaccagaccaacatgttttcaatccagtcccttgaggcaatttgaattctgttgataacttgtccacacacctgctactgatggatgtttcgtcatgaaattttaatcagagagccaaaatcaatgggtaattgttaatttcaagggtgccaggtgacactcaagtgtagaccaaaccaaatttttataaaacttaataaagtgatttcctttaaatgagtaagtcaagatatctcagacatagattaattcagctaaggatcatattctccagagctgaaatattaactatcattgaacttctatcagtgcttccaaaataattattctaacacttattcatgtgacatgggcaagtcatttaaccttcactaattgtcttcattttatcatctctaccattaaataacaatgaaagtccaaatgactggaaataaattgccttaatttttaatccctatcatggaattacaatgaaagtgcaaatgtctgccaatacatgcctaagacttcaaagctggaagtatgactccatctaaagtacatgttaatttcacaaatacattataactttgccaaagcagaaaaggtgatagtgtcacctactccttttgcatcttcttagttctctacttgttttccttgcctgcccctactccatgaaaaatatgggtgtgaattaaatcagtgttccttaaactgtgttacgctggagtccttgggttttcttccagaacgttgtgaataataaagatattagttaggataaactagattacgctgcagtaacaaattaacttttaactcccaatggtttaatatacaaatgtttccttttcactgtgctacaagtcacaagtccagcatgagctggatagatttgattaatataatgctgttgaaagtttcaccatcttgaaacgccactatcctagcacatgaattccaggacactggaagagaaagaggaagtgaaagcataataagctctacccacttgtaaatgcctcagcttgaaaatgttacatatcactctgctcaccacccattagcgagaactaggcaaaatgaatgtcttaatgaaaagaagctaagaagtgtggttctcccatgtgctcaggaaggagagacaaactggatttggggagcagtagaagtcccttgcatagtgtattttttattcaaaacaacaataaacatgtgaataaaagcccatattctattattctgggtgatccttgggattgagactttcccataagttcagcactcatgtttataattgtattggcagcaatactgccatccagtctctggctattgagaaagggtgggatacaccccgggatgcttctgttgtcctaaaatgattggaacatctctcttcatgtgtgaccttctgcaatagggcctggctcctcctctatccataggtagagtctatttattcacccatgtgaaggctctgtaacattttatctggtagaacgtggtgggagtgatactgggccaattctgggcatagccagcccctacctgacctggtagcttctactccttcctcagagaagctaaagaattgtgattaccctgagaactccatgctgtgagtaggccaagccaggtggagagattgatataccgtggggagagagagaggccaaggagcaccaagataccagaactatgagtgaagaagccatctcagaagtggatcttttagccccagtcccaactgctgttacctggagacaaactacccagtcatgtctttcctgaattcctgacccaaaaaatcttgagccaaataaactggttgttttaagccattagtatgtggtgtaatttattatgcagcaatagataacaagaagacaaacgaattttcccagcagtgcagaggggatgagtggtggagaactgagtcatggcataaagcacattaaaatgaaccccaagacactacaccccagcagtctacagcatagtcacattgtgttttaatcagcattgcttctttggctattattgtttttgtggtgtttatatttaactcgtaaacttgtcttagttttatagttgtataggaaccataatcattaggagttgttattctatcttattttgtgcatattatttatacatatatatatatatatatatatatatataatgttgggcgactaatgaaaaatggttttcttataaaagagtccctttcttgtttaaatttattcgagtttaagaaatcaatgcatttgaaaagatctaaaagaagtaggcttttccaaagtataaactttggcatgaaacagaagcaatgcatcccttttggtgcagtgatatcagcaggtaacagcatacgtagtgagaggagaatcaaaggaagaattaggagttccgagttctaatcacagctcagccatttattgtctatgtgggctccaggtaaccacttagttttatggtcctcaatgtccccatctgtgaaatgattaatgacattacctgtgcttattacatggggttactctggcaatcaaatatgatagaaagaaaggttcgaaaactgtggacttttactattgttcatagagattcaggctagagtcttaagttttgtgctgacaaatctaaaagtaacctgactaaaaatgtgtagcaactgagtttaaaagaagctcaaataaaattatctttaaaaactcaatccaatgtaagattaaataggaaatacattggatttacattttctttgaagtataaggaaacgtgcagtctgctgggatccatcacactgcttggtctggaaaaagaggagggtgaattcagaactcttgtccctctctaaattcttgtaaccttctaatctctctggagtgtaaacttgtggccaagattttgagctctggataaattctagttttaatctcaggtccaccactcactcacttgccagttacataagtttacgttgttatttaacatctcacaaccacatctatacaatgtgggtaataataatattacttatctgaaaggttgatgtgagcattaaatgaaatgatgctagggtaaacgttcaaaagatgacagccatgaccaataatattttgttctctagcattcgattacatggtgactgatactgatctctgaaacttgcctatgtagtagcatttttgttcactgctgtcctttagtaattctacataccataaaaaaattagttatgcatggtggttttattttcatcttaccaaaatgatagtttacagttttaaaaatcaaatgcaagccttataattaaaaacagaagcattttgctccagctttctcaaatccctcagaggcattatccaccaattctttaagtgtttcttgtgctaattaactccacattttaaaataatatgtgtatgctgaaatgtgtggatttgcttcatttcagatgttgtctatgggctttcttctatggaagatgagatttaacttttaaattcaacacacacacacacacacacacacacacacacacataccatgtttatattttttctggcttttgaatatagatgtatcacaagatggggctaggttaatattcagtgttcatattattgtgagtccttaagtactatttacagctgagccatttataccaataacatcccttcctctctcaaacagctttttgtttccctgtagttaataatggccctgtgatgccctctctcaccactcctattcaacatagtgttggaagttctggccagggcaatcaggcaggagaaggaaataaagggcattcaatcaggaaaagaggaagtcaaattgtccctgtttgcagatgacatgattgtatacctagaaaaccccatcgtctcagcccaaaatctccttaagctgataagcaacttcagcaaagtctcaggatacaaaatcaatgtgcaaaaatcacaagcgttcttatacaccaacaacagacaaacagagagccaaatcatgagtgaactcccattcacaattgcttcaaacagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaactggaaaaaactactttaaagtttatatagaaccaaaaaagagcctgcattgccaagtcaatcctaagccaaaagaacaaagctggaggcatcacgctacctgacttcaaactatactacaaggctacagtaaccaaaacagcatggtactggtaccaaaacagatatatagaccaatggaacagaacagagccctcagaaataatgccgcatgtctacaactatctgatctttgacaaacctgacaaaaacaagcaatggggaaaggattcccgatttaataaatggtgctgggaaaactggctagccatatgtagaaacctgaaactggatcccctccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaattaccatcagagtgaacaggcaacctacagaatgggagaaaatttttgcaacctactcatctgacaaagggctaatatccagaatctacaatgaactccaacaaatttacaagaaaaaaacaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacacagttcatgggactgtaaactagttcaaccattgtggaagtcagtgtggcaattcctcagggatctagaactagaagtaccatttgacccagccatcccattactgggtatataaccaaaggactataaatcatactgctgtaaagacacatgcacacgtatgtttattatggcactattcacaatagcaaagacttggaatgaacccaaatgtccaacaatgataggctggattaagaaaatgtggcatatatacactatggaatactatgcagccataaaaaatgatgagttcatgtcctttgtggggacatggatgaagctggaaaccatcattctcagcaaactattgcaaggactaaaaaccaaacaccgcatgttctcactcacaggtgggaattgaacaatgagaacacatggacacaggaaggggaacatcacacaccagggactgttgtggggtgggaggagaggggagggatagcattaggagatatacctaatgctaaatgacgagttaatgggtgcagcacaccaacatggcacatgtatacatatgtaacaaagctgcacgctatgcacatgtaccctaaaacttaaagtataataatgatataaataaatagataaataataatggccctgtaaccccaacactttgggaggccaaggtgtgtggattgcttgagcccaggagttcaagaccagcctgggcaacagagcaagacctctgttgcctttttttttttaacttgctcactttcctatctccttatgtctaatttttcccctacattgtctaatagtttcctaaattttttcagtatggtcaaacgcatcccctaaacgatccattgctttatttggttgtcatccaccctagagataccatcctttgacttcacgatgtagtggttgctttctggaccagctcacacctcttaccctagcacttccttcactattatcccaggaattccctgttggctggatagtgttggattcctctttcctggaaccccttcatttccctttctcagattatttccgcattccgatgcagaatgtccttcatgagaggcgactttttaggacttttaatctgcgttcaaatcaattaatagtttgacggttatcaactattaggttgggaataaacatctctcagaaatttgcaagtgtttctctgttatctttgcctacaatggtgccattgggaggtcaagatcattctaattcctgtttcctggtattcctctttctctctagaatttgctcttagttctctgcattttgtagtgaaactcgtttctcttatttgatttttttgtttaagttcatttttttccatgaaagctatgtttctattgacatgacatttgagtattcattgcaaagctttaaaatgtgtgtggcccagtggtggctcacgcctgtaatcccagcactttgggaggccgaggcgggtggatcacctgaggtccagagttcgagaccagcctgaccaacatggagaaaccctgtctctactgggcatagtggtgcatgcctgtaatcccagctactccagaggctgaggcaggagaatggcctgaacccgggaggcagtggttgctgtgagccgagatcgcgccactgcactcctgcctgggcaacaggagcgaaactccgtctcaaaaaaaaaaaaaaaaaaagtgtgtggcccatccacatgcaaatatccttgtttctctgataaaattgctgattgtattcttgaagtgttgattcaataagtgttttcaaaacaacacttttttatttttttattttatttttaattacaaaagtaatgcatatatgcatttttatgctaaacatccaaacaaatgtagaagacaaaaaaaaaaaacacacttgttccaaatcaagcttatatcctccgcagaagaaaacactattatcaatttaatgtgtagctttcagacattttattatatgtcaacatggttatacatgcacatatggaaatagagagtttaatttttgtggtaagagttttttaaccaaaattgaattgtatagtatatactattttgcaaattcctttcttccatttagtagtatatcttagagaatttgacttataagtacacacatattgaatttttcttattaatgactgcataagattccaaaatgtagatatactatggtggaaatttctttcaaacttttcactacataaacaacattgcatgcttctttgtgcacaaatataattgtttctttaggatagctgtcagaagtgaaattgatgggtcaaatttgtgttttggtcttgtaattatgccttatcccagaatgatgccatgtggaagttagacacaggcccttgtgttttagaaagtgtggcagagccttctcaacttcagagtcacccagaggaagttataaaagtcagaagggacctatggctacatatagtgggccatgtctaataagaaggtagttttgttccagaattctttaggtagggaaatgctctaacatctgttagctctacctaagacaaatagaagattctccattaattccccaagtcaggaagtgataatgaggtacacctagtgcctgggtgtttaagatcaaaatgatagctgagtaattaattggcactttccatgtgccttttgtctttctagctggccaaataagcatatctgacagtgtgtggcaaatgataaactcccacaccaaccatgtggaggcccgtatctgctgcaaaaatcagttgttccgatttgcttttcagcaacctcagtggattgttcctttctatccactgcattttcacttgtctggaaggtctttcaagcaatatgactataatttgcaaccaaatctgatctcccgccatatttgccttctccttctttttcctggagacttctttcttctccctttaaaagcaaatatttttacttgaaagtatagtaacccaggtgaggttcaccttcaagactctccatctgaggtcaaactgggcatgtgacatttctcagttgatttaccatccacgttgactacccatctattaggcagattttggagacaacctctttgtcctcctaactgtgcaatggaattaggcttctcccttatcgacaatgaccccatacctaacttcagccttcctggaactccctttttatctaaacacttctcctggccctgatgaagaatgcagtccagaaggaaagccagtgaactttaaggtcaggtgctcctgtcccttgggagcaaacctcggtaaagactagatcccaaatgtgggtgctatatacaactagttccaccccttactatgttaccagtgttcccatggtgatgctgagaatgttacaaggacctttcactcagctattgtatcagttcaggctgcttggtctgggcatgccaataaccatatataaatgttttgtttctctttattctaattaatctgcccacttaacttggctggtatggcttctcatccctggcccaccttttatcatactctcacctttatgtttgctgccccctgttggttgctgtgaatcccagtgaatgctgtatgttagccaagcaattgcaggccatggccagcctatgcagcaagccaggtgttctgataccttttcttgcaggaatgggaatgtttctgaaccctctggaaagtgccctgccactctcacctgattctcatgcttactggtcccacctatggataaagattctctctgggaattgcagggaagctgccattcctacctagtatgatgtcccagtaagccacttgactgttgcccttaggtacctccccttccccatattattcttaatctttgaccttcccagtgccattcacacaatccataacagttctctcctaccctggaatattctctattagtctgactccacctttcaggagtttctcatggtgtatgctccactgggggcacccattttgctttctaatgcagttaaggatgtctatataggcatgtatatatttacatatatatatatggatttatgtttatatagctgtgtatctgcacaaatggcagacagacaatccctacctctctctccatacacacacacataaacacacacacacacatatgtatatatatgtatattctgcatatcatattataggatgatacatatgtatgttaatatcaaagggttcaaagaagggagaagacatgggaagtggctcttagtctgccatttgcactgagtcctctgtagctttaagaagaaatatcgatttatttcattggttgtgcttgtttttgacccaaatgttcactttagcccatggtctgatcttttcaaagacaagcttactcaagcaaagaaagaggaaagctccccattgtcacgtcaattatagataagttcatgccaacataatacctcctcctcatcttatttctgtagctcaggataaaaagataatctccaaaggaggcctaaaaaacagccacattaattaaaggaaagagattttttttttctaggaagtgcctaataactaacggacaagcaaaggagactcattagtggaagtatttcctttgaaagggcacacacgctgtgaaaaaaaaaaaagaaagggttatgccaggcttttctctttgtaaataaagtgacaccttttatctttttttctgttaataacacaggctggggagaatgagtctgagggaggcttgtagataagctggcaggatttgaagattattcagatctttagtttcttatttctctatgttctagggtaagacttttcttcattgttcatggccttgtataaagaatggttaggattggggatcttagggagttaggcttaagagtggtggcttagactccattatcccagttaactgatgaaccatttgccatgaacacctttggtaggtcatgctccatttagcaactgggcagggaatccgatcacctcaaacactacattcaaacagaaaggcaaaagatgctataaaagctagatggagagataggtggatacacagataaataaacctgatagaaagatgatagatagagatataaataagtaggtagataaatgaatagataggtaaagagactacagaataattagctaaattctgtagaaagacctaaaagggaaaagatattcacaagcgggggcattcagggtgagtttgaatctttaaggagatttcaaaaaggcacagagtgatgtctaggatttgcatgataaactggaatcttacttggagcacattttaccaacaccccataatgaaggttacacacagaaacagcctcagactctccagaaggaactgtcgaatttgatgagcacacatagagctagactaaatggatggggtgctgaggctgggcttccataccttaagtacctacgaatcatgtgagtgattaaaagatttcttaggtcaggcctaatttctaatcatctctcactcaagccagcatatggccactgtatgagttcaagagtgagcatttttttgaaacgcagttaagacttcagtttcctgcaccgaagaactaagtcactggcaacttgtcatgctagagaaaaaggcaggggacaattccatctcaggtatcatcacttcacgttgcttaccctacctacctaaatccagctagcatgtttgctcagccccacgtcagctagagtagaaattacttatccacttctcctctacacaaacctctctttatgagtacaaataaggaaaacaagcctgccaaatgacagtttgtcattgcaggagccatggccagaatccacatttcccatatctaatgagtgtgactccagccatgttcttcatttacatttatatcgttcacaggaatccatgtagccctgacttttgtgggcattgttatatcaactccacccccaccattgccatctcatctggtttgggagttaacaaagctctgtcatcttctgagtactgtgtgagatggcccagaaaggtatcattgttctcacttgggaacattgttcccactaaatggagagatggaggtttatggagctaacagtcaaagagtagcagtcacatccaggtcttcagcagcaccaggcttggccccgtatacatgaactctgactgctccatcactaacaaggcacatctaatctggaactgtgccttatgctttgctaactgtgacatacagcacactattggcaatggctttcgtccactccatccaccatcaccactggctctactttgcaggagttatctgatccattttctctgttgtttccttgtgagggagagcagacatgcacaagctattgtcaaaggacaaattacaacaaatttagtttaaagatctcgctgggctttatagcaattttagaattggtcaacacttaattccataaaatagaataagtgttccaatgagcctagcagaagaggttggctttctagacagagaatgtaattgtactaggtttgttgcccgatgtgcatggcaaatcaatatgccaagacactggattgtgacagagaagagatttaaccatagggccaccaaatgaggaagagggagggaaaatcaaatctgtctccccaaggagtttggggatagagtttttaagggttatggagtgggctgaagcatggagattgttgacggggtgaagagtacagagtgaagtcatgggacagggagataaagaaactatattctcactctgatttcattactctgtggggggtttcaaactggttggcaacaactgttttgctggaattcaggatctggaaaacaccttaagcaattcttaaacaaaagtcttgtgattttaatgtcagagatcttatctataggaacaatggggatgccagtggtcaggatcagtgctctgtgactatcaggttcaaggaagtgggtaaaagtgaaggctgattatttactcttatttataactatatttctgtccagaattcttcttaaccctgtgaggatggcttcaagaagggttgaagaaagcagaaacaaagaacaaaggatgtattcattatttttcaaagttactttttcttgtcgggtgggaacagggaaatagaacaatagaaaaataactgattagttaacatcaagtcatgtcaggctacttattttgtgtaaggaatacagcagaaggaactttattaccatgtcgattgataattaaaactgacctgcttggaaaatggctgttatttctgtctcccgatttctcagaaggctggataatgtcatagtttaggtttggtgatgtagaactttagcatgggtgactctattttgatctttagtctggtctgttgaagtctagtgcaaaagtttagtccaaaacaacaacctcctataatttttaacactgtaaatctctcactagccctgaattcttcagtagactgtattttgagctcctgctgcaggcaactgcagacagattggccacataagagcagtagccttcagaccaaagctcagaggaagtgccaaaacatgtacaaaccctggatgggttctggccttggcaatcatgagccaccattactgttaaggaattaggagtggaatagtggaattttccttgctccagattttaaggacacactcaacttcatccaggccccagcacatcacagacccacctatgagtcagtactaatggcagtactagtggcctcaaaggacatttgaagaaaaattgttacttaccagaccccaccagagctgctgagatgatcccatgtaaccctaactacagagttacctttagcttttttcagttaaattgtattttatgtgagttttaattgacacaaaatataattttgaaagcctgcaaaaaaatgcataaatgtaaggcagaaatggccaggacattcctccaaataactctgcctggaaaacaaaatcttgctgtcattactggattgttcttgttttctccacatgaacaaggtttggataatgaagtaacagctcttcctggagccccattgccaaaaactagcaataaaggaagaccttactacctaacacatgtggctacttgaaaattatctgaaataaaaacaagccagaatcaacataatagtgtataacaaaacccagatgtctcttgaataaaaggttaatcaaatgctaatgttaaacgaaagagtttcaaaggcaggaggaagaatgttagagataaatgaagaaattaggtgcagcctctgtatgacttggaagagcaagctctctgcacaggatcgtttttttgttttttttaggaaattaagcttttctttcacacctagaatgtgtcagatgctttataagaaaggcactaaatacttttccaggagcttaatcttcaaagtacaatctactaagatgtacctggaggaagaaaaatgtagcaattcttgcaaagcaatgctttggatattacctttctgccatattttggtagacgtttatatataaatcctggtttggtcaggaatccagtaagaatttgcaatgtttgtaaaagcccacctgctttgctcatgaattgcagaacagctcatgcctccctccacagcaccctctgccctggtctccatcccagtgaagggggttgtgctcacagtctgtatcagaatcagtcagggttctccagaaaaacagaagcaatagggtgtatacatacaggttgtatatgtaaagagagatatttattttaaggaattggcttatgcaattgtgaaggctggcaagtccaaaatctgcagggcaggccagcaggctggaaatgccaacaagaatttatgctgcagctcgagtccatggcagtctggaggcagaattccctcttccttaagcggaccatagtcttttctcctaaaaccataagataagacccacccatattttgagggcaatctgctttactcagctctgctcacttaaatgttaatcacatctaaaaaaaaaaaataccttcacagcaacatctaaactagtgtttgaccaaacatctgagcctcgtggcctagcccagttgacacataaaattagccacacatccagtgggcaagacagacaaagtcacaatagacatcgaaggctactggcggggactgagagaaagtggggagtctacaagggtgaaggagaggaaagcaccgtgaaaaatacttgcaaatatttattcatgaggtcgggaggcatttcagggatcttgcaccagcatgtgcgtgtctgtgtgtgtgtgtgtgtgtgtgtgtgtgtgtgttaaaatggggaggaaataagagaatgatacaaatgaagctgaggaagtaaacaggtcaaggaggggagggtggattctttcttgtctgctcaagcataggagcaagtggggtcatgcaattttattttataactagtggctaagcatccacttatcttatggaagaaggtcctcaattctccaagaaccctggtgcttcagagtcagcagtgccattagcaaccacaggtggcgctgtcctttctcaggagagcaccaatcctacaactcctttggttaagattataaccctggccagccagtattcccccaagccaccctagtgggaggcctggggagccttcctaagcccctgggctttgtgtcatacctggccataaggcttgcctgccttcatgctccagatagctttactctggtggcctcgttgcccttgcctaacacctgaccttgatgtaccctcccccagctcaccctgaaagagcagcctgactgggaatctggggatggggtgtttttcctttctgtcccagaacgccctgtcttcctcatgcaaggtgatgagctctcacccaagggctggctctgcaggctggatcacacagctgtacatgcccttccccacttcccattctaaatccacctgatcaagctggactccttcaccaggcccttccaggaacggacaactctgctctgaggagatcccttctcatggaggatgactcagcatgtcctttcatgcagcttccatctaacctctacctcagcaggtgtctgctaccctagggcacatgaggatgctcccaaagccagcagaaatccaggacagcatttcaagaaggggagaggccagggattctgcaacatggtctgtcacagaggagggtggcttcgatggacagcaatagcaagaccagagcaggtgcaattccaagggtgcaaagacagctctggatgctggagaaagtcaatgacagtgagtccctactcacctgctccaccactaatggctgcagcaatgccacggctcatgttctgggctgaattgtttccccccagattcatatgttgaagtcctaacccccagtacctcagaattagactgtaattggagattgggcctttaaaaggataactcaaatgaagtcactagggtgagtcttaatccaatataatgggtaaacacccatgagaagggcaaatttggacacagacacacagaagaaagaccacaagaagacgtaggagaggaaggccatctgcaacccacagacagcagtgtgagaagaaaccaacccagatgacaccttgatcttgaacttctagtctccagaatcgtgagaaaataaatttctgttgtttaagccccccagtctatggtactttgttacagcagccctagcgaacaaatatactggcttcaatctaaatcaacttgcagttagcaatttcaaaagactgcgtgaagctatcccaaaaggctatccgcaaaggaaagctgcgttcttgtgcagtactattaatagattatagaaggaaataaggatgacagatgttactggaaaccaccttgtgcctagaaagaagcatttcctttctctcaaccgaaggacagcagcaaggtcccagatggtgctgaataagcaagtgatcaaatatcttatcattttggatataaatcaatgcagtgatattacctctcaaactttgctcaatcacttagccttgttagattagtcaatatctaggttgaagagcaaaatgagaattggaattggccttttcaaagtcagatttgtgtacctaaaacaagccaaattagttttgcattaaaaaaaataacacagcaagtcacatatgcatatttgagggtcactatgaagctccttgtttaacaactaacactgattgtaataattgtgccactgtggttctgaatgtcaataatgggagaggttctgtggagatggggtatatgggaaccctctgtactttccactcatttttgctgtaaacctaaaactattctaaaaaatatagtttattaatttttaaaaactgaaaatagtaactatttaaaaatactttgactattcaaaaaaccaacacatcaattagtctgtatctatcaatatatatattttagagagtatcactttaaaaataaaaattacccatacccaaagctaaacatcacttaactttttttgtttatatcttttcagtgttttgtctctattttttttattttacaaagctgactttctattgtaaaatcaatgtttgttttactttcctttataatatagcttttgaaagctgcaatgtttttcattgtatggttatagcatcatttatttaacaattcctctatttaggaaaaatggccatttctaattttttgtagtaaatgagattcaaaaaacagtgtcaaaataaattctcttttgtactctttaatgtacatctgattatttgcagaagataaatttctagaagtagaattggtgcattcatcagtttgctcattgtttaggttttttaatacatctctgtcaagagggtattattagcatttttcctctgtcatcaatttggcaggtcagagatggcatcttattttattttaatttgcatgtacttgatttttagtgaaagcaatttttttccacatatttctcaatcatttatagttttctttggtgagaagacaggtaccttgagtgtgtggcttacagcatctatcacagatcactgcctggcacacagtaggtcttcagttagtgactgaattaatgatttaccctgtgttcttgtcatcttttgggaagtgctccacttttccctaaggatctgtatgatcccattttgtcataagaatatcagcccattttctaccattcatatggaaaatggtttgttctcttttctcatttaaatttctaataatcatatttgtccctgctaattatcaccatgtgcccagcctggaatgtgtactttacatattttatcttgcttaattcttaccaccaccctaggaggtggatgttatcatcctgtttactaatggaaatattaagactactcctagacgttaaataactggccctggtcatactctcaagagacagtagcacctagttctgtctgatattccataagccttcacctacagtgctatatcgcttccttttaaattatatttatgtgggatttttgaaggaggtaattgtctttgtctattttctgctgctgtggcagaataccaaagactatgtaataaagaaaacaaagaaaagaagtttatttggcctacagctctggaggcttggaagtccgagagcatggtgctggcatctggtgaggaccttcttgtgttaacccatggtggaagggcaagcaagcatgtgagatagcgagaggaaacggggaccaaactatactttcctgaggagcccacccccacggtacctaaaccatgccctcaataatggcatttatctattcatgaaggctccaccctcatgacccaatcacctcttaaagttcccacctcttaatattgttacagtggcaattaaatttcaacctgagtttaggaggggacactcaaaccatagcaataatatattcacctgcatcaaaaataatatatataggtgtgaagtttaaaaaaaaaaactccttccctcatttgctcatttttacccctacttactttaaataaccactattactaatgttgcacatacaaccttcttgagcctcttttatgtatatacaaaatatgcatatatattcttctcccatctttttacacagatggcagcacactataaacaccattgtgtacctgctgtttagacctttcttattagtacatgagcagcttccttgtttttgttgtgttttgttttgttttgtttttgtttacagacaaatgatattccattgtatgaattgattacattttagctaaccagttcaaatgttacttaacatttgggttctatcaatcttttgctataacacagtgttacatttattgttgaccacatatgcaggtatatctgtaagataaattcccagaaatagaatggttacagcaaagggtatatatatttgtaattttgatggatgctaccaattgtcctccacagcaattgcagtacttatatttatggtacttctgaggtatagaaggtttttattttatcagttagaaattgtgtttggctgctaggaacagagacctaaccacagcagcataaacagataagggttttcttttctcacagaaatggaatctggaggcaggcagtatagagctgatatgagagctccacaaagtcataaggaacctaggctcctttatttttttggctctgtcattctgaacatataacttccaatctcgagatcacaaaatgactgctgaaactctactgtcacatccctgttccagacaagaaaatcaagaaaaatctaggggtaaaaagtgtctttcataggagtccaaaaatatcattgcccacaccttttggcaagaaatattgggaagtataattttgtgactgagcacattgcagtcctcagtaatataagggttctattaggaaggtcgaatacagcgcatggatattgagtagataagcagcaacctctaaatgtgtcccatatcttgatctttttattcatagagtcctcactccaaaatcaaatacatattacctgcatttctttttatttctttcatggcctcaattttaactctaattcattttgcatttattttagtatgtagtattttaaagcattttttcttgttttagaaagaaaagaaaggccttaaagatctgcccccattccatctttccaaaagaaagaaaaaatatttctatatttataagataaaattacaaaagtattaggcaaattaattaacaatatgcatctacatggttaatctatttggaatttatttttgtgtatggtgtgatacaggaatttcttttgtagttagctaattgactcaatatcacttactgattaatttatctagacctgattgtttgaatttattatatacaaatggtttaaaatcaaatatttggattcaatttccattaagcttattgattattaggaagaggagaaattgatacctttacaatgttgggtcatacccttcaagaatatggcatatctcaatttattcacatctggtgggttcttcagcagaatatcatcattttctttatttaggtcttacatatgtcctgtaggtctagtctcaaggctcttatagctgggttattattgtgaatactttttcttattaagttttctggggtgtttttttttatttttgtttgagagtgtctagctttggggcccaggctggagtgcagtggtgctatctcagctcactgcagcccctgcctcctgggttcacacgattctcctgcctcagcctcccgagtagctgggactacaggcacgcagcattatgcctggctaatttttgtatttttagtagagacaaggtttcaccatgttggccaggctggtcttgaactcctggctttaaaggatccacctgcctcggcctctcaaagtgctgaaattacaggcatgagccaccacactcggcccttattacattttctaaaactttattgctaatacatagaaaagctatgaagtttttacatgttgattttctccagcttgctgaactcttattaattaaggcacctataaaatgattctctcaaattttctaagaagaaactctcataaagaataaataatggttatttaacttgtgttttataatatatttatatctcacacatttttcttgctgttgttttggctacaacctccagactaatgaataatagctgtcagtgtggacatccttgtcttgtttaagattttaataagaatgcctctattttgtttttatgtcctttggcttctaacaaattcccattatcatgtttcagaacattttttatgtttctaatttatacagagattaatcagacatggaaattttatcaactatatcaagtatacttgaaacatgtatccacataatcacgttgcattttcttttaacgaattaatttaataaagtgtattatatgaatagatttcttaatataaaatcattttgaaatgactagattagattttactttgtcatgagattatgttttattattctttggattcgatttgtcaatattttatttagaattttaaaaatctatattcctaagatatatttgtctatagtttcctcttctggcagccttcttctcaggaattgttcagcccaacaaatgaactggaaccttcgtgtttttctgtgcttctttacagtttaaatggcaaagaaaacatgcctcttgatggtcaatgtaactcatttttaaaatgggctggtccagtccctttttgaaagtgtatctttggggtttcaatttcttttaagcttactgtctatttaggtttctaccatttcgttagtcatttttggtaatttacatgttccttgaacgtacttattcacctcaattatgaaatttgttgttgtaaacttgtataaagtattttcttttttttttttttttttttttttgagacggagtcccgctgtttagcccaggccggattgcagtggcgcgatctcggctcactgcaagctccgcctcccgggttcacgccattctcctgcctcagcctcccgagtagctgggactacaggcgcccgccaccgcgcccggctaattttttttgtatttttagtagagacggggtttcaccgtgttagccaggatggtctcgatctcctgacctcgtgatccacccgcctcggcctcccaaagtgctgggattacaggcgtgagccgccgcgcccggcctgcagtcctcattttaaggcctgcgtattttatgcttctccagtgttttcctttttccctttctagtcttctgctggaataaccaactttactttatttctcctgccctcacacatgaaggttagacagtttcatactgaattcagaagccacaatccattttcctctgagctctgtaaaatatatcacatgttctcttagcatttggtatttccactggaaagtctagtacctgggaagctccatttgatcctccttcctttataatgtttttcccccttgtctaaaagtttataggacttttcctttatcctataaattcagaaatttcactagatgtgatttattttcagtaatcttgtctgtcattcagtgagagttaacaatctgaacactaaaacttttctgcaaatcaaaaatatgtttgcctgttttcctccatctcctctgttctcttcttctcaaactcttattacataggtataagacactctaggtctctcaacacttcttaccctcccttcctttacttctttctctttgctctgggataattccttgaattcattttcttatttattagtttggtgtttagcaatgtccattttattgctaaattaaatctggaattttaatagtttttaattgcttggagagctctctttttcctatctcttgtttttctcatagcaaattgttcatatcatagtgatagaagcatccctcacatttcactgacattcaaaattgtaataatcttccctgcattttcagttgtttcagtgaggtctgcatttatacgcagttaacacacacacacacacacacacacacacacacctctctcaagagtttaatgcatgccagatattgttttaaatgccattattaccacttcccaagcaaggagactgggcagagcctggaagccaacccagacagtctgattcagagccaggaacactctaccaccgtgcaataccagcatttgttctttacgctcagctgggtctcctatttcaagttgctacttctacagatttgtccctaatttttctatctgcctcatttttatttacttatttatttattatttatttattgtatatttatttttatatatatttatttatttatattatatatatttatttatttatttattatttattttagagacagagtcttgctctgttactgaggctggagtgcagtggctcactgcagcccaactcctgggctcaagccaccctcctgcctcagccttccaagttgctgggactacaggtgtgtgccaccatgcccagttaatgttttaaattttatttttgtagagacgggggtcttactatgttgcccaggctgttctggaactcttggcctcaagtgatcctcctgccccagtctttcaaagtggtgggattacatgtgtgagccaccgtgtctggcctctcacttttacaaataaagataatgtatccatattgataaccactgtggcctgcacccagcccctcctcaagcaagctgatagcagggcatccacaaatgtgcttgtgtgaggggtggcacagacctggggttcaagccatgccagcttctaagggtacacaaagttatagttccataacctcagagggtgcaggactctgatgtgtttcaaagccccagaatctggtgtctgtccgattttactgctccagcctctgatggccaatgagcagaaatgtgactgccagtgtaaagcagcaagacagcctaagcaaagcaggctcccttgggccacagacgtggcttggcaatggtgagtgccaagggcctctgagcaggacacagggtccgctacacagctcagcgtctcaaaaactcccaacatcccagaacaagacagagttaatcagctacataaattgagttaattagctacataaatcatgaaatataagttgttcttatctaaaattataaagaattaccaacttttaaagataaacattaaataagatgaccttttgtagacatccctactgctgacactgccaaaccactcgcgcccctctcagcacttcacctgtgctcacctggacgccatctgtttcctgtcttccagaaattcttccaacctggcctgtcaaactcagccttctgggttttccagctctgttgcatattttatcctaaatgaacatcccttcagttatttcagcagaattttgatagggaaggaaagagagcacgtgagctcaaatcaccttaaaaatgagtcttgtatttctggcagattttatgctgcatatttttaaattaattatcataattttttatcagaagaaagtgtgagaaggatttttcttggtgaagtcacttcaaccctaaaagtttgggtgaattcacggctactgtaaaggtaagccacaagcccacttacgacagctcttcacagtaagataatgtatgtctaaagatcctccattcgttggactcaaagatatttatttttgttaaatatcatatttccttgcagaccagagagcagcatatctagagagtaagctaagcttaaatgagcttcagagtggcccctttatatatttatttttaagggcatttaaaaagattaatgtatccatgacataagaatacaattataatcgtataaccttcattaattaaaagagctgacgtttaagcagagaagttagtaaacagggtattgtatgcagtggggacagccaagttcaaagtcaaaaaaggagctgtttacattagagaaatagcaaagagtccgaggtagcaagaggagaaggaagcagagagcgatacagaacagtgccagacagagacgtggagtccagatcctgttgggtcttgtaaaccatggcagtaagcttgcatttcctttgaagagggaagtgagaagatctgggatttgggagagtagtttggtaactccattgaggtggtgttggtgagtgtcaggtgctatggtggagttgcctgggcagagagagctatgcatcctcgagcatcatctggggaactaggaatggacttatcatgaatggatccagattcaacactaccgtctgaagcagcactagctcaggttgactggactgtgcacttcaggctgcaggaggggctcagggggttgccatgggtctctttccaggactagcccctccctggagcttgctcattacatggcaatggcaagagcggtttatatactttgacaggatattatttggttcagagtcatcagggttatcctcttcgtgaatgtccttccttatcaatataaaatcatatcatgtaatggtttttgcctttgagtctacttcttccaggataaacactgccacctttactgtcttattattacatcagcctgatacacctttgctcattccttcattttttgccttcctatgtcagttatttttaagctaattttttaaaataacatacaattggattttgcattttgatttaagctaaaagtatttttattttagtaaagcactttaagatattttctatgtattatcaaaacaaatacatttgctcttataacttctagactagctcctttttccgccctttattttatgcattatatttttattgctcttttccttcctcttacgctttgaaaacttaatccatctttttattcttctcatggttgtcataaaatataaacatattttaacccattttctctaattataaaatgtcaactatcaaacaatatttattatatcaatcctgagtaagatactaaattttagcacactgttacttcctctgtacttgactacttttcaattttaattgatagaggtggggtttttatgctttgctttcagccaccctcctccacagtctacattttatgactcagcttaaaaggaatggttctcaccacatagaaatggggtgattttggccccaggggacacttggcaatgttgggagacagtcatgattgtcactggtgggaaggtgggtgtttgctactggcatctagtgggaaaagaccaggaatgctgttcaacattctacaatgcacaggacagagtccacaacaaagaattgtccagcccaaaatgccaatagtgttgaggcaggaaaattccattttagaggttttgtggctcttatgataattgtaagttaatattactcattgtatttaaattatttttaccaccagtactttcatatcctcactcttaaatttttaaattcctgtttatccctcgacgggctagaaaatatttttaagtaatttttttttcaagtagactctatagaaaggaggaattatacttccctaagctgccagtatttgagcaaatctttctaacactctcagacacactcactggaagcagatgaagctattagtcagtcattccccagcctctgagaaggaatatttttcttgtagatgttttccctcatatatttgcacatgttacacttccatttgttaatcgcctgtccttatcttacccgtttacctattcctatagtctatgatgcaatacttttatgcattttagctcttgcataatgtatgtgttacaaatatttaacctataatatttaagatatcactgatacttaatatttctaatttttaatgtacagaaagtttaaaagtttatttttttaaaatttacctcactgtctcttccttcacttttttgctagaaaggtcttgtctattctgagatcaacattttcctaagtgcctcatctatttgttttcacatgcgatcattttaagccatgaggatttattttggtgtttgaaaataccctcaaattgttaagcaattctcataatttggtttattaaataattcatcctttcctctctaatatgaaatgctacttttatggtgtaccaaacacaagggcctgtttctgcagtttatgtcttgtttcatcaaatctatcttttcttaccctaaattttatttcaattattttggctgtataatgtttttatatttgccagttttccttcattacaattacttttaacaaccatatttttaattttccttgcccatttattctttcagaagaattctggagcaatttaatccagtttcaaaaaaatagcccttgggacttttggttagaattgtattacatttccaaataccggaagaattattgcaatactagatatcctcagcccatcttccatttctcttttcttctacaatttttatttctttattgtttcctctgagttctggaaatttttcttaagtttaccttttccttcgctaatccaatttttcacataatctgccattcttctggtgcaggggttttgaatgtagtaatcctatttctgttctttatgtgatccttactgatatcaaatcatttcattttggggactctcaggtctattttcataactttgggaagtagaaaaacactctttcccctatcccttgctatatgtctattttggtgaaaagcattgactaactctttggaatgaacaaagctagtcttcttagagtctagggatgtctctgtttttcctcgcagagacaggtctgtatttagcccccttgctcacagttgagagattgctgtccacatacttcaggcccagaaaaggaaggagtgaaatgctgagatttgctctggttttatttcacctgttcagagacccaggggacagtgtcagagttcaagggatggtcacaacatccagcctgactcccaccccttctgctgaggcagccatgagttagccccagcagtctccacagttcactggctacacctgccctcattagaagtccacagccctgtcctcccaacagagccatctgtgtctattgaacccagtgtgtgcactgctgtgggcgcctgttacccagtggcattgatggaattaaaatgcatctccccaaggcctggccggctgagtgacagggcatagatgggttccccagaggtccttgcccattccccagaggtccttgcccagcctatctgcatgaaatatggaagaaatgctagctaacttaaattatgcatgttgtctgatttacagcccaagtataggtttcagtttttgcatcccttttagttccttctgcagtttaggaggatgacattgacatctgtgtccaactcgctgtctctctggatatttaagaagtagaaaggtggtcaagggaaagttgaactttatttatgtctcagtttttatagtgagaatatttttatttttctcatttctcattttcatattttttagttaataaaaatagaaaggttttaaacaataaagtccaagataattcctaaaacactgaatttttcctaatgtgagttgagactttaccaaaattaccctcaaaaggagcaagttgccttcaggcgaagtcctcacaaagcctcttataatagtgtgtaatagtaagtgctctcaaaattatattactcataaaataaatttgtatttaggagaggcataatttcccttaaccttaatcaatgctaattgagctcttagggaaatgacccaatgaaataagtataaaaaggatgaaaagaaacttaatgaagatgtagtcactattgcttgggaaggggcctgcacttcaagagtggggtgtcgttgttaaaaagccttctaaaatcaatttagaaagcaagacactaggattgcagaccatcatctacaggataagcaaagagagcaaatgtatttgacgttagaaatttgggaatgtgaacttaggtcttaggataaaatttccagcactggctggatgtggatgccaagagttctgtatctcatcattttggtggaggagacattgctagcagctctgctctgacaactctgtgtgagactcaaaaagcagctggaggaggaggagggctctgatatcaaaggccccttggaggagttaggataaaatagtgtcaagaactgtgagagtaaaaaagcagtggtttgaaatcaatattccatatacataattttaaatgtgtgtgagtaaacaaataaattaatttccataaggagacatttgactgattcatctacagtccaaagagctttgatatttaagttgcctataaaacattttttggatagtcttcttggagaaaatgggatatcaccttatattagagattggagatcaccttttatttggatttttatttatataaaaatacatatattatgaccaggcacggtggctcacgcctgtaatcccaacactttgggagtccaaggcaggcagatcatgaggccaggagttcgagaccagcctggccaacatggtgaaacccagtgtctactaaaaattcaaaaattaaccaggcgtggtggtgcacacctgtaatcccagcttctcaggaggctgaggcgggagaattgcttgaactggggaggcagaggttgaagtgagctgagatcatgccattgcacttcagcctggtgacagagcaagactccatctcaaatatatatatatattattatatttttttctcctcttcaatttacatacttggtacagcagccttgaccttcacaccaagtcaaagtgtgtgaacccagaaataccaatgtttaggatgtaggcaagtaaaaaaatcacacgttttgtctaacatctctccataggctgtccctgcttaacccagaacttcaggcaaccccaggccttgagaaaacaagaatattcttattgggttacagtaggagttttgtgctcaagtcaaaacaggtgatactaaatttttcttaatcttcgaattccatgaccctatatccactcaacaactccctccaccaacccatgtcagtttctatcaattattctttgtcatttgccctgagcatgtttaaatttaccaatttaaacatgctggtaaatggtctgaaccatttgaaaacaatctgaaaaacaattttttcagattgttttgttgctgttgtttactattgcttcttatgtcccattccttgcctccaggcctcatttttcttcttactgaagcacaccccttggtagctctttcagtaagggtctgtaccgaaaacacttttggagccctttatgtccgaaaatgttcttcacatcatgttcactcttgattaatgtattagttggtaataaaattctaagttcacttcctttacctcaagaaacagtggagctattctctttatcttcatgggtagacagccctgtttcaactcctgaattcacacagagaaccaggatccaggccgtgctgtgaatgagatttgtttgaccccagtcatcagaaaagctttgaggaacgcactgtgatgttgttattcagtactggttacgaatagcatggaaagcttcagatctcacccttttcccaatatgttgttggtgttgttattcttgtctcctgtttctggttgaagaagagctcccttccttgtttttgaacatggagatatatttaatattacccttttgtatttgatctatgtttggaatgagaagaaggctcaatgtgagctcactctgacatcttgaaccagagaacttgaaaaaatttaataaatctataatccatttttctcctaaacttttttctataaattctcatcttttctcatttgaatttccccacatctctaatgtcaagttgctttttcctatattgttcaatctcttgccaggcaaagggatgggtatagctcagtgatttaaaaatatatacatatataatatatatatttatattattataatataaccatacatatctatttcatatattatagataattatatataatatatattagtataaccatatatgtctattacatgtatattatatattactatattataaccatatatatctattacatataatatataatataaacatacaatatatgatatataattatatattaatataatatataatatatgtaatatatatgtatggttatatatttttaatatataatataatatatattatattaaatataatatatattatatataatatatattatatttaatataatatatattatatataatataatatatattatattatatataatatgatataatatatattatataatatattaaaaatatatactttttttttgagatggagtctcactctgtcacccaagctggagtgcagtagtgccatctcagctcactgcaacctctgcctcccgagttcaagagattctcttgcctcagcttcctgaatagctgggactacaggcacgtgccaccccacccatctaatttttgtatttttagttgaggggagttttcgccatgttgtccaggttggtcttgaactcctgacctcaggtgatccaccccccaccccgccctcccaaagtgctgggattacaggtgtgaacgaccgtgcctggcctatatatatatttttaagtgagacctctcaatttatgactatatgtattggaggtctctttccagaaccatatatatatacataatatataaatatatattataaccatatatagctattacatagctatatatggttctggaatgagacctctcaattcatgattatccaactgggagtcttttgggaaagttacttcacctctgtaagcctcaggtttttcatctacaaaatggagataataagcataacaatttcttaaggtggttttggagaattaatgatacttggtaaggaaagtgcttagcacaaagtgagcactaaataaacattagttattttattatgacctattgtaagtttttgtgtttttattcacattatgcaggatcctaatgtctagatatatttctgccacataatagccattcaataaatacttatgaaggaattaatagcagtaacagctcaaaagcctaaaagagagaaagtaacagtatattttgagttggggagatggaatttcagcataacattctttaatcagcttttcaatccatgatttcttatctttttaagagccaattactggttaatagatagaattttctgaaacggagcacaggaagctattgtagggacactggactggcaatctgggtagaagattcttttcctcactttttcttgtttacctattttctctacttagaaacttttctgtgttgtgtaatttccataaggcaacttacacatttttttaaaatctgtgagcctgatgggataattgattttgaagtcactccttctgagttttaattgcagctcaattcttaattgtgtgaccatgtacaattgagcttatgattcagtctccccatatgtaaaatgcagataataatagatagcaaaagtttttgcttattgttttcaaaaagaagccatagtagggagagaatttttcagtacccagaagctgcgacaagaatatagttaaaagcaattccacctggcctcctattgtgttttattttgttttgtttctgactgaatcatctgctacggttaagcccacctcagcaggctgcagctcctcccagctctctctcctttcaatctcatttcacaagcctagtaatgcttccattgcctcctcctgttaccatttttttgtttcctacaggttgagattcagtacgttctaagagggagttcagtttctgctccattgaaaaataattatgacaaagcagcattttccaaaatatgtttactaataaatgttaggcaagaaaatgtttctatggcccaggaatttagggaaacactcgtataaataatattaaacagatgtctttatcttaagactatttgacattttaaatatcagaagattctgtcgcttttctgaaaaaggggacaggataagtcacttgcaaaatgaaaatgtttttttttgaggcatctggagaactacttttatgaaaggcacatgttgggaaatgttctgatggagctaaatccaaagaggatagtaagacaagagggatgattggagggaagaagggaaggaatcgtgtgtaatctggtgacaagagcagcaccatcaaaaccccaggcttggctgcaaatctcggctctctgccacttcccagccatgtgattgaaactggtcactttaattcttttacaagctgttttctcatctttaaaatgggtataatactacatctctcaaaaggtcattatgagaatttaattagaaaaatcaagcacatagcctaataagtatgctttcaagacaataaaaaacataaacacagaaaaatgtcttattttccttatgtattttttgcattcctagcatttgcaatggcatcaatcatagtaggcactcattaaacttttgctgaataaataaatgaacaaaaaagctttatcaattcactgaataggtaattaatcaaacctttgcaggtttagcactatgccatatacacaaaaactaaacaaaatattatcattgtaattaagttgaacaggatgcattttgctactgttaggcattcgcattgtgagtgctacagtcttttcttagcctgacatttttctgcaaatgtgttacttccaaaatgagggcagaatttgcatgaataacgttttggtactaaacactgtatttattaggatgaaccatttttatagggctttctaaaacacaattatatggacataaagatggacaatacaatcttatctccctttagccaaagagtattgacaatgcaatttgtgcaaagtttatgtgaattcctgtagttcctcagtcgtttcttggtttgtagataaattatcatgttgagtagattctttgttttcaacttggcattttgatttgttttcttacttgtttacttgacaccaaacaattaaattatgcccccccaaaaaaacgcataaaaataagcccttcggtgactgaacctgcatacagactgatgcagaaaaggctgaagcttcccaaagaggattgtttgaattctcaaacagaagatggtcccaggcaggcaataactgcttctgtctagtgggcattagatttataaagtgaaactgcttttctccaagtttaaaagtataacatgtaaaagtttgaccaggcctcattgcacaagtggagtgctaatgagaaatgggaggactcactgaagggaggacactgttcgcataggaacagtgactcagtgcctcgcagtacccttccctgatttctcattattgctccatctatgcaagactgggttaaaccactgggttcactaacagaagcatttccagtgactccagaatctttttaacgtcctatgtaaagagttcagagcaatacatgatgaactgcacacaaactctttcggccttggtaactttcctgaggaaatagatgtcagacctaatcacaactcttttgccattaagtcttaggggaaagtttctcttgaaactatattggtatttagaaaaagctttgaatctaaatgtcatgcatctctcatttagatagataatttgtgagggaaaatagtctggatgctattggctcattcattcgttctactaaaggtggaatgatatgttaatgtcttatcagccaagtcaacctagaaataagaatgtcaaccatgttaaattgtaagattattcaatcttatagattataattccctatagcatgcagagttatttcacaggctttatcttcttaatttgacaaattttttagagaccctacttgccaagcactgagaatatgaagttgaataaggaatagtctctaatctcaatcaattttcagactaatggaaaagtctatcatagaaacagttgttatgagctctaaaatcatagatgaagaataattaattctcattgctgaccagaggtaaatagaaagaagagtcaaatttgagctgagagccctagagggatgaaagagagtttgtcaaagcccattctgaagtgaataacacggtcataagaatgagccatggggaatatgacaaacagcctggtgtggccaaagggtggtggtggcagtggcagaagagaagcagcctgagagatggctagggccagaacaagagccataggatctctcctagtacaggtgggcttcaactatccgcgtttttacatgttgctttggcaaacttgagagaattgatgaatgccttctatcccttcaccaagattgtattgaatcctcttccatatacctaccagcagtgttctaggctctggggatacaacatactccctgatttcatagagtttacattctctatgaaacagataattaatttaaaaagcaataaataaaaatctatatatcaagaaataaatactctgcagagtattaaagcatggaatattagtcttttctcactttgctataaaaaaacacctcagactgggtaaattataaagaaacgaggtttaattggctcatggttctgcaggctgtacaggaagcatagtggcttctgcttctggggagatttctggaagcttccaatcatggcagaaggtaaaaggagagcaggcatcttccatggcaggagcaggagcaaaagaaagagtgaggggaaggtgctacacacttttaaacaaccagatctcacaagaactcattcacggggagcaggcatcttccatggcaggagcaggagcaaaagaaagagtgaggggaaggtgctacacacttttaaacaacgagatctcacaagaactcattcactgtcatgataatggcaccaaggagatggtgctaaactgtccatgggaaacccactcccctgacccaaccacctcccaccaggccccacctccaacactggggattacaattccacatgagattttggtggcgaaacagatccaaatcatattacatgataatgtgatagaagataaataggtagtacaattagaaaagatggtcagaaaaggcctctccaaagagcctacatttgggctaagacttgaatccccccaaaaaagaactaaacatgcaaagatctgagggaagagcattccaggcggaagtgcaaaggtcccgaggacagaacaaattctctgtgttttaggactagaaataaagctgggtggctgtagtgaagggagttctgtacatgtatcaagtagctattgttgcataataagccatcccacaatttaatggcttaaaacaacaatggtttatttagctaagtattcttgcatgtcattaatttaaaccgagttcagctaggtgggtgtctcatacatctatggacagctgtgggtcatggaggcaactttgctgatcttagccaggacctctagcatttctggggttttcgtgggagcatttgaactgactcaactctgccccatgtggtctcccatcttccaggaggctagcccggcttggtgactatgtaggatcccaaggagagcagaggctcccaggcttcttgaggcctaacctgagaactcacacaccaccacttctgccaaactctatcacagagtaaatatcaaaggaaatcaaaggccagcccagatttaaagggaggggaaacagactctgactcttgatggaagaatctgaaaagtcacatggcagagggagtgaatgaagtagacggagcagtggagtattgtggccattttcgcacagtccaccataaaattgaaaagattgaccagagacagatcatggagggcttggcaatctgtactgatgaagccatggaccagaagagaagtgagtcaatgaagagagtttctcttttcacatggccataaaataatagtgagggctatgacagcaaagaggaaacaaaagctgtagtgatgagtgttagacaattgatgagctgggagagaatttgttgatccaaatgcaatcttctcatccttactgtgttccagaaagttaataggaaagctgaagttcaaaaacagtctccaaaatttatttaaaaagcaatgaataaaaatatatatgtcaagaaataataaatactctgcagagtactaaaccatagtgtattagtatgttctcacattgctataaggaaatacctgagactgggtaaattataaagaaaagagatgctgggcatggcggctcatgcctgtaatcccagcactttgggaggccaaagtgggcagatcacttgaggttaggagttcaagaccagcctggccaacatggtgaaaccccgtctctactaaaaatacaaaaattagccaggcctggtggcaggtgcctgtaatccctgctactcgggaggatgaggcaggagcatcacttgaacttggaaggaggaggttgcagtgagccaatatcatgccactatactccagcctgggtgacagagcgagactccatcaaaaggagagaagaagaagaagaagaggaagaggaagaagaagaaggggaaggggaaggggaagagaaagaggaggaagaggaagaagaagaagaaagggaaggggaaggggaagggggaggaggagagaggtttaataggctcatagttttgcaggctgtacaggaagcatagtggtttctgcttccggggaggcctctggaagcttccaatcatggcggaaggcaaagggggagcaggcatcttccaaatcaggagcaggagcaagagaaagagcaaggggggaggtgctaaaacacacttttaaacaaccatatcacatgagaactcactcgctatcatgacaatggcaccaaggagtgccatttccatacacgagtcattccaaccaccacactgtccccctgataagacttgctgagacatttgctgatacctaattggcttagaaatgcaaaagtacacctctaaagatgaaatttgaccctttcccccaggctctgtctggaggttgggttgctatcacgaggttaaaaaacattgatgataataaacaatcatgataatattttcttatgtggaaattttattacctgatatttgcaacatttaaaagagctaatgaaaataataatatattaatagccaacactggttgagaacttgccttgttcctcttatcttgacctctgagatgccaaaaataaatgttgccaatccatgcatgtgcagttattcaagctatattttcttgaattgaaatataagtcttaaaaccagtctgttccctcacagcagattgatttccttgagattagagagtaggtttcatttatctttatgtatctagtaggtcatatagcatcctgcaccaagtaggccatcaaaaaatattcatggaggcagtggctgacacctgtaatcccagcactttgggaggccgaggcaggtggatcacgaggtcgggagttcaagaccagtctggccaagatggtgaaaccccgtctctactaaaaatacaaaaatttttatttttgtattacgggcgtggtggcacacacctgtaattccagctactctggatgctgaggcagagaattgcttaaacctggaggggcagaggttgtcgtgagccaagatcgcaccactgcactccagcctgggctacagagcaagactccgtctcaaaaaaaaaaaaaaaaatcatggaaaaagtgaataaatggtcttcctcagggatagaaagggtaaaaaatgttttttaattagaaagatcaacaactagagtagtttgagcccattaaacatagagcaaacctccttggacaccctccattttcatgtctgtgtataaattgaacaagataatgaaaccttctgcttataagaaaaaatgttagtttctattctgcattgtagtagattttaaaaagatttccattgaaaacatctactttttaacatttggtgctaaatttgtaagttcctgtttccgaaaaaaattcacttaagttgactaatttatttcctgataaatattacatgaatatctcatatgaatatatttctttaaaaatttaggcacctataacctgattcttatcccaatagaagcaattaaggggcaggtggtggtatcacctttaactgaagtagtaagctgttggtcttccaaggtgacccagcaagcagatgactgaatccaaaagtgggtgatttatcatgtcattctgggagaacatgaagaagttctcagcttttagaatgtaccttaggccaattacgtgcacgttgacaaagatggatgtgtcttcattatgtagtttattatggatagatcagggctgggacaagaacctacatcttgtgatcctagtacagtacatttttaggaagcacaacccccatagatgaccctacaaggagcctatactggagtgaaataggaggctgtgagttttacaagacatcaaacaatggctgcaaacttgattttataggtttagtaatatctccagggaataattctctttccctttccctacttctgtaattggtatatactctaaatgccattagacccagcttgctctaaagatctgtagggatagtatttctctctctccctcattcagtatgtgcccatgtcaggcctaactgaacacagggaccaaataaatagaagatattccattcagattttatagcctgactgctttactctgcaacctctattattgagaattatctattttgactgcaaacacgtcatttcatcaaaggttctttacaaagcagatgacattgaaaagcagcctcacatttttcaggtttagagactagatttttatggacttggaaacttggaagtcagctcaccattctggcatagtcttcctgccaagcccaaattctgaaatcagtgtgggagcaatcagtgggtgacatccatctcagagtcaaagaaacaggggacttctgattccttgtaatttctctagaagtaaatcctcttttccttgactggcactcttctcttttgagggccaataacaacctactcattaagaaccatttaacattttccaaaaatacttccaaaaccattaactcatttgatccatgtatcaattctatgaagtcagtaggccaaatattaatatttgtagtgaacaagaaagccaagcacgaagtgttcaaaaaactaacccgacaacaaactgaaaccctggatattatcaggataacaaaaaaatcacctgacctgacccccagttaggaaatttcccactgtcctatgcactgttctgcacacagtaggaaatttcccaattaggggccaggtcagatgattttttttgttattctgataacattcttctcttctagactatgagaagagaggtgctgtagtggtggagaagcgagtgtgtgtgtccccaagaatattttaggtatggccaccaagttagccctaaagaaactacaattaaactaggaaatagagcagataaactctgtgtctagaattctaaacttcttagatttatatgtcctaaacccaagtctttcccgtctcttttcaggctgttcccacaagtactgacattacttccaaagaggagaatttgggtcactaatctagcgaaagcatcttcccctctgaattcaccatcaagatgaatgctatccactagaaatataaaggaagccacataggtgatcttaaattttctagtgggcacattttaaaaaggaagacaaggcaattaaaatataattttaataatatatttcacttaacccaacatatccaaaatattaccatttcaacacatgatcaatattctaaactacattagtgagatagttacactcttattttcattcttagtcttcaaaatccagtgtgtattgtccactcacagcacacctcaactcagaccagccacgtttccagggcctcaaagtccacacctggccaggagctgacggtctagctcctgtgagtaagctagtcctcagattttataaaactctctcttcagggttgtgctcaccttccccctcccactcctgctgctcctgacctccatcaccagaagagacccccaagagcaaatcatatttttgtttccaagagggcccactgacaacactaaaacccaggaggaagcagttgacttaagaccttcgagtgactcactttgtaggaaaagcagagaaaggctggcaaacaagaaaaacataagctcatttttctccccctcatcaacctcattccccaacctgtttgcatcctgaagagggcagaggcctccaaagttgctttagagggcagaggcctccaaagttgctttctgggtcactgcggggtgattcacccaacaataggctataatttacaaggtttttctctgcaagtcaactcttgctaatggaaggacgacatgaatgttgaggctgacaggctggaagataagagtagttgtttgttccctcagcccattgaaaaatccagccccaaacccatttgaagaacagttcctaatagataatgagacacaaatcgtgtgtacctgattgtaaatgaatagctcatatgcacaaagcaaactgtaaaacctccatttctcagccaggatagcactccattaatgatgtgcttttgtttcttccaaagactaagtgctcctttccaggagaaaatagacctcaacctcacctccccacccaccatgtccctacccccaccccaaagagactgcattaccctgagtattaatatacattgcctaacaaataggcaggcaaccaaaaactgagcaattttagccatttaaaccctgtcttgaaatagcaactcactggataaatggacctaccatttagcaattttcaagatttccaacctgctttgatttcctctctaggtagttttttattttgtgtttcagcgggcatcaactttgcaatatcaggaaaaaccagagccaggcttgaaaataatgctgagacatctagactcaaacccgggacacaagtgggaatgaatcaagccgggaggatttttccaaatctacaggaagtgaaattcttctgctccaggcaatgtttatcacccatgtagaaacctcattggtttggcaattgtgagctaacagggtatggcctgagttatgctctgaatagcttacagttactgccttggatgtgaacgatttgggagggacaagtctgtgcagtggcctaaagtgaggcgtgagtttgtgcctagcttgtctgtgaaattgggtttgttttttctgcttttactacacattaagccagatgaacacaaggacaccagttgttacttttgaatgatttttaaaattacatctctagtagggaatattgatttactttattgattttttaagatcctttctatttctttagtgtctgctagtcagtggcctcaaaaattgaattttcacgtgttgtctttgccacttaacattatcagaagcttcttgaatgtttactaatagaagtgtgactcctttcatgcttgctgtgtctaatgttatttttgtgttagcaaaattgctcttcaggaatatgctgatggctaacttgcagaaatagagatttaggatagacataatgaaggacttccctacaacactggatattaaatgctgaaaaaggcttttcaattccttcctgaaataagccagggccataagcacttagcccactctatcgaagtctccccgagaaaaccctgcggctttctctgcggattcctccagcccaacaccgaggaaccagggcctgggacttctggagtccctcccaggactaattcccgctctgatgcccagcacaaatttatcataactgcctgactctctcagtgtggtgtggtggtggtgatggtgtgtgtcttcctgagtgtgttggttggggatgtggtgggaggggttggccagagagttgaataaagaggaggaaaaaaaaaaaggaattagatttttcagaactgcacaaccaaagatttgcacacttatttatagaggtgacccgtgagcttggttgaccctggatgcttttctgcgctataagggaacccgtgggtggccgatcactctctggccctccagagggggcctccctcctgcgcggaaagcgtcccggtgcacagcgcccagctcccgggtctctgtcggacctgcgactcccggcgcctttctggtgccctccacgccctccacgggcaggggcggagctgaggggcccacacagctccctctgccccaaacggggcagagaatgagtaggtgcctgcagccaggggcgcgcccatcctttcgcacacaacaggctcctgttctctaggcagtgattaagtgagaaaaagagaagcctggcttgggggtgagtctggcgctgggtgaatgtgaatcgccgacacggtctcctgcagggctgcggcgtcctggcccgtggctgtcattctgtcccggtgcttcacccccggccggtgtgaagccagtgtgaatccatggcccgcgcggacacacccgccaagcaggcacaggagcaaggggctctagctgcgtccactccccagggttaaaaattaactgtccggccttgctggcatctctgttgacaacgcgatcattcctgctgggagcgagtgcgccacagagattaactctgcctctccagtcaggccgcctgggttccactcctaagccttaccctctttaaggctcgttcttcataggtcagatggatctcagtcgtcctgaccgcatagggttgctcaggcatagaaggcactgggcacctggtgtgggcaagttgtgcctgctcagtaaatattaactaccgactcacaggacatgcctctctttttgctaccctcgcacgtttcttttctcgtttccttctccattgtcactgacccagggttggctgatataagtgaaaaacaccaagggtgccgtctgttatctaagtcatgcaaatgctttaaaattatatgtctgtgtatgtatgaatatatgtatcaggctctgggcacatagaggtgaaatatcatgtaagcaagcacttgtataattttcttcagataacaagcttgaaaacacagcctctacttgtttccttcccttccctgtctccctttctctaccagagctttctggaccatctccaaataaactacttgctctcaaatcccagtgtcagagtctgattctaagtgaatctagagtgctggcaacccagaatccttttccaggattcaggatggaatcttacaggagatacacagtcctataaaaagttagaataataacgcagcatcaatttgtgcttgatcattaagctaataatgcctcctttctccaccagccccatgtttctgatactgtgatgtgtgatgttgtagttgtgaaatgtaatattgtgatgtggcagacagattataagagttgaatgcaccaggagatttcctgtggcattataagagttgaatgcaccaggagatttcccgtgacataagtaattctcaggccctatgaagtgcaggctttaaaaaaatctggttcagcagccaaaagtcatcaaaaattaatgctagtattttctctctcagagaatgctaatgggaacatgttctaaagtccacttttctttccttccttgttttctcagctttttgagagtgccacattctctctttttgccctgacatctcccagcttcccaaacattctgactcagtcttttcttctctcccaacagatgctcctgctagctcttagttaggtaaatcaacttagcctctctatatgcattaattctctctcagttcccaaactctccctaataaagaagaacttgagagttgactcagctgtcccccagtataaagtggtgggcatgagggagagaaatgtgaattactgatacataattttccccctattaaactttattccttggaacatctttgtgaattctgcaaattcacaaagatattcatagtcctatattcatttgaattatccaaagctccttccagacccagttgacccatcttttctttccttttctcactggagtgggcataatttcctgccatttcccactgtgctgccgccaattctggctgtgtccattagtgtccctcttgacaaacttggatttgaaaaatgggcaactaaatcttcatttattagacgtgtttttcttttactaacagctgccatctgttcctctccacctcaatacaactcccccaatccctccagcatcctttttggacattttcattccagttcctctttattcatgtgcacattcaattgccagacagtttttgaaagagtagaaataagaagtaacagaaaatagaaataataataaaatactacccccaaaataaaagagacatgggaagagtttcttttttcaaaagggaacacataaacaacacatgaaaggttggaaaataacaaagaaaataattttttaaaaaaagatgtagacgcaggaaggacaattatggaatggctggaaagattaataataaccaaatagcttgagggttgcctgcagcagagatgaagagaataaatcagaatagaaaaaaggtttgcctgattctattttacagacagtctcttaaaatgtatgtgtcattcaaatttgttttgatgtgtcagtcatctccagcattcatcctgggctttggatgctacttagttgcacgactggatgtgttctaagatctgccatgcaggttatattctgatttacttgcttacagtgagctcctatttggaacatagttctgaatgccaaagaaaaccaaagacagaacacttccagctcaatttccatctataaagtggtcaaagaaaactccagtccttgaacttgtgttctagtcttttatgcactgtttagaggttctgcaggggctttatgcctgccctctgtgagagatgaagcatgttaccggctcctgatgaatggacatttaagatccaaaatgtattgaagtcgagttgtcatcacgtttttcatttgcccaagtcctatatccaaaaaaaaatgatgtttttcatcatttcatatagatgaaaaacaacattaccagcccctgtttcaaaggcaaaatgcattctgcattgtatatgagttgggtaatgtcaagtgtctgtgattgcagcgtgggagttgttttggtctgttttattttgacttaagtcaggaaacaataagtatgtttgtcattttccaaacaatatggtccaaaaccacttgtggctggtgttctttcatctccacggggcattccacccaacaatcaccatctgccagggacgcctatgaatgtcaaagttctgctaggtttctctgaagcctgcttctgctttcagcagctttgaataagctacagggccacaatttacttctattgtcatttcttcagggagatagagagaaatacatctgccactttagacaagaagcccatgggaagagtacacacacaatcagaacagccagagcaggattattcaattcagctgcaatcagaaatgggggaataagacagagaagaaaagccccatcttgttatgtgtaatgctcatttctgagccagtgtttgaagacagatcatgctttgtgagaaaaacatattttttcatcagataggatgtaatcaaccaagaattaatcattagtgagccattaaataattaattgtaaattgtaactaatttctgattattaaaatgactttttttttatacctgggctcctataattccccattttaaatagttaccaagctacgccccgataagataaagacaaaaaagttgcaataagttagctttggctatgtaacaaaccattaagacataatagattaccacaaaaagtatttattagttcactataatctgggtcaggcatttaggatgagttccgctaggcggatcttctgcttgtcttgcctggggttcctcacgcagaggcaatcagctgatggtgtcagtaggagccgattggtcttgaacggcctcactcacatttctggttttaatgctggctgctgtctgggaggtgcaagggattgggccctgtatatctccaacagagtagcccaagattgttcacatgctggtggtcaacagtgttccaagatgcagcaagacagaacaagccccagtgcagaaacatttttcaagcatctgcttatagcatgtttactatattccactggcaaaagcaagtcacttggccaggtctagggccagtatgggcaggaaatcacaagggggtgaacactgggaggggggtataaatcaaggacgttactgcaacaacctaccacagacgtatccttgaaaatgcttttatccgtatcaccagaccaaaactctagggactttgaatcatgtaagcatgtgccaaaatggatctcagctatcttcaaatccttctttggacaacttaaattcagaaaggtgacttttttgggcccaaagtcacatgactaactcaatactacattaattatgaaggtattggcaagcatctggaatcactgatatagtagtttcacttaatttttaggataggaaaatttatttataaggggaaaatctatcaggactaaagagtctagaaaatattttcagaaagaaaagacagagctcaggtgggcaggtaaacaagcagatgtaatgagggaaaaccaactgaagctcaaggtgttatgtttttcttatattattttcagattcataaggcagtacttctcaaacttcaatgtgcacatgaactgcctttccagggagaactgtcctactgcaaaaggtgtatgcccaggagacacttagctctcatccatgttgttcccagaaatcatatagaactcataggacatactctgaaacctgaattcctcctcctacagtgcaccttagggagactcgttcccttggtcgcaagacacatcctcctggaatcagtgtcttcttttcataactgcagttatccactgcagcagagaagagctgaattctcatgtctcccctccctagccagcccacttgatctaaaagtgttctgtacccaggtcaagttcctcaggcagcaccaatgtgaaagtgaggaagtgagacaggaaagggaagaaacaccataaagtgtgtgttttcaaggaaattaccagtgtgggcaactgggactcaggcttgctgagcacctctgggaaactgtggagaacatgactcagtcatccacccaatgggaagaaagttgggtgtttatccacaaactccctgtcagagaccgctggagggtgctcggggaggattagttctccagcacatcactcttccttaggcacacagctagtgagtcagagaaaagccttcaggcagagacagtattttggggtttctaaaagcagcttcaagcttgtacaggagaatgcagaaggaatatgggaaaggctagagtccttctgccttaaccatcgccggagtactaactagaaagtcaggactagcttaaatgtataatggttgtgactaaaaccaaggcaagcacatgaaaagcaacacattagtaaaacaagcaaaatgttaggcatcaaacagccctgtcggttatttctgccttttcccccttctgttgactggttgggttatgttgttgttgttatgccaaccaataatgtctcagctgccttaaataaagtatttgttttcaacattattcacccaagttactcaacaggaaagcaaagattttttccttgctttccattaggaagcaatattagttagatctggatttcattctgtccctgtcgtctctcaaaactgtgaccttggccaagttatcctccctcaacttcagtttccttatctgttaaaagacaatagcaattctgaccacataggattgcagtgacagaagtatgtaagcagcccatccatgaaaggcacacaaatgttgtcctccttcttccccactctccaatactctcctcactgctgaggattaaattcaattctacttaatcaatttatgttgaagttttactgtgtgtagactctgtcttggattacatagcaagtatagagctaataatcctttctttctaatagctttccattttggggaaagacaggcatataaagctctaacaaaatcaggtaatgataagtacttctttcaatgtgaagagcatcatgctctgatcctacagggagaaacaaattatcctctattttcttgtaatttacataacagtagttgattccataattcactctcaactgctagagtctgcaagattcccaccaactgccatcttcagcagaattgtattacacatgaaaaaacctttgactaacctctaattgattccgacattccaagaactattaaaaagagttgaaaataatctagaaactgctgacttgtatcaggcatagatttattcagacaaaacagagagacagaaggattttgaagtgagatggttttgtcaattgggcataacaaaggaagaaaaataaaaattatcgttcatgctttgaaaatctctcttgtgatgtacctctctgctacagtacctggcatttagaggtgtttaaccaatgttagggaagaaaactaacactggttaaacacctctaaatgccaagtactataacagagtactcattgatcattttattcaatcttatctactcttcaaagcccacaaaagaaacctgttgatcaagcaaagcttatcacacttcctgcaataagagagaacattgtcttaatggagaatggttttagggcctgagctgggtgatttcgaagttggtcttgcaaggcagggcacttgttgggactggaaaagtttatgaaaagtttctttgggttggtaagcatatggaggtaagggtcttgaaaggagtattgatgagtaagtcatcaatcttgataagtaagctgtttcattggtgttatgggataaactgtgcccctctaaaattcataggttgaaggcccaaccccccttcctcagaatgagactgtatttggagataggccttcaagggggtaattaaggttaaacaatgtcatatggttgagccctaatccaatatgacttatgtcttagttcatttgtgctgctataacaaaatgccattgactgaataatttatgaagaacagaaatttatttctcacagttctggaggctggtaggtctaagatcaaggccaaggccagcagttatggggtctgtcaggagcccagtctctccttccaagatggcaccttgttgctgcatctaccacagggaaggaacactgtgtcctcacatggtagaagtgatggaaggacaagaaaggtgaactctctctgatgcttcttttataagggcattaatttattcatggaagtggcaccttcatgacttaatcactttccaaaaggccccagttcttttttgttttgttttgttttgtttttcttgagatggagttcactctgtcacccaggctggagtccaatggcgtgatctcggcttactacaatctccacctcctgggttcaagtgattctcctgcctcactctcccagagtagctgggattacaggtgcatgccaccacgcctggctaatttttgtattattagtagagatggggtttcactatgttggccaggctggtgtcaaactcctaaccttaggtgatccgcccacctcagccttccaaaatgctgggattacaggcgtgagtcaccgcacccagccaaggccccacttcttaataccaccataatgggaagtaagttacaacacatgaattctgagggacattcagaccatagcaaatagtgtccttataagaagaggagattaggacacagacgcacacagagggatgaccatgtgaggaaacacagggagaagacagccatctgcaagccaaggagaggtgcctcagaggaaacaaaacatgccaacaccttgatctcggacttccagcctccagaactgtgggcaaataaatttctgttatttatagccacctgttctcacagccctagcaaactaatataatcggttcacagtcatctttttggtacttccagaaacaggagattaagtaacatacccaagattacaaagctattaatgtggagccagggttctaacttcagtctactgaactacaaaaccaagttctgcatattttaaactttcctctgaagcagaaacaaattataaatagggactaaatagaaagtaactaaagctttgttatatgtttcttcaattgctcagttttccatgggcagcacagggcactcattgctgtttcttttctacagcctccagcctaggacagcatttttgtttataagatataaaagccagccagtgttttatccaggtgagctgacactcttgtgtcccacccactgtcctcaggcctgaccatttctgggagcagagattctgtgatttccaactgccaatacctgcaactcttcatcttaggcagttcccacttggccctggttcagggcagattggaagttctgagtagtgaatgctccccaccagagaagccctcaaccaatgattgatgggagttggtggacaaataccccagttccctcctccctcacgtgggatgactctgagacatgttttctgtactattcccagaattccccaatgggattgacacctagttgtggacagtagtaacaagcctgataacataccttgtattggctgccttttctccccattgttgctttttgggattgcctcctagataaactatactcaagtctttgtcttggggtcttctggagaagctcaaatgataccaggctataaccactggctccaatctgacagtcacctcccatctccaacacctctgtatggatctctaggtttcttaagcaagaggccactttctttaacatgacctggaagagctggcatgatctggcacctacctacctattcttatcagggttcttaggtttaacaacagaagtagaatctgggtaactaatgcagaaaatgaatttattacaagggcatctctcacagaatcagattagcaagatgggaaccaggctgatttagagacgagtaaccaaggccctaccataagaaccatcgacttaggacactcctgcagaccctagcccaccttggtcctgatcaccctcttcctgctgccagattccacaacccagatactccccctactgctgaatgttcagctatcagtagcccccatggaactctctaaccagtatgtaccctcctggccctcccgaaagacttacagcctgagaaggagctgtgggcttgatatgcttaaaaagcatgctcccacagtgcatggagaaaggtctcttcccctacttcagcatctgcagaaggaaatggggatgtcccaaataatcagggtgctcaaatactgggttgccagaagacagaccccctactgcctcacagccccctcctcatcctgaagtccagccctaccaggctttgtgcagtgtcgcgaggccaccatgcttctccttgccacacagtgtgcatagaaggctcccctcttctgcccagtcaaactcctcttggctgcagaattcaggtcagccttcctcgtggaagatttcctgagaccacaaacatgtcagatcccccacaaatgcatgcacaacagctttcctttgagaaattcatctcccttgtaattgcatgtcatttgcctccctcccaagaagtcagctccctgtgggtccaggctgtctccacttttactcaccctgtgtgctcagcaccaagcagaaggtccagcacatattaggtaccaaataaatagctgttgaagagatgaataagtgaatgaacacatttataagcagctcaattttggtttttcacaaatcactacacagtttgtaaatagcaaaagacattgtccttttggcttagaggtgaggcagctcatattttcaatgagaaagatgttctctcatgacagacactaaaataacccaatggggcgtgtgatcaccttgattacatgttcccaaagaaatacttttttaataccaaatatttttcaaagtttttataaagccttccatctactcaatggtaggtcatatctcaattaactattgctacgtaacaaatgtaacaagtgtctccaaagctcagaggataaaaacaacaatcattggttattgtccattcatctagacgtgggctggggtaaactgttctagatgaggctcagcagaaagcgacaatgctccacgtgcctctcatctttcttaactactaatgggctatcccaggcatgttcttctcaagccaccagtgggctagcccaggcatgttattctcaagccaccagtgggatggcccaggcatgttcttttcaagccattagtggtatagcccaggcatgttcttctcaagccaccagtgggctaacccaggtatattcttctcaagccaccagtgggctagcccaagtatgtttttctcaagccaccaggggcctagcccaggcatattcctctcgctgcaatgacagaagcaaaagaggtcaagtggaatcacaggagtcctcttaaggcctaagcttagtcatggcccactatctcttctgcccccatgccattagccaacacaactcaacatgatcaagtccaaagtcaagagtaggttagtacctccacccacaatgggtacagcaaaggatgaaaattcaaagccaacgagcaatctacctcaatattagaggtcaggtgaatgataagaagcatttagagaagcaaacagccaaatggcaatcaagccctccatcagcgtgtatgttgtatgcctttgaaaagctgtcagagacagtacttgtcaaaactgtcaaagtcatcaaaagcaagaaaagtctgaaaattgtcacagccaagaagaacctaaggaactatgatgaataaaagtaatatggaatcctagatgagattataggtcagaaataagacattagttaaaaactaattaaatctgaataacatatgggctttaataataatatatcaacatcgtgtcattagttgtgagaaatgtaccatactaatggcagatgttaataacaggggaaattgggtaaggagtatatggcgactctgtgctttcaacatttttataaatctgaaactattccaaaataaaaataaaatggttttaacaaacacagcagtcagagatggaatgtggtttatgacagcaagaattattgcttgtctagactcaacaagttcttaaccttattacagtcttacaaatgacggatttgttatctagggaagaaaaagccctcttctgggactctgagacaaaggatttatttgtacccacctgagacgtgctcagagagggactggaggtgcatggagagggctcctgtcagaatcttcaatccgggggaggccagctgcctgggatgtggggctgcctgccctcagtccctatgcagcctccctttgggctccttccagcctcactccactgtgatcttactcttctcagtatatctgtagtcttctcatcctcccccttcttctgtctcctcatctgtgtgaaaagactggatgaattctagacccaactccaagcttctatacgtttgcagtaacacaatgtaaacaggctaacttaaaagtccacagctacaagatcatttatttttcaaaatctaattgaagtcacagctcctttcaaagaaagcactgttcacctcaaagaaggtatcctgagaccacgaacagatcagatccccgacaaatgcatgcacaacagctttcctttgagaaatccatctcccttgtaaatgctgtgtcaatcacattcctcccaagaagtctgctcccggtgggtcggggctatgtcaactttggctcacccctaagtcctcaggacacaggacataagcagatgcattttccgagggcgcccggcctaactgtaagtctcgtgaaggcaggggccaacatgaatacatcctgtatcctccaaagatttagcaaaatgctaggtcctgtgccctaccccgacccccacccgtaaataccaaggaaggaagacgccctctgccccttcccctctcctccctggggcagagcggcgcccggacctgctcgctgccatggcaacgcggcgctccctcccatagacagtgcaccctccacgaagtcaccgagcagctgctaccgctgtgtctccgccagtgccatttctgcttcctcgaattttaaattggccagaataatacaacaaattaaggtatttgctggtttctattaccattttttggtaaatcactttttccctattaatgcatgggaaagagattgccagcaaacacaccattaatttcactgagaaaaagctttaaatgctcagtcatgtttttctaatacaattcagtgcttccaaatttatttactgctgcctcaaaaacaccaagtaaatcatgcttttatacacgcacgcgatgcccatgttgagaagaaatttgctaagcggctgtgtttgttgaatcctgagcctgcctctgcacctagaacaatcccaccatgaaatgaaatgaatgcttgcaaagatttcttacttcctcctttaaagagtggtaggaaaatgaacaaagaggataaaaggaagcaagctcatcatgcattcaccaacgttaaatttccaaacggtagttacaaagcatttttaaatttaagtttcattaaagatttggaaatatattgctttttttctctgacttctcccagaaaagtttttgggatttgggaattttatgtgtaggttttccacaatggagtttccttcccatgtatgtgtgtgtgtattttaatatatatataattatatgttacacataccatatgcaatatataaatattacctaacatatattacataattatatattatgcaattatatatattataaaattatacataattttatatattgtagaattacatataattatagaattatatgcaattttatatatattaaaatacatagacaaacataatttagtacatatttattagcagtggggatatttgtaatgcagataattacctgcagctttaaatgacagttttactgatacactgtatgtttggtgagaaagggtgctatgtatggtaaacggaagaggagaggaggacacaagttcaaagtcgaaaaaggttttggagattatcttccaatctaatgccctattttacttgcctagaagatgaggaccagaggaaaaactgacttggctaacaacacacagtcaacttgtggctgagctgtgagttaaatgatgaaactgaagcaaaatcacttggatttctgcatgggagttgtcgacagtcatgaaattacactcaaagactccagtgcattcaactaaatgtcaattagtatctaaactttgccagaacacagcaaacagcagagctaagacatcctgtgggtgatcttccctccctgcagcctggcttgatgaattagagttctttggttttcagaacgtggttgctattttcttctccagctccattagcaggttgggaatggcacactagctttttaattaaaaataataataattaaaataccaaacacagtgttgactaaaaacaaaccattattcttccttaatcacttaggcttagtaatttctctttgtatttggcaaaacttcaaaaggagtaaatcaatgttaaatccaaaatttaatgactcgagggtttttggagaaaaagaaacctagcagtacatcacaataaggcaggagccagaataagtctgggctgttttacaagatgctgtgttctaccactaaaaagagggttatcataaatattattagttatatatgagctaaccccaaaacatcttgattgccttacaagtcaccttttatttttaaacttatgaaaatgttcccaattattcagaagcaagatcattttatatagagttctactgttaaaaacaaacacattctgttttattactgcaaaccctacatgtttctccacaagctttgtctaatatttaaactgaaagacttattacacgtattgaagtgcatataatgttccaaaatagacggtcaccaagtttaaaaacttcgctctctcagctaacacgtgcatatctttaacaattgacaaattacatatgcaggattgttacacaaaatgaaaattaaaaaagaaaaacaattgacaaagcgaagcatatttgcatgtattaactcatttgttttgatcttgtcctatattcctaaaagtcacagaagataatctgttacgtaaatatatggtcagtgtggaaaattcaagaagtatatgaaggaaaaacagaaatctccctctatatcgagcccctctttcatctccacaccccggaggtaatcattattatcattagtttggtatctatctttttataacagaactggccaatagaaatgtaatgtgagccacaactgtgtacataatatgaagtagccacatttctataataaaagcaaaggaaatgagagaaattaaataataatatatttatgtaacatagtatatccaaaatattatcatttcaacatgttatcagtacaaaattataatgagatattttacattgttttcttgtactaagtcttcaaacaccagtgtgtgtttcacacttagagcacaaatcaattcagactgccaagtttcaagtactcagtagccacacagggcagtgactacctatgggacaatacagctctagaccttcctttctatgtgagagagagactgtgagatagtatatcaactaagaattcttggccgggcacagtggctcacacctgtaatcccagcactttgggaggccgaggcgggagtattaagaggtcaggagttcgagaccagcctgaccaacatggcgaaaccccgtctctactaaaaataaaaaaaaattagttgggcatggtggcgcgtgtctttaatcccagctactcaggaggctgaggcaggagaatcccttgaaccagggaggcagatgttgcagaatcagggaggcagaggttgcagtgagccaagatcgcaccactgcactccagcctgggcgacagagtgagacttcatctcaaataaaaatacataaattaaaataaaataaaataaaataaagaattattttgctgccaagaacagaagtaataatcactgaaataataaaggcttcaatcagccaatgtaacaggaagtctacaggtggccaggtctgaggctggaccagcagctaacaatccaggcctcaggatgctctctgcaattgtctcaaccatcccctgtggttgtaagatggttactgcgggtccagagagcacatcttcctactccagcttccaaaggcaggaagcagaagcatagctgagaaaatgagaaagagctctttcttcactcatgaaggggaaaaaaatctttgtcagatgccccctttatatcttttgctcagaacagatcacatggccttcccaggttacaagggaagctgggtaagcagctgtctggctcttttagtctccacagtgagaatcagtcataggagatggggattgaaaatgtttaaaaggtaagcacccaaagaactgacatggatagatctaaaggtagcgctcctgactcaaacagcgttcctacttcagagctggatggactcttccagcccactccttgtgggctgtgctgatcacacttccttcataaagtatgtaaaagaatgtttcagcacatctgcagcacgttggacattattagattctcaaataaccccgtacagtttacactttcatgagtgtcaccttcattttacccagaagttaaataactttctgaggtcacagccaagaagaacctgagtcatgaaccatctattaaacccaggccttctgtctacaaactcactgctttttccattctcagctgcaatccacctgacaagtaaagaatacttcatgaaaattgaaagtataattaaagaatctcaagttgaattttatgacaagtttgaaaacccaatgtaagacccttcccaggataagctctggcatttataaaaatccaaacagccagtctgtgactgaccaccagaaaaacagatcttggggcacttaaatgatctctctactgtgaaccactcagaattgcttttattattggagagaaggtaaaaataatgacagcaatggtggttcataatcttcaaagtatttttatgcccatcatctcgtgtgattaaaaaaaaaaaaacctctgaggttggcagaagtgtgcaaccttatttgataaatggtaactaagactcagaaaagtaaagtaattgggtcaaaatcaaacctgtaggctaggaccctggtcttggatgctaggaactatgagaaagatggatatcagaagtcattagaagctcttctattatcaaaactttctcagtggtctaggcactggttataataataattatagttcacacttacagagcatttattacatgctaagcactgttctgaaccctttacatttgttaacttatttaatttcacgagaatcctataaaattgtgcatcagtgctatgtcttcataacaaactaacgaaacttgcaggtgttcacagcaatatagacagttacttctcattaacagctactaaatgactggttgaggtttggctgatctagggtggactcagcttgggatggctttgagcccaagggttgcgttaaagtttacttctgattcatacaaataataccttgcttgtaaatttcacactcaatggacctcacacacaaatactattttcttagtcctcctgagtgggagttggagtgtcttggtggaaatgggaggattctgacaagtagagaaatgccctgatagccacctctatcaaaaagccaagtggagttgaaaatagggcactggatttgataagaaagagatcactgatgaagctgtcacctgaaatctgggagggacaccatcaagcacagctttctctagggcaacagttctcaaattgtgtcccctgaaccagcagcaccagtgtcacttgggaattggttaggattttctaagaccctgctccagacttacggaatcacaaactctgagagtggggcccagcaatttttgttttaataagctttcctgaggattctgatgctgcttctaaatgtgagcaccactgctctagaagaacaccaagaaactgagctgtgcacagcattcaccattgctgacctgctagaaggttgatggttttcaccgtagcatttgtaatcttggttgtatgcaccctgcctttattttactatatatgcaatatagtctttgaagtccctgtcctaccaagagaatcctaccttattttgggctttggctgctctaaaaatgaaaagttttgaaaagcacaagtcaccctaaattggatcctgggttgttttttgatgggggcataaagaacatcattgggacaattgatcaaatttgaataaggtatagattagataatagtattgtatcaatgttaatttcccaatgttcacaactgaactgtggctatgtaagagaaagtgactgtttctaggaaacacatactgaagttttttaacttcagagagcatactgtttgcaactttcaaacagttcagaaaaaaatgattttgcatatgtcgtatgtgtagaaaaagaatgataaagcaaatgtggtaaaatgttatatttagaaaatctgaatgaagagtatgtaggaattctaaatactcttttcccaatttttgtattatttccaaattaaaagtttacaaagaaaaagcaagtagatccaccatgacttgtgctccaaatgtatgcaactgattttgcagaatctcatgcttcatgctctatcctgttttggagcataactttcctccctccaaaggaaacaagagacacctatggaaatgctgatggagcgagggtggtcaccaggcatggagcagcacaggaacacaagcttcttgaggcctcccaacttgataatcttcacagctggaaatgtcccccttccttcagaatttctctgacattattgtctgtcctgggatattattgctcatttgttagtactaagaagtagtttaagagagcagtctctggggccacttcatgtatttatggcttcaaacagccagggttcaaattctgcctcatccactttctacctgtgtgacctcaggcaagcccctgtgtcctcatctgtaaaatagggatgataatagtaacaaggattaaataagtgtaaagggctaagaaccgtgctagcacatggaagttattcagtaagtcttcactgtgctattatttccatacatttcttccttctaagtcactgcatatatatatatatatatatatatatggcttcaaatctagatagttgtgtattcatagtatgttcacaacatgttcaattcatctggcccattctctcacttcacacctgaagaagcagagacccagaaaggttaaataacttgcccaagtaacacagcttgtcagtgttacttaccagctcaagtcacttgtgcctggaatcatttctcccagcatactctccagattggggatctgaaagagcagtggagtgggcaatctacttttccagagaaggtctttatatagaaaacagttttgcctggagggagccagaaacctcctgatgtaggaataacgcctctcactagagtcatcagagtcactggaatgagaaattaccgggtaccacaggcacactgaattgtaatttatttttcaaatgtgtggtaagttgaggacactggaaatgagcatggtacaatgagaatcagaaaacagtgggttaaaatttaccaattaacttgggtatgccacataattcccacaagccgcattctctgcatccacaaagtgcagttagtggtgcttctctctcagtgtggtgacagcgatcagagcggattcttacgggggggcaatgagtccagggccacggatggccaaaaaatgttctttgcttcaaaaaaggtgatggctgactttggggcagagaaactggtggtaaagttaaggctggggagggccaataggaaggggccatgaggggtggagaacaacacctggaagaaaatgttcctgctctgagagaagtagaagacctggaaccacaggaccagtacttctcacccacacatctattgtatgggcctgggatggaaatctgcgccaccaactgaatcttcaagcaagcacataaaatagtggtatttcatttctaattacacattctgtcagtcatgttgggtttcccctgcaattaactggctctttacaaacgcattagcatatacagccaaaggcattggtttcagactgaggcaaatctggtgtaaaaccggcaactcagaaattgtgtgactttgggcaagttactcagagtttatgaagttcaatttcttcattcgtagaatggtggacaattattcagttactattgctgtgtagcaaattaccccagagcctagagaagaaaggaaaccacagttttttggctcactattttgtggttcaggaatttgggaagggcttgcggttcccacttgggatgccatatacttgcagtcagacggcagcggagattgggggggttgtctgaagactcaacagggctggatgtccaagatgtcccatcacatggctacaggctgggagcccagctgaggatcaaccataggaccaaagctcagcctctccaggaccatagcctcagggggctcagacttctttacaggctgactggcttgccctaggccaaaacacaagatgtccttttctgacgtattcttgtaagtcagacagcatcacagcatcactttgtgtgtgtgtgtgtgtgtgtgtgtgtgtgtgtgttccttgtctagtttttatttgtttgcttgtgggctcttttatttatttcagtaggttttggggaaacaggtggtgtttgtttacatgaagaagttctttaatggtgatttctgagatttggcacacccatcacccgagcattgtacactgtccccagtgtgtagtcttttatcccttgccccctcccatccttccccctaagtcccccaaagtccattgtatcatttgtatgcctttgtgtcctcatagcttagctcccacttataagtgagaacatacgatgtttgatgttccattcctgagttgctttacttagaataatggtctccagtcccatctggattgctgcaaatgccattatttttttcctttttctggctgagtagtagtccatggtgtgtgtgtgtgtgtgtgtgtgtgtgtgtgtgtgtatcatattttctttatccacacattgattgatgggcatttgggctggttccatatttttgcaattttgaattgtgtggctcatcacagcatcacctatttcatgataaatcagtggttgaatcagtcacatgctcatccaggtcaaagagaggaacacaggttctacctcttgatgagaagaatatcaaagaacttacagatatgttttaacactgtcacaattgtaataccactttataatattgttgaaagaattagatatataatcattgtaaagtattttgcatttggtgctattgttaagatttttatatttgcatatagcagggaaacaggttgctgcctctgagctggaaagatgcaggttttaagagacaaacacaggtatacaccatcctttctttaagccacagctttataaaaacctagtcactcaaacccaggctagcaactagttgaatgccattgatttcttagaggaattaaccaaataccttctctgggtccctaagatgcattgatctcctgctttcctccccagcactgtgcgaatgtcactgaatgatgggaggctgtttaaatgggtagaaatattgattttcttttctacctttttgaaagttctttgcttaccaggtgctgagcaaacatcaggcaaacggcagtccacatagaaatagatgatgtgaggagcaacaatggcagttctggcttctgaatgtgaagctggttaagcagcaggtgcccccactacacactgtggttttagattcaaaaactacacatcattgttcacacttcgtcatttgctaattgataatacagctcgcccctgtggcactaagtagcatagtggaaaatatttccaaccaatccatggaaacagctccatccgtgtctgaagagggtcgactgaaagctgagatgaactgagggccagtgacggggtaatgaggtgcatttcggaggctggggtctgcatcctaggtgtccatgtgcaaaattggttatacccttggaaatgacaacaatgttctgtcttagtctgtgtcagagatgacagataaacacaggttaagaaatttctgggtttctttgatatagaggacatccaagaaaccatgcatcaacattaggttgctattgacacccaaggaaactgatgtgtggttaacttctccgaaagaaaaagccaggggttccctcagggagccaaagggcagcagattggaaatcactcgcaattcacaccattggaaggaaaccaatgatggaggatggagaagagccctgtttccaatatgtgcttcctaaaggatacagtcccagagaacttgcctcaaagaacaacaaaggagaatccccagagagtgacactttttcatgattttgtcagatactctgaatttaagtagattactgctttcaacagaatatgacgaaaaccacagtggggcattcttgggcttgcttttcagtttttgcgatgttcttagggaaaaggtcttactgggtcaggtttgccaggctctgcccttggagcacattttcagcacttggttggaagaagattcatttaaccctcagctgtagatgagaacaggatgcagcaaatttactgcaaaccagaaaataaaattggcttttctatccaagaaggaaataaagaaaactctgccttatcttactttataaagataattcttttgttttccctgaaataaataataatcatttaaaagcattgggagaggtgtgcagtgactcaggcccgtatcacaacattttgggagtccgatgcaggaggatcacttgagctcaggagttggagactagcctgggcagtatagggagacctgactctttaaaaaaaatgtttttttaattagccaggtatggtggtgcatgcctgtagtccctgctactcaggaggctgaggcaggagaatttcttgagcctgggaggttgaagctgcagtgagctgtgatcatgccactgtattccagcctgggtgacaaagcaaaaacccatctcaaaaaaaaaaaaaagcattaggagaagagaaagagggaaataaggtctaaatgtcccctttctgcatacaatgtgcctgggttcaggtcagatcaggcaggtactggaacttgggttcaggtcaggcaggccctggaacttgggccagttgctcttacctgtccctgaactcaagcacttccacacctgcattccctccagactcaggttctttcttctgagaagaaaccttacattttttttgggggggggggttgtgtttttgttttttgttttttgtttttttgagacggagtctcactctgtctcccaggctggagtgcagtggttccatgtcagatcactgcaacctccgcctcccaggttcaagcagttctcctgcctcagtctcctgagtagctgggattacaggtgggcaccaccaagcctgtctactttttgtatttttagtagagatggggtttcatcatgttagtcagactggtcttgaactcctgaccttttgatccacccatgtgggcctcccaaagtgctgagattaccagtgtgagccaccgtgcccagctaaccttatgtttttaaaattgttgttgttggttttgttttcaagtgaactttttgcctgttctgtcaggatcatttcaggagagtagcaaccctaaagaaaactctctttttctttgacataaaacttatttttaaaaaattaaataaatacttagtgagttcctactttgcatctggcacttccgggaactcagaaacagagtgagagaggggtcattcccagggagagggatggtactaggagatgagacaggactgggaccttcctagagctctgggtgctattgggagggcaaacaaatacatgtcattcctggaatgattaggagacactggcaattcaaagggaagacaatctcaacacactagtgcgatgggtgagtccaaattgatagcagaacttccagcaaatcgaccctccttaaaattcaagatagaactcttagaaaggatataggaatgttcacatagcatcttgtttttgaagtgattttgtggcctcatcaaggaatcccgtctagttttcattaagaacagcacacatttttagggagatttattcaacaattactataacaagaccctcccctagaaagcttcttagggatacacagcacttttcagaccccatacaacagttccataaaagtgatcaaatttcacattgtgaaacgagacacgatgcagctttttaaaatgctgacgaggcatgaacaacctggtggctttcatttgctttttgacctgagcatgttttgaagtggaggagacaagtgaacaaagtgaacagaaatcagtgaactccatcagagaaccacggtaggcttgttcacaagctgctgtgagccaccacgtcctgggtttctttgttttgcagcaacagtagctggaacacaaacattgagctcatgatccgtcgacatttcctcattggctttggccatttagcattgcaggcccagcccatgttgatttttttattcctttacaattaaaatgttttggttgtttttgttgttgttgtttctgcttgaaggcttctggaattttgtctctatcactgcaatttaaatattccctggaatatggctaaatacagatctcatgttattaatcttgcctagagtgaagtgagcctttcattctctacactgaagtgttttgcttcgtggcttttccaacggttctgtttatttgtttgtttgttttccaggaatattgttaggaatattcccaagctgaggagctggtacacactgataaatctggaactgcccagctcccctgtcattgctgccctcggtctaaggaccagcaatggaaaagagtagagtggcctcctaactatgcatagactatgggctcagtttactgtagattacagtgaacactagcaatggacatgtcataagttaatgctttgaccttcggattttaggacctaagactcaacatttgccttttataacatccatgcaacccacccctgcctgttatgtgacgcattccccctctcaggcctaagtttatagctctctggctataaattcctaagcatggggtctaccccaaatgctggcatcactaagaacaaatgggacaagaaaacccaccctttacttctacctcctgaggctcctcagtaaggagatattgaagcttttagagtaaacacacaggcggcatggaggaagagtcatgcaggtccccatgaaaagatatctgacttgagatcactcccatttgatagcagtagcatttgctgttgagaaggcattcagaagtattcccatcccccaaactaactagctttattgttgaatctgtttctctgctctgtgtcctacacgcctataattttccccttttgacattttaatctctttctggtaaaactgctaaaattcacctgtcattaccagtccatttctgcattgtgaattctgctctttgctgctttcaaaccagatttaatttgggttttgtgctgggcatcctcttcttgtctctatgattcttcaatttaccttttgttcctttttaccttttgtatcttttgtttaaaaaggtaaaattcttcaattttactgcttatcttgtgtttttttcctctccgtcttacggatttgggctcctattttgttacaatcttgatgtacatcctaattaatacaccaaggaatttcttctggttcttacgcttagttattttgcagtgcagtgtttttccctgaatcttcagcagaatgttcccctcccctgttccttgcatttttcattccagctctcctatgtgggcttcttttttctggcttacttatttttaaatgagataagctttacccaaacccagaattcaccaccagactcactgctgggttgtccctgatctgtccattaactaagtcacctcctgagagatagcactggaagagcatagttctttgccaaattcccaatgtttaaaggattggccgggcgcagtggctcatacctgtaatcccagcactttgggagactgaggcaggtggatcactttgaggtcaggagttcgagagcagcctggccaaaatgtctctactaaaaatacaaaaatgagctgggcatggtggtgcatgcctgtaatcccagcaacttgggaggctgaagcagcagaatcacttgaacccaggagacagaggttgcagtgagccaagaccgcaccaccgtactccagcctggaaggcagagcgggactgtctcaaaaataaataaataaaataaaagattgcagggtttaaattgaatctcttcctacccttactgcatatttctctgacattctgaacaaataagtgattaaaaaatgacaatccaccagggttcttatgtttccactcacacacttgaaagttgtgatttatagctcccgaagtgaagcgggccgcccccagtatctacctcctttccataagctgtgtattttggaaatgtatatgtctacgtattattttatgtttaccctttcaaagaaggggtcttgctgaaaaattcccttgttttcaggaaccctgcagagatggaccgtcaaatgtgtttatctattcagccgcactgaatagctacactacttagcagcaattcttttgaattctagcagcagatggactatgagttctgcttttcatggcgtgtcttgagtacttcagtgagaaactcaagagcactaggcaaggagttagtatccagaagcctctttcagaaaaatgattctggcagaaaactgtttttaagagggacagacacaagagtagaataaccacatgtgctctcaaaagtcagacttgtttacagaaaaatctatctccacaactttttttttccacagtgttccatgaacatgctccagggccacctctcaatactcacatgtgcaatatgcatttttgcatctttccaatcctgtccagcctgcttcagctgctgttcagtgagaaccatgtgttcccaaaactgtaagtttagcctggccacaggggtaattgattttctttgatttgtttgtatgaagcactatccagtcccattttacaagaaggagaattggagtagacagtttaaggagtggactacatactgtaaatgttcttgagtgataaggtgtgtgtcacacccagcaccagcaaattacacatacacacacacatacagcaaaattagcatcattcagaagttcttcccacacattccaagaaacattgttgagatggtgttattattccatgcttacttatttagaatgcatttagtgttaagcaatctataacgctcttgtttgtttctttgcttgtttgtttgtttgtgacagagtccttctctgtcacccagactggagtgcagtggcgtaatctccgtgcactgcaccctccaccccactgaggtcaaccaatcctcctacctcagcctccctggtagctgggactacaggcatgtatcaacatgcctggctaatttgtgtattttttgcagagatggggtttcaccatgttgtccaggctggtctcaactcctggactcaagcgctccacctgcctcagccttccaaagtgctgggattacaggcatgagccaccaggcctcgcctataaagctctttaataaacttttttttttttttgagacagggtcgtgctctgttgctcagactggagtacagtggcacgatcatggctcactgcaaccttgacctcctgggctctagtgatccccacctcagcctctcaagcacctgggactataggtgcgcaccaccacacctggctaattgttttctttttcttttcctttttttctttttttttggtagagatagggtcttgctatattgcccaggcttgtcttgaactcctggcttcaaggaatccttccaccttaacctcccaaggtgctgggactacaggcataagccatgcacctagccaacaattattttttatcacaacacagcgaggttcctgctataattatcctgactttacagatgagaaaacaaatgtacagaaagcttaaaaaacttgactaaggccaaacaactagcaagtggtagattcagtatgtgggcctagacagtccttctccagagactgactctcactatccctttattcagcactctctgtattgcatgagaaaaaatacatgttgcatctgtagctgaacttcatacaacgcacaccaactacatttgggagacagattcatttatttacaaattcccagtggccaccaaaacatctgatagttaaaaagcccatcttaaatgtttgtggaaatgaatggaattggatggttttagtagcttcaatttgactcatctaagaaaacagtataacccacatgtagctgtcctcctgagggtggcctctgttttcactatctgccagccatgaaacagggctgcttcatccctgcacagatatcttcagtagaacttgtcagcaaccaacctcacttctccagcatgaatattagctctctctctgcatgcgggaggcagaataatgaccttctcaaagatgcccacattctaagccctagaacttgtgaatatgttatgccacatggcaaggtggggttaaggttttagacgaaatgaaagttgttaataagctggctttgagacagggagattatcctgaattatctgaatggccccaatgtaatcacgagtatccttacaagaggaaggcagaagagaaagtcaaggtgatatcatacaagaaatatttcatccactgttgcgccgttaatgatggagaaatgggatcataagccaaggaatgaggaagcctccagaagctggaaaaggcaaaaaaagaatccctgccccctacaagagcctctagaaggagcacagccctgctgacaccctgcttttagacctctgattcctagaactgtaagagaatgaatttgtgttgttttaagccactaagtcggtggccatctgttacagcagccacagaaaactgcccactgcaggatgaaaagccactttctcctggtatttctcaaaggctaatctaagagcatggattgttctgtatcttccaggagcactattgcaaagtcgattcattacttttttcatttgttccgcatcaccgtgctggggctcattaacgccctgtcatcgggtgctctgtgcgtaagtagaagtgtgttaagaatcaatcgctctgacctttattccctgttggtgttttgtcattcgtgggctgcttggcttgacatatgaattactctccagctgcctggtgctggggaggcacagtcaccagcccccaaatatttcagacatatgccaattgcaatttcaacacacattttttttctaccgtcaccctggaactgttccattggcaatgcatgaaatatgaacaagaggaaataattgacaaggcaccactgttgactaaggggctaacctttgaggaagattaaaaacagatgtccttgaagaagaaagaactgaggaagtgaatcttctctcctcttaactctttagttcattgtcctcatccaaaaattaaactaacacactctgaagaaggtttaaggagatcaggaattttcaagaattcatttgtattctgtagcagacagcttgtttgttccccattgaaaacctacaagaaacaatactgcaacctttgttatagcaaataactggtgggtgtatccctccatgccaaacacatgccaagcataaaaaatgtgcctagaaaaacaaataactttggaaggctcttttcccagtgccttcttacttcctttgtcttagtcctcctttctgtgatggtgcccaacctaagccctggatcctttgctgttgatttcagtagcatttctccctgacttgcaggaaactgcccaaggctttcaaaattaccttttccataaactcctgttccttcctcgaacaatctcaaccagcatctttgcaaaaagctgcctaattaatgacttcatgcacaagtgtgggtaagtgataacacctggatgtgttgcccttcccagaggacttgttttccaaatcttttcaaatagagacataatcagcctggataatgagtgctcaaaactaaagcttaacccttcatggcaggagtgtggtcagtgtgcgtgtgctcaggggaggtgatatgggtcattggaggctttctttgtgcccctcaaatcacatgatttgtactacccaaatgctgcccctgcttccactctgacgatgaaatgatttcatgaatatattgaccattataattatagccagtgacatttatagtatgcttcattattctcaacaagaaaagtttatttcatgtcatcctcaccaataagcctgtgaggtcaagaattccatcatgtccgtgctatacaccagaaatcaacaaactttctgtaaagggccagagagcaaatatttcaggctttgaggccatatggtctctgttgcaattactcaactctacggctgcagtgtgaaagcagccataggcagtgtataaacaaatgggcatagctatgttccaaaaaatttatttacaaaagcagtcagcagactagacttgccaaacccatggtctggatgaagaaagcacaacctggagaatttgaggccctacctcagaacatgcacaaatcagaagcaaaccacctcagaacccaaacccagttctttcttacttgaaattcggtgctctttcactgaaccacacggtttggggcatagtctttagcattcaggagagtcatgactttggatcaaatcaagaatactctccacccacccatctcccccgttttcatcacacacacctgtaaaggagcagctggggctggggtaccatcattagcctgtggccatggaaacagagtcaaggtaactgacccacaggaccaagacacatgaccttgatgctattagctctttccattgaagcttgctggccatatacagcataattgaatgaaactgcagaacttcttcagtcagatccacctgtgccttccagaagcacattaatgaggcccccctccggcacagaatgggaactaggcaatccagacacatccccacccagcatcctccttctggttcactagcagaactggatcatgaatcaacaaaatgaaggaggctttgcaagaacaaagcttttggaacctgtattcctgggtggtgctggagccattcattcctagccaggtgccatgagcactttctctgtgggcgctgttggctcccctttacctctcacccccaaacgcctttccagggaggtgtagtgctgagtgcactggtcagatgtggggacactgactgttcacagctggagtgaagagggacagagacttctcctcgtctccccaccatccttctgttcctcctcccatttgtcctcccaggagctctccttattagactgaggccctttagcctgcctgcaatggaaaacagagccattcacctggcccaggcaggctctttggggtgctacaatgtgcatggccaaagctattcatgtattaaagaggcttagctagctttgcttctttactgcacttacatctcaggagacactcattgagaggaacatgtcattttggccaagaacagcatttagggactttctagcttctctggaaaattgtcctgtcaagtacaccccagtctaaccattcctgccgtaatatctggcatagagcctccatcttttaatatccttttccttaatataatttcctaaatccatctcctaacattgccccaccaccctggaaacaagcatagccctggctgcaatgcacatgttccaaccaatatagaagctgagatttcactttctcggggttctcgttggctgccttggcacctcgctccacaagaaacatctttgatccctccctaattacattgatttatctcacggtataccttgtatccagagctttagatgatagatagcaatttgttaatacttgtcactaagactcaatgactggaactgtggtcagaggcatgcagccatatcctccctcctcaattgatcatctttattcttgcaagatggtccaacctctctaaatgagggcaatcaatactgtgcattcagccataatcgtggcttaacttggtattctttgaaaacttaagctgtgtaatttgcctgtaattgggctttccaaaaagtcatatctcctgctcaaggaagcaattaagccggcacactccctgtctgctgcctgctccctccctcctggcatctgactgccatgggccaagtcttccctccgcagacctctctcctctccagatccctgtttggatctcgacaaccaaagccagcagttggcggcaaagcagatgaactagaatatctgagccccttggagaggcctttttcttccataatctcccacatcacttccatcaatcgcttttgggggtttctcgcttgatgagctgtgtccagctcatcaattcaaacactgagataacacaccgcattgcaaaggcaaaggcagaaaagctagagccccaacagtgaaccctcatgtaaaccatggaccgtgggtgatgacgatgtgtcagtgtcggttcagcacgcgtaacaaatgcacgctgtgctccagcagggatgttgataataatgggaaggcagtgcatgtgaggagacagaggatatgtggaactctctgtgccttcttctcaatttgctgtgaacctaaaactgctgaaagacacatagacgaaagaaagaaagaaagaaagaaagaaagaaagaaagaaagaaagaaagaaagaaagaaagaaagaaagaaagaggagagagaaaaaagaaagaaagaaagaaagaaagaaagaaagaaagaaagaaagaaaggagagagaaaaaagagaaagaaagaaagaaagaaagaaagagaaagaaagaaagaaagaaagaggagagagaaaaaagagaaagaaagaaagagagaaaagagaaagaaagaagaaagaaagaaagaaaggaaagaaagaaagaaagaaagaaagaaagaaagaaagaaagaaagaaagaaagaaaagaaaagaaagagagagagaaaagaaagaaagaaagtctaacaaaaagatgtggagacatgcccctcatgcagatggggacttgtgttgcatttaggacacacttaggaatggactccagctggcttctcttctcacatttgatttgctttgtcttcagttagctaagagcaagaagattaaagtccaggcatctgggcagctttggagtgagatgagcctagcttgaggtgttttggaacaagggaagtcactaccccactgcctttctacattacaaaaacattagcaaaattatagaagtaactgctggcatttcttgagttcacacagtgggccaggtgcttatatgcaccatcacttttgatcctcaccacaaccaaagtacacatgggagtggaggagcagcacagtacgctagagaagtacctagctagactgctggagtgtcgtgtcagtttgcgaaggctctcatatggggggccacagccagggtggcttaaagaacagaaatgtatggaggtaaaagtctcagatgaaggtgtcatcagggttggtttcatcagggccatgagggaaggacctgttccaggctctttccttggcctgtagatggccgtcttttccctgtgtcctcacaccattccctctgttggtaacagtgcctgaatatgatgacaccagttatattggatgagaccccaccctaatggctttaattaatgacctctttaaagacactatcttcaaatgcaacctcattctgaggtactgggggtaaggacttcaacatttgaacttagagggaagagagtccagcccacaacaggcatgacccgtggctctgcccttggctaaccataggaccgttaaccagccacttggtgtcttcatgccttcactcctaacctctcatgtggttgtcggggaaaataactgagataatgtacatgagtactcagggcactgcccagcgcaacagtcagccctcagtaagtgtcagccatcactagggtttatccttattttacaggtgagcaaactgagtcttaaatgggctccacagcttgctggagaccccacagccagagaacaacaggtatagcagggcctgtaactcatgtctgcctgtccccaagaccaagctctcatccacaatcctatgctgcctccttcacaatattacacagaaggcagctgtgtgcctacaaagaagtcaagctatattcccctttctgtgagatgaaggatacacaacccaatccatctcaattcttaccagcttcccaaagcgtgaaacgaaacttcccagccctgcctctaacaccttgtgagaggaagaacttactctgtcactatctggtgcccagctctgtgagcacaccccagaaatgcctcagatcctctaccctccccaggaagataacagtgacaaggatgaccaggccagggcccagaggtaacttctatcttcagccctaatcctgtgtcccatatggatgcgtcctcaagcccatccatgggtgttagagctaaagtgttttaacctaccaagaaaaaaaaaatcctcagactataataaaggcaaggtatcttaccatgcaaattaagaggtttttcataaataaaagattcatgctctttgggtacttttgctacatttttaatacttcctccagcacactggctcactacgctggctggtcatttgaattacctggaaagttttaaacaccgctgaggccagggcccatccctagcaactctcagttccctgctctggtggttggcctgagcacagggcttttgccaccttcccaggtgattgcactgtgcagtcaaggctggggacctctgcttcgcgaggacaccttgttttcttgtagtgatgttaactccagtctctgcctcctccatctccacatgcctttcactctgtgtgtctgtatgtcttcacatggcattctccttgtttctaggccctcttagtataatgacaccagctgtattggattgagaacccatcctaatctagtatgacctcatcttaactaattacacctgtagtgaccctatttccaaataaggtcacattctgaggtactggaggttagcgccttaatatatctttcaggacagcacaatccaacccatcatagtggtaaataaaataattctcagtggcacaagaaataattttacacaatcaaggacatcatagattaataaaccagtatttttagcaacatgttagttttgtgttttatgctccttttcttgctctcacttcaagcaaagacgtccctcaccatctttggagcaggtttcccctttgctcccctttctcctggcccctcccaccccagcacagtcaatgctaattaacagctgtttaattatcagcccagcagggaagtgatcatggcccaggtcctcagagagttatatgcacagttaagttgtcccagatactggaagattgactgtgttatgtgcccatagggagaggcaatgcggcttagtcgaaagttcatagcattgagaatccatcaacctgatgactctgccatgttttaactgttagacaatggcttccaaacctttttttcctcaaccgtaacaataccaaccccacagttttgttgggaagattaaggccaggcgtggtggcttatgcctgtaatcccagcactttgggaggccgaggcgggtggatcacctgaggtcaggaattcgagaccagcttggccaacatggtgaaaccccatctctattaaaacaaaaattagccaggcatggtggcgaatggctgtagtcccagctactcgggaggctgaggcaagagaatcgcttgaacctgggagtcggaggttgcagtaagccaagatggtgccactgcactacagcctgggtgacagagcaagacttcatctaaaaaaaaaaaaaaaaaattaatgtagtaaaagtaccttgttaagtatacaatcatatgcaaatgcacagggatgttttctgcttcatcttagcatggtcataactggcacatcatagagagactagaggtgggtaagggatgggtagagttgcttgagcaacatttgtgcacaaatgtcaaattaaggttcaaaagttgaactggaattgtgaaatagccatctgttcattttaaagaaaatattaactagtaccaattctatgaatctattccaaaaaatcaaggagactcctctctaacttattctacaaagccagcatcaccatgataccaaaatctggtgaagacacagtgaaaaatgaaaactacaggccaatatccctgatgaacatagatgtaaaaattctcaacaaaatactagcaaaccaaatccagcagcacatcaaaaagtcaattcaccacaattaaaaaggctttattcctaggatgcagttagttcaacatatgcaaatcaatatatgtgatcatcacataaagagaatgaaaaacaaaaaccatattatcctctcaataaatgcagaaaaaacttttaataaaatccatcatgccttcaagaaaaaaaccctcaacaaactaggcattgaagaaacatacctcaaaataataataacagccagctatgacaaacccatagtcagcatcatactgaatgggcaaaactggaaggattccccttgaggacagaaacaagacaaagatgcctactctcaccacccctattcaacatagtactggaagtcccagccacaggaatcaggcaagagaatgaaataaaaggcatccaggaaggaaaagaggaagtcaacttatatctcttcatttatgatatgattctatacctagaaaaccctaaagactcaaccaaaaggctcctagaactaataaaaaaagcttcagtaacatttgggttacaaaatcaacgtgcaaaaatcagtagcatttctacacgccaataacgttcaagctgagagccaaatcaagaacacaatcccacgtataatagctataagaagaataaaatacctaagaatacatttaacgaaagaggtaaaagatctctacaaggagaactacaaaacactgctgaaaaaagtcatagatgacacaaacaagtgggaaagcagtctatgctcatggattggaagaatcagtatcattaaaatggtcatactgcccaaagcaatctacagattcaacgcttttcctaccaaactaccaatgttatttttcatagaattagaagaaacaattctaaaattctataaaaccaaaaagagcccgaatagccaaagcaatcctaagcaaaaagaacaaagctggaggcattgcattacccaatgtcatattatattgtaagcctacagtaatcaaagcagcatggtagtggtacaaaaacagacacatagaacaatggaacagaaaagagaactcagaaataaagccacacacctacaaccatctgatcttcaagaaagtctacaaaagtaagcaatgggaaaagggctttttattcaataaatgatgctaggataactgtctagccgtatgcagaagaataaaactgcacccctttctttcaccatatgcaagaatgaactcaatatagattgaagatttgaaagtaagacatcaaacaataaaaactctagaagaaaacctaggaaatgccattccagacataggtcttggtaaagatttcatgatgaagactccaaaagcaatcacaacagaacaagaattgacaggcggacctaattaaggtgcttctgcacagcaaaagaaactatcaacagagtaaacaggcaacctagagaatgggagaaaatatttgcaaactatgcatctgacaaaaatctaatacctagaatctataagaaacttaaacaaatcaacaaaaaaaaaatccctattttaaaatgggcaaaggacatcaacagatacttctcaaaaaacacacaggtggccaacaaacatatgaaaaatactcaatatcactaatcattgcagaaaagcaaatcaaaaaccacagtgagataccatctcacaacagtcagaattgctgattaaaagtcaaaaaataggctggatgcggtggctcatgcctgtaatcccagcactttgggaggccaaggcgggcggatcacgaggtcaggagattgagaccatcctggccaacactgtgaaaccctgtctccaaaaaaaatacaaaaaaaaattagctgggcgtggtggcacacgcctatagtcccagctactcgggtggctgaggcaggagaatcgcttgaacccgggaggtggaggttgcagtgagccaagatcatgccactgcattccagcctggtgacagagcaagactccatcacacaaaaaaaaaaaaaaagtcaaaaaatagtaaatgttggcgaggctgtggagaaaagagaacacttatacgctgttgatgagaaagtaaatcaattcagccactgtgaaaagcattttggagatttctcaaagaacctaaaacaaaattatcattcaatccagcaatactattactagctatatactcaaagaaaaataaatcattctaccaaaaagacacatgcacttttctgttcagtgctacactattcacagttgcaaagacatgaaatcaacctaggtacccatcaaaggtggactggataaagaaaatgtggtacacctcatatacaccatggaatactatgcagccataaagaagaccaaaatcatgtcctttccagcaacttggatgcagatggagttcattatcctaagcaaattaacacctgaacagaaagacaaataccaggagtcctcacttataagtgggaactaaacattaggtacacatgggcataaagatgggaagagtagacaatggggactactagaaaagaggaagagcagggaaaacaaggactgaaaaactgcctattgggtactatgcttactacctggctgatgggatcattcataccctaaacttgagcatcatgccatatatccatgtgccccctgaatctaaaataaagttgaaattacaacaaaatttttttaaatgtttaaaagatattctcatagaaataatagtgatacccagtaacaaagacttctactttcttatgttttttatttgtacaaacgtgtaagccaacggtcctatttgaggaagcgttctaaaactaaatacagaagtgaactatacgttattttctgagaaggggaataattaagttgtatgcatgttattcgtatcacatctaaatggtaataaaaggtatagtgtatggaaggctaaaattcagagaaggaggaagagagaataagtcagtgaccttttagtaataatgtgaaaatatagtttagacactcggaaatatttctctgacattaagggctttatcatacatggaattgtaacactgcagtctttcccagaggtcttctaaaatagtttataacccaatctgtccggtcatggtaattttatttataatggaaaacaatctaaatgactaataagagggaaatggataaattgtggtatatgactctggaacatttaggtagccattagtatttaattttacttaaattttaattttaattaaagtatgatagctaagtagcagcatattacaattcttatggtaggatactcagtgaaaaaagaattcacaactttatagtatgattactactctttaaaaattaggtatgaatatgaattaagattgaatgagaacccagaacaataaacatgattaatggggttacatggtatcattgtggggaaaaaaaaaagttttccagttatttgtgtgtaacaagtgaaagcatatattgttaaaggtgttcgtctctttcaaagtgtaactgtggacaagaagataaactgacagactcagaaagcccccttcagtctcaagactcctaaattgctgagttgcaaggaggcagtgcccagagaatgcagcattcctaagcatcactagtttccattaaaacctaatttatggaattaaaaattaatttcatggaaatgaatttgagcagtcttttcattagagcacacttggtctaaatgagtttggagtggttgtaatagccattcctgcactgttatttataaaggtgaaatctgatgtgagtatttttgttcttacgctactgagaaacaacatattgcttagagttttcaaacttccatgtgatagttgctcttgctccccgaagatcctctcagggaagttatttacgacaaggagtcccatagaatgggaatccctcagtgaaagtcaaccaaggcctccgattagtgagtagagcagataaaggcctctcgttgtggaaccaaaatgggaagaggcaatggccaaagtgagacaccttctttcccaagtgcaagaggcactcttgcttccatagtgaaagaagtttgcgagatgggtgtatctgatggctatgtttccaggtggagaactatacatttacttcaacattttaaacattctgttaatgaatatgcacatgtgtgcacgcaaacacacacacacacacacacacacagagagagagctatgggaatatgctgcaaaaatctctgacttcagggaaaataattgaccaaggcccccagctgctgcactctgaaatctgtcactgtgccaacaaggccacactccccccagtgactgcgagcagcaggggaactcaggcaggcccatttctgggagacacagggctcctcaaatttaatccccaacagttttaccaaaccatccttagagtacaggggaatcaaggatgaatttgcccaactttgttcactgttctttacttggggtcagacttacatcacagtttcttgtatttttctctcataaaatacttgcacatttaatcccatcttggcaatggcttcctagaggatatacatgtgtgtgtgcatatatatgtacatatgtgacagtatgacacacacatatatacacacatacacatatatatttatatatatacacacatacatgtgcataagtatatatatatatgtatatgtacctttgaatcataatttatctccatttgatgggcactagttaggtccaaatttttgccgttataaaaatacccatctatcccatttttctaattatttcacatttctttggggagatttttttttaagcttgccacagtgactgtgactgtcctttgttggaatacctccaaagaactcccagagccaatgccacacttaacacttgttttccacatgtatagattttctggtgtggcttcaatttctctggtaaatgagcttcaggccttctcatgtcagtgtgcagagtaaagaagtgaggatctagcctttcacaggatcctctgcaaggcagtgcagtaaggaggggaagggttttctgccacgtctgtggtctcttcattcttctcttcctgctgtcattctcgacctgggccctgctgtccttctctcatctggtatccattagagttcttgattacaagcaacagaaatggattctgcttcacttcaaccagagagaagttgtcaggaagatatcgggggctcacaatcaatgggcagctggaggatcagtcttgaaagctccggggctgggttgcaggaacatagtgaggatcttttactagaagagcctggtgagggaacctccaggataaatgggctccaggggatcttggtccttgcttcaccttcccaagattcaaatcctgggaaagagacacccacagaggcacccctaaggcagagggagactctaatgcctgcagcaggcgggcacctagaacttcactccaccaacacagaacctgatggattggaagtaattcccccaaatacactggggagatttgggaagaggaaaaaaaatgttgggctacaaaatataatagtaatatctagcagcacccttttatatatgtgcataatccttgagtttgtacatgttcggagactggccacaactgttgcatgataaattagtctttgtccaagtgaaaacaagtttcctgattaaaacaaagcctagccattgccagaagctgcttgaactaactcagctcctaaattgcatttacatccaagagcttggggttctttctggctgtccaaaattgaaatgttgtcagtgcaaggacacaccatccatcaatttcttctcagaggttcctctctaccttctaggactttgctatggcatttgttggctctccatgctggcctcattgtttgtctgtttgttcttgtcttggggaagttttctttttcagcagattctcaaacgtgatagcactgtcaacaaattaaagactgggaagccatccagaaaaattatacatgctgttttcactctctctcttcctgaatccacatcagtcctctctccttaatagaaatgttccattgttttatttcacttaatgacccctaccacattatcttctttaagaatactttactcagccaggtgcggtggctcatgcctgtaatcccagcactttgggaagccaaggctggtggatcacctgagattgggagttcaagaccagactgaccaacatggagaagccctgtctctactaaaaatacaaaattagctgggtgtggtggcacatgcctgtaatcccagctactcaggagcctgaggaaggagaatcgcttgaacctgggaggccaaggttgcagtgagccaagatcatgccattgccctccggcctgggcaacaagagcgaaactctgtctcaaaaaaaaaaaaaaaagaatacttttctctatctaattcttactttagggaaactcactttgagtcatcaccaaagcctgtctgttcagtgcaaccataagtaaatgctctcataaaataatggtaacgggtcaggcacagtggctcacgcctgtaatcccagctcttttggaggctgaggcaggcagatcacttgagctcgggagttcgagaccagcctgggaaacatagcgagaccccccctaatctctacaaaaaaatacaaaataataataataatggtaaggtgagcatgtatatgagatgaacttgcttttgccaaagaaaaaaatacacctgatatacaaatgaaatttggattcatggaaacaaattccagaagacagaatgttcagattatattcaggtaatatgtcagcattgtcattccaggtaaagatggctttgcagcaggaaggatttgaccgaaaaaagcgaggttacagagacatcaatgagatcgacatcaacatgaacgatcctctttttacaaagcagtggtatctggtgagtgtctttatgtccttttggacatttcccatcttgagactctggataaaagatgaattcctgtatcctcattattcactaggatgttagccagtatccaacccagtgaccctctctgtccccttacatatgtattgattttctgtcaccacctgtgcatctagttctctaatctgctttcttctggaactgctaagtagcccttgtctcctagggtggaggctatgaccaacaactagtggaattctcttcagttctgaaaaagtgcaccagtgtatgactgaagattagcaaaactatataaaagtcaaatcagaggtctgggaagagtaatgcaggggtttcaacagacagagtaacaggggacataatgaagtcacaggcctaaaagaaaggatccaatgactttgcaaggggctagcaagaaagcttggagactaaagtagcaaaaagagcatctattaatgcttcctaaaacaatggcaggaaatcaattccatggggcttaactgatgcaggcctggaggcactaaaacccattttgcctggtgaagtgagcattttgtgggtcaccaacagttcatcatgatccatttggattggccaagctatgtttaaaaagggatcagtgactccaaaccaacctgaactgcagggcatattgacagaaagggagtgactaatttgtaaatgtgaatgaagctgtattttatttaagattaaaaagtgatgaacaagagagagaactaaattacagccttgtggacggctacattacaggaattcatcacaatttcccttctggggcttcagagcttgactctgacttatgctttttggcatggaagtccgaaaatccaatatgggtaattgaatgagtgtacttgtattagttaggataggctaggtttgttgcaataatgaacaaccctcggatcacagtagcttatcaaaagcaaggcttgtttctcacttttgctacacgactaatgcttcataattgctcagaaacgcaggctgaccaacctccatctgagctccattcccacactgctttcataagcccttcagcaaggaaaaggggcaaattgtagaatttttaaaagaaactcttaaagcttctgcctggatgtgaaaaaatggcacatgagatcacatgtcattggccaaaatcagtcatccgccattctaacttcagagtgggtggagaggtgtgtagtcttaacatgtctttagaagaaagagcacagtaaattttttaaagagccccaatgacaatcatacaatgttttagcaatatcataacagccactgatcactgtgggcttttgccagtacaagctctgacttcattattttttttacaatccatcctggagaaaacctacacagtacaaagacacatgaagattgggagtggacatattactgtggaattgctctttgttttcctttctttcttttctgaaatatttttgggggccaggatgaggggccttaggatttatttttctgcattagaacatgcactaaaggtgagccagttttctttaattcagttcaacaaatacttttgaacaagacttagtgtggtggcactgaaattacaaagattaactaggacatgtcatctcctgcaaaagatattgttatttagtaagaagttatattcaaataagaataatccaaaacaatatgctgtaaattcaaaacatgaggtagaaacaaagagctatgaaagtgagcatttaattctaaatcagggagggtttcctgcaatagcagctctcttatggaaaaagtttaaagatagtgatctagttataagatattaggggattgaaactatgtttgcatatttacagaaaacagaaaacacaaagtgtttataccaaaaaaaaaaaaatggagaggaaacactataggtaggttgggagggacacccaaaagtactgtttcatggaagatgtggcctttgagctggtcctgaaatattagatggctatagagtatgtcaagtaaatatgtacatgggtgctttacaacaccaaactaataccattctctgctttgaaattcctgtaccagatcaatactgggcaagctgatggcactcctggccttgatttgaatgtggctgaagcctgggagctgggatacacagggaaaggtgttaccattggaattatggatgatggtgagtattttgaagcctgtgcctcatttggaaataagcgtgcctttgcttgccttttgataaaagttgtattgttttggagatgctaaccagagatggaacagcaagatactgggcatgatggccacactgcactgtgcccagatcttcacctttcttccaatcagtggtcctcaaacttgaggttgcacttaacaaatattttttgaattaataaataataagctaaacaaatgaataaatgaaagctgcctatcactcaaccataatttcttactgcttacactttaccttaaaatgtcctctaaactctttatattcaccatcaatttctctagactcacactatccaatgtagtcaccactagccatatgtgcctatttaactttacattttaattaattaaagttaaataaaatgtaaaattttatttcaattcctcaatcacactagcctcaagttcttgatatccacatggggctagcagctgctgaaattcaattccattttcatcatcacagatagttacattagcgtgactctacatccataaaacagcttttcagtaacaggattggagcttggggaaatttgactttattgctgctttcagaatgaacccttgtaaagtagcctttgataactttttattacagacatcccttacatgttattcaacctgcgtgcctaccaaagacttagcagagcttcattttctatagtttgtgatatgaaaaccaatgggcttgatgaattggcatttttccaactacacacgtccttggccctgccaagattgtggagaattgccgcctgtggtcgtttcactggggatgtgttgttgccctccatcacccatctgggtctgccagcaaaaagctctactgtgcattattgacccaattatatacaaaggctacacagagatgaaacagttgagcctttcccatccgaagatcctcaaagaacagaacactatgttccttaaagtgaggctttgaagcagaaatgacagaggaaaccaagaggagccagcctgcttaaaacctgcgttgtcttgtgtgggctcattaaatatcaacataaaaacaatgcctcaatgttttttgatgtgtgagacatttttaagtggatgtaaaaccttcctccagaggccaagggctctcacaagaagaaaggagccctgcatgagagtgtgtgtgctcagatgtcaggagtttataaatgtttcttcttttctcacacttgttcttgaaaactgttccaaaggggttcaggccagctcacccaggaaaacaatgcatcaggatttggggaaaacctacctaggagatattgtcatgaccatttctaacagcatatcctactgggtatccccagccggggatcagagaagccaccctaaaagtggcactaaagtgccaacagatgtgcattgctctgctcttaggaaacctccaagagtactgtagatgcccatttcagaatactttaactgaaagctctttgactgactcctaaagtcattggctcctgactcatttccacatgcaaaggcaagccctttagaaagtctcagcagaatttctcatttgatgttctttcttcagctgattaatggcctttgggttcccacaaaagtaaactctgccccccaattacaattcctggtttcttcttcattttagtcaattactgctgcagaacaaagaatcccaacattgagtggtttaaaaaacaaccatattattatctctcacggttctgtgggttgctggagttcatctgggcagttctgcaagttccactggagtctatcatgcaggtggagtcagaaggaagttgaccctggagtcaactagaggctccaatgggaggctgaaaaggctcagcctccctccctttccatggagtctgaggacctctcctctcacatgaggcctccagcaaggtagatggatttcttataggtggctcaggactcccaagagtaggccttccaaaagagaagaagcagaagctgccagtcctcttaaaggctagacctggaatgggcaccggtaactctgccacttatgttggatgaatggtcccagggccaatccagattcaagtggaaaggaaataaactctgaatttgtggccatttttaatgcatcacatgctattccatatgataactgaagaaaagtatccaagttcactgttgaatagcaaaatgagcacatttgggacaagggcagctccccacatggtgaggacaaggacagatgctcttgccatgtaattggccatctctgtcctcacagctagaaccgggaaggctggcaacatcagtactgcattctctctcttaacgacctgcacgcatgaatggtatggtgccatgtcccagacattttcttggcaagatattccaaaataaggttaaagacagacacagatgccaaccctgatacctaagggcaaaactaatgtcatattctatcaacattgtctctccacatgttggcctgtgtggcaaatgttcaatcatctgcgtgcagaagtttaaatttgtggacagccagttttaatcactgccctcccatctctggttgcccaactccaaactcagccatcatcccctctgctggatccagtgactcaatggatgctcaataaatatctgctgccttcacgtaggtacaaagcaatgtcatttccacatgctacatatcactaggagaggacctccatggttagctgctgtctaaaggggcagaaattatttcttaagggtctactaggacatttcacctatgtagatattagcaaggaccccatttaatgatgacaacttccgcccttttactgtaatggaattgtttagagttgggaacttgacctggaaaatggaatgtgatcatgacaagatacagggatggacaagagtcatccagcccaagagtaattcagggcagatggctggttctcaagatcacacaagatcagagaaggcatgggtcaaggcccttagccattatcagatggagccaaggaagtgagatggaaggccagcgagctaaggtcagagggagcttcaagctgaagtaagaataaacaactaacagtaaaaacgacgaacatttattgagtaatcactatgtgctagacactgcttagcattttggaaatacaaccacagttattccctaaggttggtattattataatcgccattttacagatgaagaaactgaggtttagggaggcaagaaactgcccaaagtctcacaactaattctaaccaccattcttggtacttgaaacctaatcctttgctctgccttcctggtgagactttatgaatgggagcctcattcaaaatagcattaggagatatacctaatgttaaatgacgagttaatgggtgcagcacaccaacatggcacatgtatacacatgtaattaacctgcacgttgtgcacatgtaccctaaaacttaaagtataaaaaaaaaaaaatgacaccaccaggatgtggaaattctccaggacaaaagacagttttttcaataaattcaaataaataaataaataaaagattcaaacctgaggaccacatagtcacccacacccttctgagagatttagaactctgcatcacatagaaaacagtaggaaggtccagcagggtgactgctccagttacttttgctgcataacagataatcctgtattagtccatcttcacattgctgataaagacatacccagactgggtaatttataaagaaaaagaggtttaatagactcacagttccatgtggctggggaggcctcacgatcatggcgggagatgaaaccgtgtcttacatggcagcaggcaagagagagagtgagagccaggtgaaaggagtttccccttataaaaccatcagatcttgcgagacttattcactaccacgaaaacagtatgggggaacccacccccatgatttaattatcccccaccgggtccccccaacaagatgagatctgggggaggacacagccaaaccatatccaaccccaacacttagcagcttgaagttgctatttatctttaatcatgattttgtggcacaagaatctgggaagagcctggctgggcactgctcactcagtgttgctcatgcagttatgatgttagctgggctgcagtcttctgaaggccccgctgggctgcacatccatgatggtgcactcctatcgctggtggttgttgctggttgccactggagctcagctgggaccgtcaaaaagagtgcccacatattgtgctttactatagtttggtcttgatgtcttactcaccagagtggctataaactctatcctgccccaacaggactccaggggattggctgtagatgtttacaatgtgccttagtccgttcctgatgctgtaacaaaataccttagactaggtcatttataaataacagagatgtatttctcacacttctggaggctgggaaatcacaaattcagtatctgataaaggcttgctctctgcttccaagatggccccttgttgctccatcctgtggaggggacaaacactgcgtcctcccctggcagaaggggtaacaaagggatgaactctctccctcaagcccttttataaaagtacgaaccccattcatgaaggcacagccctcaaaacctaatcacctcctaaaggccccacttcaaaatactattgcaactagggattaagtttcaacatatattttagagggacacaaacactcaaatctcagcatttcaccctgcccgcaagcaccacccccccgaaaatttgtgtccttcacatacaaatacactttttctagcccagtagccccaaaagtcttgatttgttccagcaccaacatcaaagtctaaagcccagagtctcatctaaatatcatctaaatcagagatgggtgaaactcaaggtacgattcatcctgaggcaaattgctctccagctgtgaacttgtaaaatcaaacaagttacgtgtttccaaaatacaatggtgagacaggcataaaacatacattcccattcccaaagggagaaataggaaagaagaaaggagtaacaggtctcaagtaagtccaaaatccaaaaaggcaaacaaattctgaggcttgagagtaaccttttctgactctatgtcccaccttctggacacactggggtgggagctgggcctccaaggctcctaatgaccgctcccccatggcttcactgggcacagctcatgcagcagctctcatggggtggagtctcatgcctgccattctcccacactggaatcacatgttagtgggtctgtagttctggggtctcagggcagtcccacccccacagctccactgggctttgtcttagtgggggttttctatggtagccccaccccatggcagttctctgcctgggccccgaggctctagggttagggttagggttaaagaactggagctcagagccagggttctgacatgctacgcatctcaagtgaactattaacattctacctaggaatgtgcacatggaactccttcctagttcctcgaggtctccaggactgtcaccgcttcctgagaattgggactattgtggattagactttccaagaagcttcaaattgatgataggatactaatgatttatgaaccaaattataaccaagtctttgtcatttctgtgccacatttattatgattggctggtgatcagtcggtacccccataggctgtgagccatagatagttgtacagctcaggttctacgtctaaatcacctgcggttttccaggaccgacactgtgcctggcattcactgctgagaaataaacaaaagcatgaagtataagaatgaatatgagaatattgtaagaattaaacataagccgattaggaagatgtgttcagtacctcccaccttaaaagataatcaaatatacaaaaatataaaagtactatctagttaccaaattactattttccattcttcagtccattattactttttccgaatcatgtttgttgtccttcacagtcgtatcaatcattctctttctcagaccaaagtcggtatctgttctaacttaacacttagtattcctcttaacctaatttaagatcgtttattttaattaggctaaatttatcttgttttaattctaatttccttctggtctcaaattatcttcttgctccagtattttcccttgacagagaagacactactatttattggaacatttttctccttaacagcttccattctcagaacatgaagccatgtttcaaaaattgacttcctgttggaaaatatattctctgggtgtgtctttttttacacttatttagataagttcgtttgatctagctaagtgtgaaaaaagacacacacagagaatatattttaaaatataaatatttaaaatataaattatatttttgatcatttatatttaggtataaattatcaaaatttttcacccaatgagttcacaaaatttaagctatcttaacaaatagaagcaatttaatttcaacacaatatgctgaaaccaagtggatattttttaatgtttcttttcttctgcatatgcacactactccagagatgtggtagatgttaggactaatgatgataagaaatagaatgtattaagtgtttactataagctgaagactttcaatgaattgtctctaatcttgaaaaccgctttgcaaagtaaataatagtcccatttcaaatacatggaaaccaaagctcagacagattatgtcacttggctaaagccacacaagtgttagtgtctgagcccagagtggaactggatccactgatttcaaagcctatgctcatccccaacttcaccccacagcctaaactgaccattttgctggggggatgtttcttggtttgcttttggggatttgtttgttgtttccttttagagacagggtcttgctgtgtctcccaggttagtgtgcagtgatgtccttatttttgtagagacagggtctcactatgttgcccaggctggtcttgaactcttggcctcaagcaatcctcctgcctcagcctcccaaagcaccgggattacaggcgtgagccaccatgcctgaccaaaattgacggtctttgaattaggatccagaacaagggttaacaacatttaaaaatatttgtctttaaatattctgatgcctttccctctgaagacttcgggaggcaagtgggagaagaaggcataatgatttagggaggggactatagtctcccaaactatagaaagcagccatagtgacagcaattgcttcactcatcaaaatcaacagtgaaacctaacacacgtaccgtagattagtgactctcagtccagttactcattgtataaccggaaaaaaaaagaaaaatttcttttcagaaatatgcatcctaatacaagctcttttggggaaggcaaatctctaatggtggcctagccttagtaagcatgcagtgaagatagcagccttgggacagatttaatgatacttctggcttttagatattgcatccccatatagttattaaatgcaccagctgctgggccaagcataccacatgcattcatttctttagtccttacattgttctcacccccagttgatcaaaaaggaaaattatcacagagtccaagcaacttgcctgaagtcttgcaggcagttatcagggtggttgggactcaaatgcctgtctttgactccacagacctacgtttgtaaccattatgctagatggtgtcaagaacctgccctgtttcttggagggttagatgctcaggtgtaactgctgcaaagcttatgtggttttgcaaacccaaatgagagcttttcaattgcccttggagtttcttgatgctttctgaggtccaagggtctgatggaactcagcagtgctcatagtccctgattttacccttggaacgactactgggcaacaagacaggccaccattcaggagaaagcagggctcctgctgagacattcaagcctcaggcttcctggaaagccacattctgaggagacaagcctcagctcccaaccagcaacacctcactggaaaccatttgccctttacctaatggcttttcttgcccagccatgttctcttattatttccatgccagagtacattctcctaatccattgctgtccatgccctgttaaataataatcacttttcctccccagggccggtttcatttcagagaaatgccagttgatgctttaaaaatgtcaagatttctacaaatctcttttagatcagtgctctgatgagccatccatctcactgtcacaaagctgtcttgggcagctgtctctccgctctggcagtgcagcccaccttcacacctccacacagaagggaggtgcaagactgggagctgtgtgatggggcactcacccccatggcaagccttctggcaccagccccataaagagggcactttcttgggcagctttcctgaggacacagtggcaggtattaacctttggttcctgtgttattgttgtcttttcacagggattgactatctccacccggacctggcctccaactatgtaagtacaagccaactttggtggggaaacagatgcatcttaaatgtcctggtgtccctggctattaggaacatgcacatgtctacatgtctatacacatgcatgcaagtacaggagcatgcacacacacacacacacaggagtacagctgctggaacatatgcacgcacacatggaggaacacacacaaacaggaacatacacacacatgcataagcacaaaagatgcacacgtactcataggcacacatgcatgcacacacagacagccacatgggcagccacactggaactgtccatcccattggagccacagctcaggccacaagcaaatggacaaggcatgtggcctggcagcaggcaaaggcagtggctttgagagaagaaagaaacctgacatctgaaagagcagagtgccaagaaagtaggtacagggagggggaagaagagagagacttggcaaggtttaaatcaactctacctgatgatattgaattgaagggtggaaatgagccatttgggttcttgttggacaaaaccaaaggcaaaaagccaaaaactgcagtgactcacattgcagccccagctttatgaaagtaagagcgttatcttttttgattatttgtgtcacttatgaccactccactgactttcccccataacattgagaattactatcccttgacaaacaagcaatgttagcagagaatcaccaaaagccctgctgggctagaaccacacactctaacttttgactcagcagttcacacgctgctttcctgatgaagcccacaagccctttaaacagaatcgatcacttattttaaccccagggagtacaagattcaagcattggtgcgttcacttaaaattatccaaactatttctaagctatacttctgagacctccagatctaggtgtaaaaaatgttgtcttagtcattgaagagactcatatttagagaacaagggcttgcataaaagaaaggatggttacccagcaaaaagtgtttggaggtcaccagtctgggtcatttgtcctggaaggcgagtgtctctacgttgcacaaagaaagggggaatattccatgtgtttcatgcactgggcaacaagaaacaaggcattcaagggatcttataaatctagaagagcataaattgagaggagcatcttttttaatattaggaaaaactattaaatgaatcattggcagaatccagccaatgtggccccagaaagaaatgacagaaattaaaccaaagctatattcccagcaatgataataatccatgtctatggagaagaccattgtaaactgcctgtgccagcggtcctgtgtgtggagtctgaggaaacagcccttctccctgtctcctcatggtgccttccctactgaacatgagtggagctgtctgctggtcttctcatgcacttccttaaagggactgccctggacacagtccttgctgcctctccctgactatggctgactccgctagtgccttcacctttccctgcctcctccataactgcagggccctggagatgtgtcaggcaggggattgagaagtgctgcattgcattttctccaaggctctgatgtatctggggctgttcctcacagagagcaagtgtggcagggatcatggcctccagggtcggtggtcctccctccgagggctgtccccactccaccctctgcagacagaggcattgatattctccacagttccctccatctccaggacccagtgcctcacagggcagccacgtggagttctgctcactttcccaaaccatacttggggaaacaatcatcttgtcacttggaggacttcaaggtggggtggtacccattgggctggagagctgagggcacatggcctgtctcctgtgcatagcataaccccacaaaggcctaagacatggagaccgacctctgcatccttcccttctccctgcctagcccaggcagttcctgtcaggctgctcccaactccagctgccagattcgaaaaagatagtcattcattgggggcaagaatcctctggggttccagtgagctgcaggtacaatgttagtggatggtgtgatccatctgccaaaaccttcatctgaaattggaatgtgaaacctccatattgagccgtgccagctcctctgagatctgcaataccagaatacacctgaagaactcttatcggttctgtgagtctcaagttcttttttcttcttttctttcttaagaacatttttctgattaaaaaataaatgcatgttatctgtcaaaaaatatgaaaaagcataaaacagattcaaaactagccataataccaccattcttattattttgacatatttggggcctttaatttctatgtgtctatttttaatgaaattgagctcttattgcatattcttcccttctgcttgatgtgccataaacatttttatgttattaaatattctccaaaacataattttaagggctacatggcattagctcatgctataatttatttaaacattctgatctccaattgttgaacaattaggttgtttccaatcagtgtttcactgtaagagggagatgagatggcagacagtaacatgggtggactccaagccataccatgctaaggagaactgaaagaactggaaaagcttttcctggaaaaaagaaaacaggcacattgagtatgttttcaaatatttcaaattctcctggtacaatgaggcattccacttgttcagtaatttctcccaagaaaattctcaccaatgggtggtaaccacagaagcaaaattttaactcagtcaaaggaagaactgtctagtgattaagatagtaaattattgggaggccaaggcaggtggatcacgaggtcaggagattgagaccatactggctaacacggtgaaaccccgtctctactaaaaatacaagaaattagccgggcgtggtggcatgtgcctgtagtcccagatactcaggaggctgaggcaggagaatcgcttgaacccaggaggcggaggttgcagtgagctgagattgcaccactgcactccagcctgggcgacagagggagactctgtcttgaaaaataataaataaataaataaataaataaataaataaataaataaataaaaataaaagattagtaaattaatgaaagtaacaaattcttcatacctgaaaatattcaagaggaagtttgatggccactggtgggatgttattgaagagatgacaatgtctatgctgaacttaaactagatgagacctaagaattgaacagaaaatgtgatttctgtgcaaaactgcgcatcttgataactttcattcagagcaaagtctgagtcttcaacttgtatcaaacacttggaagctgacaatgaaattatatatatttacatatggctgtgaaaatgttctgcctctggtatagatgagaaaactgaacacctaactacctcgtgcttgattcctcagcagagggcccaaactggctggtttttaatggcacagtgtctctctcaccctgtgtagagttcagagtggcaacttcggagctactaaccacactaatcttctttatttttaattaaaaattttacactatcattaacacaatgaggacagcaaatagagtagaccagcccaggagagcaatgaaaccagtagacagtgataggctcgaaaattgtttgagcagagaattagcaggcagcttcacacctcgttaagtgacctaatggcttggagggatgagccagcctggtgccccttgagagagaggtacttggtggagtctttgcttgggtttccctagaagcagactctgaagcaagggtttgagtacaagtaggttatttggaagaggattctaggaagcaggggtagaggacagggaatgagtccgggaaggaaaggtagcttgtaaacggggcagttatcaaacaagacagcactgtgggcactgaggcttaatctcactgggcagctctgggagacagcatagaatatgtgagccagagtgatcccccttgggatgtgatgcctcaagaagctggggtatttatgtgacaacttcgtcagtcattggttgagggcttgtcccaaaagatgttcctacctccccacagcctggggaaaagccctgggcagaggtgtgggtacagacagctgcagcttaccagggacatgagggtttcaggctgaagggggatgtagcaacgtctgccccagagatgccttggaaattcattaaaggttaaaataaatagacatgttctatgttgaaaaaactccttgtggttactgatttattttcagtgaggattgaaaactctacccaaggctcctcaaaaaaattactttataatcaaaccaaccaaaatgtttctgaaagcagaattattttcaaagcttggttattctgtatattaagagaggaaacagcatatgctggtagtccagtttattcccattaaactaagaataaaatacttggaaaattgcaaatcaatatataaatgtaagttgttagtgttaatctaattcaaaaaatccacactgagcctgctgagtgttgggagtaaaggataataacggccacttggattattactctattgttctatgattgaatttcatcggagggatccagtcccactggtaaaagttcactattccaaataattaaaatttttctttttctatcccaatagtcatgacacgaaatgagtattagccaagaggctattttagaccaggttaaaattataacctcctttacccatcttcgctataataactgggtattttctctaagtcaatacaatggctgtggattgaacctgctatgtgcaagccccagaggaagagagataaataagacacaggcactctctagagaagtcggcaggtcagtaaagatgcaagcatgtgagacatgactgtcaggtgaggggtaggcagacagggaggttcgttgtctctttactctgagctcccaatccagtgaggattgcaggctgggttcacagtacgggcccaagctcaggggttctgttaggtctatggaacaaagggagacttcttcaagaacatgtggagtgtgacttaggtggcagctttcagggcatggaggtgggtggggtagaacgtctcctgctttgtagctttgctgaagctacaaaggtgaagaaaaggctggtgggtctgtagaatccaaggagagccttcttgctgtgtgctgggttttctcagaagcagaccctgagacaaggatttgaaagcaagtcattcatttgagaggagatcccaggaagcaccagctgggaaggaggaaattgatgccagaaagggagagtggcccagagagcaaattaccccctagggcaatgggagctcaatctccctggggaactctgggaaacagtgtggaccgagtgggcctcagagttacccacaaactcctgtcaaccactgggtgaaggccactacccaggagtagagatgaggtggggagatagaaggattcattctagacaagaaaaatagggccctgcagacagagtcttcagcagagttgcatgtgctgacagttggaaaacagccagcttgcaagggtagggttctgacagttggcagtagtggaaactgagtcaaagctgagatgactcctggctccctacctcatgatgcagccttagaggagcatatcaaacatctttgaaccttaattttttcatccgtgaaatgggcaaaatggatgtcttgtcaggtttgttgcaaggtatccttgagataatatgcgtatcaggcctggcacataatagatgctcaataagcattcatttccttctgtctcagaagagttgaggttacaacgttgcacaatttcgggttgtcctgatggagaagcaggggtgtgcctcaagaaaccagtgcagttgttcattggacctcccagtgagcttagggtcattaaaagaagaaagggcaactgatccaggctaagtataagattgtgagggttgcaaagttaagggcaaaaatcagaggataccaacataaatctcaaaggctttgaaaaacaacatccaagaaaagagaaggtaaaggcagggagaagacccattgctcgtggccagggatgtaatgaaggatgcccccgaggaagcggcatttctgacctgcatcttcttccctgtcacataccttagaactagatgaatattcaaggatagtcataagggagggttaatccctaaggtgggcaaagggattataaggtagcaactaccccaagtgaggttttctccgagccagggaaatctcctggtatttaagccattgcagggtgggacatcaactcctgttctgatggctgggaggatgggccacttcttgcactccgtcttctagcttggaaactgtgagtgatgctctgagcagctccaagatcctgtgctgagaatctgtctagattcatgacacttcatgagcttttccaagaattcttgagtgcagcaaatacagaagtttgcattgactcaactccacatccttccctagaccacagcttctgccatgggactctgtagaatctccctttaaagaggtgaagtgtgtttcctaccccttgactttggattgggccttgtgacatgttttaagcaatagaataatctagaactgacagtgccagtttggagcctaggccttaagaggccttgtgtgctcccaactgcctacccacgcctctgccatcgccattagaagggcattcccaggctctcctgctgtaccctagaggagggtgagagacatggagaagagcttccctgctgccacggcctgaagcaccaccacccacactggcctacagagctgcagtaagaagcagagctgcctagctgagccccaccaaaatcaccaaacctcagccaacccacagaaacaagcaagccagccaagctcagcagagctgcctagctgagcccagcccagagcacctagctgccagctgaactgtggactcgtaagctatctaaacacctgctgttatatgctgctgacatattatggccgtttttgtgtagtaactgttacagctgcccatgctagacccccttctccatcctcctacagtacttgaggtgtaccccagtctggagagaatattggcttctaggcctatcctagacctactgaatcaaaatctttagggacaagcctcatagtgtgtatttcttttagaatattggcttctaggcctatcctagacctactgaatcaaaatctttagggataagcctcatagtgtgtatttcttttgaagcactccaagattctgatggttaacctactcattcattttggcacttcattcatgcattcaatcattcattcattcaacagtgcagtttacctataatgtttgactacatcacagttagatcataagctctttgtaaggaagtgtgtactttgtaagtgttttgtgtccctcttaacacttatcacagtgttaagcaagcacttaatacatatttgttaaattgcattaaatgttaactcaccaatattattgcaagtaataccaggaactaaattatatgatgaccctctatcgacgatgatcagaaactgcagcatgcacaaccctctgtgtaattcctagttctcaaccacctcataggtggatgccaccattgcctccttcatcatgcatgatactaaggaaagagaggaccctggaacctaactgagttcctatggctgcaagcctggagagaatacgattcgagaggtgaataatccacaggcaaataactacaagctatttcttttctttaatgtctagaatccctcaagttgctggaaatgcaattaggttcctagataggagaggacaaattatgttctttggttccgttcaaaatttggaacattatttatgttccagggttgctatttcaccaacagaagtgatcataagagaaaaaggcccacccctacattcctgcacttttccattctttagatgggtcctgacaggtgactgtctctgaagtgggtgcctgctgagagctcagaagagctgccagcacaggaagtaccttgagcttgacagaagtgtgcacattgggccccagggggcatgtggcctccatgataaaagggcgacagcaagaaaccggcacagtactcagccccgaatgactcagatgttatgaagtattgatcacatacattgcttctggcttttaggcctatgaatatttaaataagcacattaatattgcatatgaaactgaggcttaaataacctttgtttcttattgaaaggaagggctggcattttcaatgtgctcttgaatgctggctggatcatgatgagcactttagcaccagatcagactgaatactgagaatggggactttttaaaaatcactttgatagaccgtcagtcaaatgactatcacttaatgcaactcatgtactagaggaaactatttatttttacagaaacatactttgctttaaaaatagggcagaaatgaaaccttgcttaacaaaatgaaactacttgtatggacctaaacttacagctatagctgaaagcaaagaaaatatctggtcattctattatttttaattattcaattgactagtatttgtttcattgaacttagtcagcattcaagaaagccgtattgttcccactgtgcaaaatgctatactaggggcctgaattatgaagtgtgaaaaatccagtccctgaccttggggggttcacatgtaagtatataattacattataatatgcttagtgctaacctggaaataaaacaccacccatataggaatgcaatagctagaaaaagcaagtcagccctaaaaaattagagaaagaaagatacttaaatgcatttaaagaatgcagctcaccacatgggggatgaacttgttttcttgggtcgatacagcatatgaattcatctagaagcttcatcaatacgatactagacaaatgggtaattggatttcatctggagatttgcttccacctagaagcctagacttaaaaagtagcccacatcatttccttaccccaaattccctaaagcccttcgacagattctcatctctttgactaaatttaactggcttaaagaccagggtaatgtcttccaactcttttactcatgagagaatgaaccagcggcctcattccccacagagatcattaagagagacttcataaataaaagactgaattatggatggatggacggatggatggatggatggatggatggatggatggatggatggatggatggatgaatggatggatggatgattggatggatggatggttagatggatggatagatggatggatagttggatggaacggatggatgaaaagatgggaggatgctaatgagactattgggattttattccatttatcactaaacacacctgttcagaaaaagtgtagcaatgtttactgataagccacaagaaagtcatttatgcaaatataagaaaattgaaagattactattctcaactgcctttgttcctttctttgtcttcattatcggtatatacgcactgaattcccaaaatgtgaaatattttactggcttttttatttgggtttctatctcatagaaccaaaaacctttaggtgaccaagccttacaaataattaacttggcaataacccctggctacagctgtggttcaaaatgctgcttctgctgagctgacatccattttcactttgtccctctcctcatgtgcctgtttcccaatcatactgtcttaaagccacagttctgggtgtctaaggcaggcctgaccagatttctgaacccatgtcccccacccaggaggggagtagtgggttgatgccacagcaaaatgggcagtcatccacactgcttgcccatgtcttgttgccaagcaacagagcccaagtgggtgtgtccactagagccacacctacatgggatcattgcctgggcaaatgtggatctgatggagaccaaacgtctgatccatcatccaattacagttttctgaagcagcaacaaagaccaagaaacaatgcccaggcctcaattaagaaggatcagactctgaagccatggagtcttctaaaatatgatagaagataaattttgtggttgtgtcaaagaatcatgagtactataactgtcattttggctagagccccattcttacctttaaaagctcttaatcatttttccttgaagacaaagacttgatggtaggcagaattgtaaaatgcccccctaagatttccaccctctgctgtaagcactctgtatagtccctctcttgagtatggcaggacctgtgaatatgatgagatatcactcttacaattaggttattagattgcattatatggcagagttagagatttttttcagatgtcatcaaggcgcctaatcagttgactttaagctaatcaaaggaaagactatcctgggtgggcctgaactaatcaggtgagccctttaaaaggtaatctacaagtcagagaaggaaggagtcagagagattctaagcagtggaggctttcacctgttggccttgaagatgccactgccataatgtgaacagggccacatggcaaggaatggcggactccctgggagctgaggcctcactcctacaaccacaaacaactgaatgaacttgaaagaggaccccaagccctagatgagacagctccagtgacaccttgatttcagccaggtgagaccttgagcaaaagccccagttaacccacgtccagaaactctgagataaatttgtgttgttttaagccactatgtttgtaataatttgctatacagcaataaaaaaactaatacaaccttcttgattatagtggatatttgagcacaaactgaatgacttgctgtctctctgaattaataaaaatagaccactcctcagtttttactttttcttaatatgtttgcttttatctcaaaaataagtatactctgcctattgccacatggggccctttcataaataataattctgctgcaatgagaggctcagagaaatttagtgaggaagttaagaagagctcttgggccagcctcgctgaattcaaatctcacgtccaactgcttcttaactatgtgccctaggcaagttaatctctctgtgtctcaatttcctcatctgtaaaatgggttaataataatactgatcttaccggtgattgtgataattcaattcagtagtgcacacaaggcccttagaactgcctctggctcataagacaccctcaataagcattcgatgttgttaagtcccctgcccaagattgcacagctagaattcagcagggaagaacacaagcctaaggtggtcagacctcaaagtctgttctcttagcctccccctcccttcctgccttaaggacacatatgaatttgcagaaagcattttttaaatgaaattaaaaggggcaattagtgcgttattctaagttttctttccactttcctgctaacaactagtgtgttattctaagttttctttccactttcttgcttccccagccctccctgtcctgcctcccagaatactttactggtttcccctgggagcacatccttaataaatcacttgcctacaagctttcatcacagggttggctcccaggaatcctgatcttacattagagcggtctggagctttaggcaaagcagaattttccatcctacatggccaaggcggagagaatctctgacatagaaataagattagcttctccaccatggtaaccctgctgctgactcccaacctacgggaaattatttttcacaaagaaagaatctttaattactaaccaataattaaaacctgaagccaagaacaggaagccagactttggctcttagcaatgttccttaacatcaccgggagtattatggtgaggtctgcactttccatgtggcatgcacacaacctctccacaatgagtgctctgctaggcagaagaataagatgtattacagtgtgtaggagatgttttcattaagctatggaaagagatggattatgttttataactcaagcattgccaattttttaaataaggagttcagtgtaagtctaagctattcaaagagcactagttcacagactcccattgaggtactgcaagccaaaaaaaaaatgcgttgtttgatctttatggccctcagtttccccatctataattgtcatccccaacaagattctcattgtctccagaatcaaaagagtataatgattattcatatggctgatatgaacactgggtctttgttgatcaatcaaaaaatagaaattaaatggaacttctgagaatgttcaaggcgttgaagctattctggtatgggtattggaccaccctccctttttttctccacaacaccccacaagcatacacacacatattctttctctatcatgtaaagaatgttccagaacactaggtggaaaggagccagtccctgtgtagaggcctgtgtggtgacagatgggcactgagtcatttgatacagtcagcaccttgcaggaattcttaccaggcactttaccaacaaaaaatatattatctgtgaataaaaccatggccaaggctattaaccacttcgattaatcactcacaagcggtcacaatgatcctatactacatggcagctttattggggagttttgacttgttgcttgcttgattattaataactcgcaaatccatctctcctcccgtggagagttggtagttggctaacgaagtatgagaaccatgtgttgtctcccacctcttctccctgccgtggttctgatatttctccattgatttctgtggaatagcaggagtgttagttcccagaatttgttgagtatttactgtgtgtttggccttgtgttttatatgcatgatcacatttaatgagcgtgttaagccagtgaagtgggtactttcttacccacctgtcatagacgggaaactgaagatcagagaggctagtgatttgccttagctcacacagacagtgagtagcaaaatgtgaagttcaccatctgtcatgctgccttcatttaacctggccccctccagtctcccacatcttaccaaatggcatcgccatggtcacaatgactaaggtgctaaacgttaccatccttgactgctgctcccttctttttcccctcagccaccctatctgccagttctgctaggcaatacacctgcctctctgttcccaccactggcatcctggaccaagccagcatcacttccctcctggaccccacaaaagtttcctgcttccactcttaccctctgcaatgcattctccccaaaacaagcagaaaggtcgttacaaagaacaaagtagtggaagccatatcacttccatgcttaaaaccaacaggtggctctcccccttccctgtgagacttagcctgtttgcctttgtcctgcttactcacgatgaaccagactctacaatccaggattctccctaattaaaggcttggaagactgtcacactagctcttcccacagttgagtccatctcaacttatattgcacaccctgtgtagccacttcctagttcttaagatagtctgtggttctgtatttttgttttgttgcatgtgttcccccattagaatgtcagccccaggaggatgaggccacggggatctgacctgtcttgttcacctctttatccgcagcacagcaccatggctggaaccaagtgagtggtcagtaggtatctgtgagatgactgactggctgaggattgaacacttggctttcctctttttcttttgccttcaccttttaatttcttctggccatgctttctcctcacatagctcctatctctgtctttttgctatgcttctccttatttatacctcagtcaacaccagcattttgttatgaaagaaaagctgcaggtcagtgccacaaagaagacaatttccccaggaaatgaacacttcagtacttctttagtaacttctggggagaaatactatatttcttcatagctacaaccaaaaaacagaaagcctctctatccaagactgccttgtccatcccaagaaaacagagaactacagaaagcagcaggaatgattcccttgatgcttttaattcattcatttgtgttatatgcaattaacaataggccaactgatttctcaaagcatgcaatttcaagctgaaaaattaacctaggttattttccactcagttaagtatcaaaaagattttgaaaaataaaaaaaagaaaaagaaagaggaaaaaaaccaacatgagcatgttcttaactaatgagctatgcttatccactgttccactagaagagaattttccaaatatggacactctattcacaagtctctcttgagaaacgtggtgttacagtgtcaccattattaatattaaacttgatgcaccatatttacaaatccttccaaagggaaacaaacctgccctggaaacaatgcttataattataatcgtggattctatctgttcctcacagggaatgcttaaaatatcaatttaaatgcaaatgaatcttatcattccaaattagactcatcccattgtgttgaaattaatatagaaaataacaccgaacaccaaattacaagtaattaatattgacactgtgaaaagtatacactctcattttgatatttggggaagaaagtcttgtctgtgcgtgtgccattgtgtcctataagcaacaactagaacacaataccctcagtgctagtaatcatgcaggattaacacagcaaaaatctgagagggaggacaaatggcaatgatacatcttagaatccagtaatctattctttgggtctgaggaaaagcacttaaatctgtatttaagtgactacatactatttaaaaataaactatttgaggccaggcctggtggctcacacctgtaatcccagcactttgggaggccgaggtgggtggatcacctgaggtcaggagtttgagaccagcctgaccaacacagcgaagctccatatctaccaaaaaaaaaaaaaaaaaaaatacaaaattagccgggcatggtgtcacatacctgtaatcccagctacttgggaggctgaggcaggagaattgcttgaacccaggaggtggaggttgcagtgagccaagatagtgccattgcactccagcctccccaacaagagtgaaactctgtctcaatcaatcaatcaacaatttgagtcttaaaaattaaaatatttttcataggctgaacacagcggcccatccctataatcccagcactttgggagactagggtgggagtattgcttgagccaggggtttgagaccagcctgagtaacatggcaacaccctgtcgctacaaaaaaattaaaaatttgctgggaatggtggtgcatctgtagtcccacctactcaggaggttgagacgggaggatctattgagcctaagtcgaagctacggtgagccacaatcacaccactgcactccagcctgggtgacagaacgcaaccctgactcaaaaaaataagaaaaagtatttctcttaaatgcaaaggcaaagaggacctttctttgtctcttctgtacctaacgtaagggttggctaactacacagattctggccacctgtttttgtaaataaagttttatcggaacgcagccatgctcacttttttacttgatatctatggttgcctgcatgctctaagggaagggtggagtagttgtgacaaagtccatatggcctgcaaagcctaaaatttttactatttgatcctttaagaataggtctgctgaaatcccctggtctaatcagttgtgtgtcaagatgtaggaaaatggttttgttagaaacttaagtccagagagcttcaaaacaggctccagtgacagctgtagcaccttctagcagtgtgacatctggaaaactgctgaatatcttgggggcatagcaccctcatttgagagctgagaaaattgaactcttgtctgttgtaactctaaaatcttatgaaactctcctcccttccaataaaatccctgattaagaaacaaaagctgaattagttttgttaaggaaatggaatcgtcaagtagtttgaatctagttaatttgcttttgagaatgacagacattaagtcaaagtgatgctccttttccatgcatgatgctgtatacactaatcactggggctgagtgatttcaaagagttttgcattcatttactgtcttagctgggattcctccaaaagctgactgtgagacatggatccacaaaccagcattttatttggaatttggtgccaggaagcacaggtaggggagcaggggagtgaaaaagtgaaggaagtcaatacagggtgtgcacaagtgtgtcctactgtgggcaacaggagctcagttctgctaagcacccctagaacatgagttagaacacatgaaggagaaagagtacaagtatgaacacaccaactcttatccatcattggttgatgattaatatcaggatggagagaggaacaatttcctatacttctaagctgccatatcattggtgaatttgactccagagataaagagataaaatgctgacagatggaagttgtgtcaatgtgcactgatatgctcaaagcaaggagttattatggatggggcatctaatagcatctaggacacttacaaaatcagaggtctccaatcacacatccctatttgtaaaacaattttaactaggctctcctaatacatgtatagctatttattcagacagtatatgtatgtactactatcaatgggctatgtacattataaagcatatccaagaaagaaaattttaaaggataaaatataaataaatattaaaagttaaaatgcacactcatgttcatggtaacattattcacaatagccaagaagtataagcaacccaaatatcaatcaatcaatcgatgaatggagaagcaaaatgtattacatacatataatggaatattattcagcctttttatcaccttaagatcctaaggtcctaagattatttattcagaatttcaggaaggaaattctgttacttgcagcaacagggatgaactttgaggacattacactaaatgaaataagctagtcataaaaagacaaatattctgatcccacttatatgaggtatctagagtaatcaaactcatagagacaaaaggtggaaaggtagttgccagggtctgggttgagggggaaaatagggagttattgtttaatgggtatagagttttagttttgcaagatgaaaaagttatgaagattgtttgcataggtacttaacattactgaactgtacacttaaaaatggctaagatgatgaattttatgttacatattttttaccactattacaatgaatacatcgttttttaaatcaaggtaaaacaaggcttaaaagatttcctcccaacactccaatggatcatccagcacatcctcccaagtgagcacaatccacttttgagacctttgcactaaatacctagtctgtagccctgccctcagtgtaatcagcaaaagattctgtattaaaacataaaatcctctgtccagctagatgttaagatctctgtctttaagggagataaaacagaataataggaatggcaccaataaggatcatgcagacaggtagatctgggtccaatcctgcctctatatttagttactgtgatttgaaacaagttaattaacctctctgttgtacacgttgtacattcctgagatataaaagaaggatagcaatatgccttcatgttttcattcaacacctagttattgagagctatgctacaccagaaactgtagtatattagttacctattgctgcatctcagattacccccaaaacatggcagcataaaacaaaatacatatatatattttgtttcacaccgtttttatgagtcagaaatttaagagcagtttggctgggtggctccgtgtttctcgtgaggttgcagtcagcatgttggccatgactgcagtcaactgaagactcaaccagggctggaggatcgacttccaagatggttcacatggtggctgttggcaggaggcctcagttcctccttgcacgtagctctccacaaactgcttgagcatcctcatgacatgatagctgacttcacccagagcaagcaatctcagagagggaccaaaatggaagctacaatatcttttacgatctagcctcagaagtcacacaccacaattttgaaatgtcctattggttatatgggtcagccttgttcattgtaggggactgtatacaaggtcatgaatatcaggaagcaagaatccctaggatcccaactgggaggcggggacaagtggctgaatagagcagacatagtttctaccctcaaggaccttagcaactagagggtaaaatagactccaaagaaataactacagaaataattatgatctaggtgctttgctacagcggaagagtactcggtgatataaatgtgtttaatatggagaaccagatctgggctgccagttaagggaagatttccctagagtagctatccctatgctgataccttaagaatgaggaggagttagccaggaatctggaagcagaaggaacagcttgtgcaaagaccctgaggcaggaacatgctcagccctttcaaggatctgaagaaggccagtgtgtgtgtgctgggggaaagaagtatatcagtacgggaaggaaaaatatggcatgagatgacattggagaagtagaaagagaaccgactgtataaactttctgagccatgaggattcataacttcatcctaggagcaaagggaagcttcagggtggcagggagggggaataacatgcctagatttggcatttttcaaagatttgcctgctaaagagacagattgggagtgaacaagaaaggaggcagggagagcagatgggggcttttctaggagaaagattatttgccaaagagctgttatggttaaaaggaagatagagagagagaaagaatgtagttaaagcaccctgaacttcagaggtgctccctaaatagtctttctctcttcctcttaaaacagaaaccttcagggacacctaacataagatgatatctgcaaaacatatatctctaaaaaaagcagacaaaaacacaatcacttagcgcgggcctcattaggcacctcataagttcaggcactagggtcctgaaggagtcttgtgcacaggaaattcaggaggggagtcagcagtgagcttaaagcctcgctccaccaccagcaggaacccggactgacccacagagagcgctgaatagcatttatgatgcttaatcagaaagcatgcagcgttgatctggaaattaattggatgctcggatttttcgcacatcatggagagttagatgttacaaagattttgacgggaatatatttagtaacagtatcactgatgttcagtctcaagcaggggcctgtatctactctggggctcattatattctgagtgacaacgggtgcttagtaaatctcctttgattatgatgatcaaccaagtcactcagagtgtctttaatagataatgagaaattgtaccagagttggggttttctaaatatgaaatcaaactgcaattctcatgacccactgtgcttttatttatttaatcatttttacttaactgattcactattttaataggtagttttaaaagttaactctacattaccgccataaatggaaaatctcacttgccatataaataagacaatcataaaaatagataccgtctacccctaaaatctgccatgtacagctcaggttgggcacagcacaccctgagaactgctggacctggatgtgcttgtagtcaagggtcttggaaggaacagccgtggtcatcagttcacacagccaggatacaggggatatgcccttatgtgacatagggcatatatgatatagagtatatgtccacacattccaatatcaatatagggagagaatggtggagagagaaagggagatctctcaaattaacaacaatgaatatcgactgaacctgaagaaacagatgctctttggttcatggaaagggtgtgaacagatgctcaggcctgaacactgctcagactttgcagcttcagggaccatcggctaagagacttgtcttctggacttactgcctggggtaaggaccagggctcatttatcttatctctctaatctggggagctgtgaggactagaatgggtaagggttcagtgcagggtttacagctgctgaaaggtccctgtagcatttcctttatggaaaatcctatggatatacttaaagataggtatttgtgagggtgaaacctacctacaacctcttacactgctagtgcaaatgtcaaatggtgcaatccctttggaaaaagtttggcagtttcttgtaatgttaaacacacacttagcatacaaccagcaatcccactcctaagtatgtactcaagagaaacaaaaaggtatgtttataaaatggcatatacatagcagctttatatttgcaaaacttggaaataattccaatgcccgtcaacaagtgaatggataaataaaactgtgatgtgtttatacagtggaatactatcccacaacaaaacaaacaaactgctgctgcatacagtacaataggcaaatctccaaatgttgttagctaccaacaaagacaaatgcaagagtacatatactctctggttccatttacatgaagctctaaagccggcagaattcagatacagcgatagagatcagaacagtggttgcctaaggtaggtgaagattaactgagaagggcatcatatggtgagacaactcctcaaggtgatgacagtgtccactatcttgattggcatgatggtgactcagatttacatactgctaagatgcagcatgcatgcttaagatcacatatgctactgtaaattatacctcaattaaaaaacatgatttaaagcacaacctataagcaaaagagccagtttagaaatcagttaccaccaaaaatgccctgtgaatgtgggaagaatgagtggagaagcctgcccatgtcttgcctcagaattttcactgcccacctgctcacctccctaggttgtctcaggcataaacgaagatgatagatgtcagggcacttggaaactctccaatcgctgtacactctaaaaggggtctagtttaatcatttgtactaatttcttagaaatgcatcactcttttttccttatttgcctttttaatatagaatcaaggcttgctcatcatcaaaaagattcaaacattacagaagtgtagataaaataaaaactgcaatttcccttctctctcctctccttttcctcctctatacaacccactcactttccaattttggtgacgtggcagttctgcatggatctttccagattttttttctcccccaactgcaatcatacagtacaccgtatcatgcaacctgctcttttatttaacaacatattctctccaacagtgtggatattccgtcatttgtttaaccaagcccctaatgattgacattttgggtttcccctaaagttttgctgttataaactacgagacgaatgtgtttccttgatcttcttcaaatccttgtgtgaatatccctttagaataagttcttagaagtgaaatttctgagtcaagtagtacatgcaatattaattttaataaaccttatcaaattattctctgaaaagattgaatcaatgcatagtcctcccaggagaatcccttctcattttgatctcaaagacaggaaaaataaagttgagagaatgctgaaatattcaaagattctccgatgcccttgaaaagcagaagtggagctgacatcaacatggccttattttcgctgctgacttgaaacttccataatgaggaaataaaacacatgatttaaaaaaaataaaaaaactcatcaatgagattaatgagagttgagagcctatgacttgaacatttgctggttaatagatgtagggatggaaacagtgttgtgccaattactgtaattaaccagaaatgaagacaaatggaagggagcctcttctgcccaccaagcttcaacttaaatgctgagtcatgagctactagtggaggctggaaggccaagacctgggctagtgctgggaaaaggaagtagctcttattctcccaaatgtgtgctgggtgctcagaaacagagacagtgggaccccatctctacaaaaataaaaatttaaacattagctatgtatggtgacatatgggtgcctgtagtcccagctactcaggagactgaggtaagaggattagttgagtccaggagatcaaggctgcagtgagctatgattacaccactgcactccagcctgagtgacagagtgataccatgtgaaagaaagaaaaaaagaaagagagagagaaagagagagaggaaggaaggaaggaaggaaggaaggaaggaaggaaggaaggggaagggaaagaaggaaaggaaggaagggaagggaaggaaggaaaggaaggaaaggaaggaaaggaaagagaagccatcctgtcaaggagtcccaaatatcccctgtctcatgtagctcatccttcaggaaataggacactttccaactaacacagttaggctatatcccccaaggtattatgtttttccttgaatggagtcaaacactttctaaactcgagagaatatggccctgaaggaaactacgcctgttcctgtgatgaaatgacctgacaggaaagaactcagcatcttgctgacaagtcaggaagaactcacaacctgcccagtggtcattttagtcaattttggggggaaacagttcttttgaataggtcccctaaaaaaggcttgaaagaagaattagtacattccaaagcagtgattagaaatcatcataattttctaccaggagaagagcactttattattacttaaaattactctagtccaatagccaattgctatattttatgttaacttttatttacaggaagtacaatgtattccttttggtgcactgttccatgagttttgacaaaagttcatacagtcaagaggcagaacatccccatcacccaaaaaactttcctcctgctgccccttttcccactcgcagtcctggcaaccacagatctgctttttattcctacagttttgtctcttctagaatgttatacaaatggaatcatacagtatacagcctttgagtctggctttttcaagcatttattctttatcaatgtggttgcatatatcaataacatgttcttttttattgttgcgtagcattcccttgtgtgatgtaccacaatgtgtttatctgttttccagtctgggaacatttggataactttcagtttggacgattataaataaaatcgttatatacatctacacacagatttttgtatagaatttagatgtcctctgtcttgggattgaggggctgtatggtaaaccaactgctctttaatgtctagaaaatgtgacagtcctcagagtcatggagcctagaaaacagtgcggttgtccctggagttcagaatgctttactctgtaaatatcattcttacttggatagccttggtctgtgagtaaatgtgctatgataggcgttgtgtagccgttcatcccagctctgtccccagaatcagataaggactcatgctgtgaactctgatgccttcagtccaatgagaccagaacatcacttgcccgtttttattttaggtctcgtgtcaagctaagctaagatacttcattcctttttcttttcccatcaaattttgtatcttaaaagtttcaaaaaaatttataagcaagtatatctcaagatttttaactgaatgaaataaatttaaataaaattctgagtatttttccatttgattttttggaaaatatatgcagttcccaaatttgaacaataaatgtgcatttataatgtaagattatgctcccagaaagctaaaaaaaagttagaattatcataattacataatccctattatacttcaactcttagacataatttttaatcatttatcttcaaaaagatgaatatttttaaattttttttcttttttttcaatcactattaagcacagttgagttaaatccagtaagcattctgttgggactaaagattttctgttcaaagcacacctaatgatttctctcttgtttcaattgtattaaatttatgagacctctattttatctctagtgtcagtttatttcatttccattttccacttgttttcctaaaataacaacaaaatgcaattaaaatgtgtaaataatgctgcttacaacacctccatagctaagtgtggtataaataaaagtggtatggcactagcacattaaaaaaggaggcttgaaatatcaacatttaatgtaaaaaaagtacaagtacagtaatggaaagctgaatgtttaaagatttggaaactcttggaagcatgcttgtgttgctctaccgaattccaaaggcaaacagttttattttaataatttcgttagctgggcatggtgacatgtgtctgtagtcccaacaacttgggaggtggagacaggaggatcgcttgagcccaggaatttgaatccagcctgggcaacatagcaagaccctggatctgttttctgtacctatagttttctctatgataataacaaaataataataattttgttaatgttcagagcatgagtgagctccacctgacaactcttataatgtcaaatgatactgacgtcaacaaaacaacttagacaattcttgaaatttgcttatttatctgatacatttgttgagagtctattatgtgcaagtggtatcaagtaaaaaacccagtgcatatccttgaaccacttggagagaactggaggggatggaaaagcgagggatatctgttcacagcagagtgtcatgtgggaagaggacatgtccttgaaccacttggagcgaaccgtaggggatggaaaagtgagggacatctattcactgcagagtgtcatgtgaggagaggacaaggaacagggaggcacgggggttggatgagctctcttcctggttcttgaaaatgccacgaatgttggtggtagcaggaatggcaaagagcaccatgagtcagggacgtgtcatctccaaaaggtctagggcagagtatttccttcccaagaaaccagtgtcccataattcacctgctggaacccctgtgcacaaagggattgtgtgattaatgtagattttggtgtttcatattgtagcaacttaataaggtatgtgcccagcttctaaatgaaggctataatcacttttccatagtttatgaattatgaagttggattcccatcccaaatgctgtccaagttttttggcttcaaaaccaattaaaatgatgaatagctgtgaaaagaaccagaagtgcatttaatctttcttcagaacagttggggatcagttcttttttgtcacatttcacattagctgggaacataaacttggtcttgttcaaaggttcaaactacttcttcctgaaagagaaccgatctacttaactttttttttccccagctattataaacactgagatatttacaaagtgccttgtacttctttctgtttatctcccaaggtcacgacactctatttgcatcttctcttagcaatgttatcctaaaaagaatcatcaaagcaaagattaactgttacaagaaaaaacaaataagcgagaagattacttacaaatttcgggggttggtttattatggatgcaaaaatgagtagaaactcaagtccctgagtccacctttcatgacggtagtcctgattttgctatcatttaatacaacttaggtcttaatgttctcactcagtgctgagtgtgctgggataagcaaggtgttcacagtcttgtacatttttttctttactttttatcataaaaatgagctgcagatgtcatgcagtgcagagagaagagaatgctttctgagtcagaaggtcacattttttgtactcaaccacttctagctggaaaaccttgagcaaattacataatctcatggagactcagttttcttacctgtagaatgggggttataatatttaattctcaaaactgctgtggggctcacacaaaattaatttgtgctgaattacacatatttgtaatttatacataaaacttatatgtatatgtataatagcaacagacccctgatacagtatttattattcatatacctgtccttttgacagaaggaaaaaacatcatctaagatgtgttttagacaaagtttccaatcaatgatatttggacacaacagccccttcgatgaggtgactcagctatcagtgaactcatctttgctatttttagagctgaaaaaggagaagcaggtgatactgaagttgtgtaatcagtctcagggggagggctataaactagtgtctctgtctctctcaggacatctggactcaaaggtagtggcctcaacctcgccagccattcaaaggcaagcagaactctcacagaggaggcaagggcggagaagctttgagcatctctacaacatcagagaacacccagtcaaaagagagggaaacacaaattgacttgtacctcatcaccttgacaacacaaatttagactctggctgctacattatcttctggttccttttccggagctgctctccttgagctgatttacacggttgctattgtagacccttgactgtacacccagtctttgtggaactccaagaatcaggcttcaattgtactttgagccagctacactgggccccttcaaccctcagccttctctccaggcaagtccataactgcagctgtggtaagcccatctgcaggctgccctcttcctgtcctgagtcccggagggcatccctgtgtgatcactggccttaacctctcattaagctatcaaagctaccttccactgcttttcttaaacccacgtcttttctatttccttcaacttcaaattagccattgtttccacatcatcctctcatgacatgatagggaatgaagtgatgatggctcacagcactgctggggctgcttttacaagaagctcactcaaagtcaacttattttttttttttttgaaacagggtctcactgtgttgcccaagctaggatgatacagttgcacaatcatagcttgctgcagcctcaactcccaggttcaagagatcctcccgcctcagcctcctgagtagctgggactacaggtgcgtaccaccatgcctggttaatattttttatactttttgtagacatggagtcttgccatgttgcccaggctgagtcaaggtcagttttgtcaccatggggggcatagagagacctcagcagtgaaggcctctaggaaatgggagaaatccaaccaggctggaacaaggctgggagaatcggccagttctagggcagttgcctaagtagaatgggtcatgaattcgaatctgcttcaagcgatactcaggtcaaatttggacaatgaggccaagcaaagacttgagcacagaatcaaagcacacctagagttacctatgtgcatctccgtttttgctaaatccaaattacaccttactatactgttaacttttatttgtctatatcatttgttggaatccagaaaacatacattgtttctttccaggaaaaagtcaggtataaaaataagtgtgtgttgaaatataagcacattttaaaaagaaattagctcctattctcattcctgcagcttggcattgagtttgtctgtaattgggtgtgttttaaaattaaaaatttgaaataaacgttaagcagcaggagtcaaaaataattcagaccgtaatattcatcaaaacttgtttaatagcaggaaaccctccactctgaacttttactcttctttcttgcagaatcaatccctccagcagccctcaactaccagaagcacaaaaattcaatatatttttttttttgagatggagtctcactctgtcgcccaggctggagtgcagtggcatgatctcggctcactgcaacctccacctcctaggttcaagcaattctctgcttcagcctcccaagtagctgagattacaggtgcccgccaccatgcccagctgatttttgtatttttagtagagatggggtttcaccatcttggccaggctggtcttgaactcctgacctcatgatccacctgcctcggcctcccaaagtgctgggattacaagtgtgagccgccgcccccggccaaattcaataatattatgcttagtagtcacacactttctcttgttttcttttgttttctttggctcattagacctctccttcagaaccaaagaaatccattgtgacaactctgttctcagagctgactttttccatagagagaacttcagtctgagacatgccaaggagttcttgacgctcccaaaattaacacctttcaatctttactattagagattaacttgtttcaatgcccattctcttctgttaaagcagataatattgggaaaggcaatgtctgaatgtatttctgccaagatgtcgatggtttatcaaaatcaatttcttcctgtggaagagtttaggtgcaaggggaggagagaaagtgagagaagattataacagggaggctatggatgcagaaaggaaaagcggggaatcaaaggcaaacctgccacccatttcacaaataaaagaatcagtgtgggctggatgcagtgtctcatgcctgcaatcccaatactttaggaggccaaggtgggagggtcgcttgaggccaggaatttgagaccagcctgggcaacacagtgaaactctgtctttacaatttttttttaattagccaggcatgatggcacacgcctgtagtttcagctactctggagactgaggtgggaagatcacttgagcccaggagttggaggctgcagtgagggatgattgtgccactgcattctagcctgggttacagagtgagatcctgtctcaaaaaaaaaaaaaaaaaaaaaaatgcagattcagtcagtctgggctggggcctgagattctggatttctgacaagttctcaggtaatgtcagtgctgctagtacacagatcacattttaagccacaagaaggctaggatatgaggtatgaacaaaggtgttagctcagtggttctcaacctggactatacatcagaaccaccaaaagaggttctgttgggtttgttggaggtttgtttttttttttaagctcctgatgctcaagccccaccccagattaattaaatcagaatctaggaattgctcaagtatttgtatttctaaaagctctccaggtgattctcttgtgcagcttgagttaggaaccactgttagttgataactgaaggtgctattaaaaattccataatatatgagctcatgaaggctaatgagacaccccagctaagggcatcttcctctgcaacagcaatttgctattgtacaatgggggcaaacagttggtgctcaataaatttgttcaatgaaaaaaaataagtgattggctgaatgcatgaatgaatggaaatgtttgaagtcaacagtctatggaatgaaaaggattacagtcctattatcaaaatgacaagtggcaggatgggtattttaagacagatcatcttttccatcactctttcaaataccccatagaagtacttaaatcttggcccacttttaagcctgactttgttaataactggaggagtcaaagccacaaattttccacaccattactttattccagtgtttgccaaaccaaccaacagtcactatacacttttgctactggtgttattatttacctagtatgtttctttaaattgacttactttttaacataaacaaatgtattttaaagggaaactataaatcactatttcaaatagaaaagcaactaatattccatgacatcagtagaattgacagtcaaaataaatgcaacgtaagcaactgaagcagggtgtttctgcctgccaatgcttgcctctgtcagataagaagaaggattaacaagtatacggaggtgttaaagccatgggggcacttagcagagactttgtcactggcataataaggattgcaggagcgttttgcaaggagccacagtcctgccgtgcgatgccatgttatttaacatgaaaagcaggcaccacgtgtaagcatctcatggcattttcagtcaatgattgtcaagctgtactcagaaacccaggggccaccaggtagtgttgaagaggctctagaaaaaagaggaagtatttcagattctgaggaattcagtcgtcagtgttatttgtcttatagagagtatgatttttttttaaatcctatttctataaggaacaacataatcaacagagaacaaagaaacaggttgaaccctgccattgaaatcaggagaattaaccttctcattggaggcatatttgctggtttaggcctcaaaggcattacatcaaccttggatgagacaatttactaaataaaaccatgttattaaaaaaatgaatggaccatacaaaataatatatttcatgtgctcccctagctctttagtgaagtatggccctctgtgggaggttaaattattagctaaatgtatatacttggatttaaacagaatgatccactgatgttctaggaagtaaatgcactaacttattcttttttatttgccaggtatttgcttttcttttaaataatgcatgcagtagaatatgattaatataattctgatgcagaaaagcaagattgcacacttaggagagaggtctctggagccagactgcctggtctaaatccctgctctgcccttcatcatctgtgtgaccttgggcaaagtattcaacctctctgtgcctacactgccctgcttataggatgaggatgacaataagggtattacccacataaggacatcataaggatgagtaatgcatacaaaatatctaagagtcccctatacaaaatacgcactccatatgtgctacctgatatcattacagtaaaaaaaaattacacaaaatgtaatttttactaattttaattacaaaatgtaattaaaactaagtcttccttccaccctagaccccacgcctctccccaggcaaagtactgtaaaaagacccttgtgcttcttctcagaactactctatacttaccatcaagtccatccctctcttctgtgcaaatgggagcccactatccactctattctacatattgccttttttgcttaacaacatttcttgggaatgagttcattgctagtttcatacctcattctttgccagagctgcagagttttgcatcatatgggtgcaccagaatttctttaactcatccccagtgttggagatttaggttgtttctaatatttcactattacagtcactgccagaatgaatatatttaaatatacatctttcattcatatggaagaatatctttagggtagagtcttagaggtggaattgctgggtcaaacagtccattcatgtttattttgatagatattgccaaatttctcttcaaagagattgtgccaacttccataccaaccaaccacatacagaagcacctgtgtcccctcattctcaaaataatattttaaatacattaacaagatatacaaggtaatcaagttttttagtctgtttgagctgatataacaaaatatcttagactgagtaatttataagcaacagaaatctattggctacagttctggagaccagaattccaagaccaaggtgccagcagatgtggtgtctggtgaaggcctgttcctcatacacaaggacttcctgccacatcttcacatagtggaaatgttaaacaggctccctcaggcctcttttataagggcactaatcccgttcatgagggctccaccctcatgacctaattacctcccaaggaccccacctcttaatacaaacacacagggggttatatgtcaacatatgaattttggagggacaccaacattcagactatggcaccaaggaatgctattatatggaagcagttatcaaaagattgaaattacacatctgtgaaatgctaacatatgtcctttattaatgcatcaaataacaaaatctagtggcaggtaggggtgtgctgaaaagatactttttagcataccggcaacaaccctaatgtggaatgaagatacatgttgatgatatgctcacaggtactgctaataatactgttgtttgtacttcccattcgtaattgaaggaaatgcttgatttgaggtggtggctagtgcaaataacaatgtaaatttttccacccaagttttagagcctatcttggagccagctcttagagcctcattccaatgaatggcagcttatttttaatacatcaggtcagctccaggaatgtacgcttttagggaagctcttaaaattcatgtgtgggaatcagcctccatctagcctaatacatgcttcactggccttctaaaatagcaagccgagcaagaagacatagacaggcaaaggccactctaaagataccctccggaggtgtctgcctcggctgttacttagagcaactgtttgctccttcctgcaatacagctgcactcctccaccacagggttttggaaaatatcaattaaataatatattttaaacaactttgaaaaagataaaggcatctttttaatttggggcaccctattagccattaagaattaatgttattatctcctcatctgtttagtgtttagaacctctcccaagtctgctgataatggtggcaatgagggccaaaggatggagctgcttagctctggtaaatactggccaggcacagaggctcatgcctgtaatcccagcactttgggaggctgaggcaggcagatcacttgacgtctggagttcgagaccagcctggcctggccaacatggcaaaaccccgtctctactaaaaattagccaggcatggtggcacacctgtaatcccagctactcaggaggctgaggcaggagaatcacttgaaccctagggacagaggttgcagtgagctgagattatgcccccgcactcaagcctgggcaacagagcaagactctgtctcaaaaaaaaaaaaaaaaaggcatggtggctcatgcctgtaatcccagcactttgggaggccaaggcgggtggatcacgaggttaggagatcaagaccatcctggctaatatagtgaaccccgtctctactaaaagtacaaaaacaaaattagccaggcgtggtggtgggctcctgtagtcccagctactcgggaggctgaggcgggagaatggcatgaacctgggaggcggagcttgcagtgagccaagatcacgccactgcactccagcctgggcgacagagcgagactccgtctcaaaaaaaaaaagaaaagaaaagaagaaaagaaaacataaaatgtccagccacccaggacacaactgtgtggcctgaccgttcagttgtatcactcctcttatctggaaagtgctccagtgactacagaagttgctagaatttccaaaagcaagaagaaagtgatgggaaaatgtgtcaaatccacaatgggagaacactgtgtcactagaaaattatatgaccctggcaaccttaggagtatggaagaaagatttcaaacaagtttctgactatgtatctttttctaaatttttttgaatgctgaagaaatgttaaatttcattaagttttacagccagatttaatatagacataaatccctttaatgttcgtttcagtcaaaagtgagcggaacattatcgttaaaccagtgcatgtgggagaattacttgaggaaaatcaaaataggcacagttgggaacattaagccgtggccatattagacgcaagtaggcgcaatagcaaaattctttaggctctaatggactgggctattttgcttctcagtttccatacagatgagctttgttctggggcaatatggttgcagtttgagagtctatctgaaggagctcatttctctttcattagtccatgagcacagtgcaatttcagctaatactgttacacagctcctagctgggttatttggttaaatgccttcagggaaagtagcaagacagaataaaaggacaaatgcaatgcggtttcttgttctgagttcctgtagctgtggaattacattggcagttaatcattaccacgttgtactcgtgatcataaactcctgttatttaagatgttattcaagtctcacaagaaacatcttgtcttctgtggcacaatttccttgaggtcgggtttgtgcacaactataaccatagagacctgtttcttgtgcttcgtggacatgctagtaggtatatagtgccatttgtgtgaaattgaaaatgacattccctactggtgggtgaactgggaaacagcaccctgtctatgggcaaattagaaaagatgtccccttctgggtggacaaatgagcaaaaggcagcccctctgggctgaccaattcttttttaaagcctcctccaccttggggtgtgggggtggtgcacatggcttggtaagtccaatgcagaccctagttgctccctgtgggcaggaacccctggcgcaatgcacaacctgcacaactgtacacaacagccctgattacagaatccattttcacaattttgtagttggaccacagagtttgcccctcagtactctaaaaatatctgttcaatcacatcagtggatgtccatattaaatacattggtcttctttcttatggcaagtaactgccactctctgccaagggcagtgttctaaccttggaaacaaacaggacactcgtaggttgagaaacagaagaactagaggacggtgactcctaggggcttgaccagtggtgggcagtggagtggtggaaaccacggtggcacctcttcaccatcgcaatgtaatgctctcctcagcctccatcattacctggtgagctggggctcagtatctgcctgataacccaccttcagctagcatgagacacaggaggagcaagcttcaaactcccaacaaggtagtcagcctagttcataccagattcagtggctgtagcccaggagagaacgaggtatggggcacgtatgtctcagagcagagagatctgcctagaaagacaaagactgagtgagaagctatagtgtgggctatcagagggcagcctgggagcccaagaggcctcggacattggtcagggattggcaaactctttccgataaaaggccactttgtaaatactttaggctttgtggggttttgtcacaacgacttatctctgctgttagagtgcaaaagcagcgactggcaattcataaacaaatggatgtggctgtgttccgatacaactttacttacaaaaacaggccatgggctgatttagctggtgggccatattttgtgacctttgctgtcggtgatcaaagaaagaggacacaacaggagaagtcaggtgaggcattgcccatactgcgtggggcaacgtgcttgccagcttacattccttgtttcattttatcctcacagcaaccaactagtaacagttttaccacctacattttgaagatgaggaaactacagtttctaaaaaataggaaaatttccagggtcaaaaacagcctcatttcaaaaccaagtctgtttgacttgaatgtctctcttccttcccctacatcaagctggtacctgcagacgtatttgtctagggcagcccagccagggaagcccattgatcacagaggcattaaattccagatttgaaggtatggatggcagtgccagggccaggtgcaatctcaggagcctcagaagcttctctgtggatgtaaaagcaatgggcacagccaccattgactgcaggagctctcacctctctcatcaccagccattcagatagacaagccccaaatccgaaaggtgtcatctgtgggcctgcgtctttgatagccaggcaattacagcacctcatatataaaaagccagaggaatctgtgaatataataagtgactgtcctttcttagcgtggtgcaggccatctgtttgaaaagtacacactgcaaacaatgccaagttgtaattattaaactttctagctaagagcgagtctcatctttcttcctaattatgcattcaaatattcagaaattaagccttagaattattatataccagggatgggtttttttcccctgtgcattaaacttttagaagagaacatgagccatcatcagaagtttctcccagaaataactcccagagaagccctgaggtcagcttggaatcaacccaaccttctcactttcggtgtgatggtacaatgataattcaagttcttaatgatgactctgaatcatctcgatcctgaatcatcagagattaaattattttcaccaaacagctagtattttctaaagcaggaaaatcgattaaaggatttcagtaaaaagttagagaagtccaaacaaagcaagcatctggcaagcctcggtgaccagaacattaaattcaccaaacaccacctgctccaaatgtccatgttaatggcaattatagaagactccagtagcattcaaggccagtttaacttattcctgtacacaaataactttatgggagacagcattgtaattcaaatcaataaatgactcggtttggctgtacaagcataaacagaacgcttgcaaaatatggttcctccttgctagaaaccatttgatttttagccagaaaacatacagccaaacaagaataacaactgtttgccttccttaatgttcagtgtagactgttacccaaggaattaagcattagtcatcaaaacttcattgcaaaggcaacaaaataattggggttcctgagttatcatccatttcaacattcagaggccaatttgaccccagacaatacaaggtctttcttcttgttataaaagtggttgcagagttctgagggttctctgctgtaagctctgctctcagaactctccaggtcctgcttccaacccctgccatgtccggccaaactattttcccagagtcaggagcagagccaacagcctcactcagacagaccccagtgataattatcagcccaaaagataagcccaagtggaaagtttgagaagccagtcactcaggcagcagctacaaagggacaaacactctctagttttccctcactgacttcatttccctctgccagcctggtagaaacatggtctcagtccgctcaggttttgcccctgtcctccctgtctccagaagcgccctcaagcttcaaaagattcatacagccttccagagagggagacggggacctagtgctggttttcatcatctgtccactctggcttctgcagtaacaccattcccattggcctcggtggtcagttcacccagatcctgcctaaaccctggatgcttattgtcctgaccacccgaatgtcctaggccagctagttctcagcgtcacatcctcaccaacctccgctccctgctctccactggggatcaagggaatgcaggatggagctgccccaagcctgtagctcagatgcctcacaggggcatttctgatctgcaacactatgtccctgttgtgagctgagtcccaggcctctctgaggttggacatcccagcgtgcctcttcccactccaacagcacacctcagaaggaagaggcagcctcaggggcccgctgagtggccactcgtgctggatttccacccacctcaccttagggaattttaattttttctaaagagaaacaaaccagattgggcagatactcttccaaatctactgcttaagtttcaatctcagctttgaagcccagaaaaaaaagtattaacttgtgtttctctcgatattcctaccccactaactatacctaagaatgctgttatctctgaaaaattcagaggttaggagaacagaacacccttggggaagacaagttactatttcaaaatagtatctctgaaaaaaacagaaatccaaatatcgcatgggaagtcagtgggagaaaggccaaatctgagagggtctcccaggaacacggattgcgggccagatacagaattaaacttttaaagtgaatgaaagcaatctggggtctaagtggggaaggagtcgaaaaactggcaacttgccagtagttatggtcagtggagacgagaagacttcctcctctctgaaagccaagtgttgaatgaagacctagatcctggaataaaggatcaacatgcttaagactccaggcaaattactgggccaaatttcagggtgactcctgcccaagtacagcatttatttaaataaattagcattacaactctgattattacaactactggtgattttgtcacctaaacaataaaacaaaaattaatggaattagtggagttgctcttaaaaacattatgccaccacattaggcttacaaactcaagtgtgtcacaaaacttgtgtgttatcttatgataaagcacagttcctaaatatgtctcaggacccataacatcaagaaatgccaaagctggaatgtgcctctaacccagtgtttcctggcccagtgtatactgtgaaccaagaagccatctggggtcttcatttcagacccccaaaacaaaggagaggagaatgagatgaggaaaaaggaacttgagagagagcagcttctccaagcaagcagagaagggaatggggaaggaatgggttattcactaaacaatggtggatcatctcccattacagaccagaataaaaggcaaaccaactaaagacctaaatgttaaagaaaaaaaaaacccacaaaattgcttagacagttttagtggctacataattattttatgtggggaaagattctcagtgggaaaaaggaaggtgctggatgacagagaatagtacacttttgaccatatgctgtagggcataagagttcatacagatacttattgaagtttgtaatggtacatttctttgtttgatctttcgattgatgtctgttcccgcaactaggctataagttacataagggcagggatgccaccattgtattcccgtacttagcaaagtctctgacatatattggactcttaatgatatttgttgagtgaataaataaggtcaattgtggacaacgtcagggccttgggcatggggtttaaaacccataaggggaaaggaaaccagcctatgctagtctgaaggaagaagctggttgtgagctttctgtgtaaagcaaggaaactctagaggccatctcacttgtgatgtgagaactagaacatctggccatctgtccaaggaaggattaaggaagcttaccctacatcttgggttccaggtgaaatccattaaccacaagggctacatcaacttgaaaggaagacagtcctggagaacacagggcttacatttgctaaccccttgaaggcttgaaataggatgaaatggggaagcctgaaagagaatatcaagagaggatggaaaaccccaaagacatgctttggctccaacacaattttgtgaggtttggtccagtgcagcacactaatccagcactccagggaggactagaaatgtttaaagtctcccagcgctttccctttactgcgcctctggctgtacggacctaatgagatgccttgtgtttttcagaatgccgaagcaagttacgacttcagcagcaacgacccctatccttaccctcggtacacagatgactggtttaacaggtaaactgggccttgggaggtctctttgactttaggctttggggttttattctactttgttttgtttcaggcttgactaccaccagcaaaataatccccatgcttcattaaattatattgtgatttttcttcttagtggttacattctctaaagtgaaatttttaatattacaatcttcctctagaataatcttttgactgttttgttctgctaacttgaaattatttgctactttaatccattaaagagaaaagaaaatagaaataagaagttctttctcaacccattacaaggtgatttaaaacatgctgattttgctttatgtgttgaaactgtcgtagagaagtattttgccccatgggtctatgtgtttttgaaaagcattctgtacgctttctgctataaccccataacagctcatggagtccctttcaacaaaacagtaagtgtgattggcagaggtttgaagtattgcttgggacaaagatcctatgatgtcaaactacccaaacagtccatccaagagaataattttccttcagcttgttttgccactaaacatggaaatgtggtctcttttttcttcaagtaaacatttttcttaaatggttaattacatataagagatatgaagaaataaagatgtgcggtttgctcaatgaaagaatactgtaatttttaaacctagtgtttccctgttattgacgtccttgggtgaagttcataaaaacatatgaacttcaattagttgtataaaaatatatgatgtgcagagcactttatccatttttttttttatttctcatggcactctaagtagcacataaaacaaatgttgtcatttttagtttagtgataaggaaacaggctcagaagggttgaagggcttccttggtcaaacagttaaaattcaagtcaaagccaagattagccccatgcttcaaattatttccaaatccacatttgtactattctttgctgagtatcatttctattatttgatacaggcagcatgatgaccagaatatgttcaagggtagagcctcagtggacaggaagcttagattctgtctctaaagttagcaagttgacctgagacccctcagtctcatcaagggttgacacagggtacacaggttctgagtacaaatgcagaaaataagaaaaaagaaaatgaaatttaattttgtaatattttgtaaagatcattgctgatgtcggatagcacaattcattctctatccacatcacctgcaacctgaaaatgacatacaatgcttggaggtgtgtgtttagaggatgagaatgtataaaaaaggtctgaaaacttttggcatgaagtgtgttttatctctgtgacttctaaccctagatggtagcatatatttagcaaataaaccatttcagacacaagaatgtgaagttaccaaatgtgtgccattaagctggggtttagacagaattggcagtggccatccagggcacagtgctgagaagggccatgagagggtctggcttcagcaggattgattaccagctctccgcatgaatatcagaaagtgcagtggcaacatatccactggctacttgctgtctttctgtaactagtaggtactaaattagtctttgatggattgatgtaagcacaaaaatataaccaatggaaagattatcccccaatctcattttctgaacccaaacaaaatctaccctagtcaaatcttcctgggcaatgtgctataaaaatactccttaaaaaaactaaaaggttccactccaagatggccaaataggaacagctctggtctgcagctcccagcatgatcgacgcagaagatgggcaatttctgcatttccaactgaggtatctggttcatctcattgggactagttggacagtgggtgcaaggggtcggaggatttccctttcctagccaaaggaagccgtgacagactgtacctggaaaaatgggacacttctgcccaaatactgtgcttttcccatggtcttagcaaacagcagaccaggagattctctcccatgtctgggttggcaggtcccacgcccatggagctttgctcactgctagtgcagcagtctgagattgatctgcaaggcagcagcctgatggagggaggctgagacttgagtaggtaaaaaaaagtggccaggaagctcagactgggcagagcccaccacagctcagcaaggtctactgcctctatagactccacctctgtgggcagggcatagctggaaaaaaggagcagaagcttctgcagacttaaacgcccctgtctgacagatctgaagagggcagtggttctcccagcatggcatttgagctctgagaatggacagactgcctcctcaagtgggtcccttacccccatgtagcctaactaggagacacctcccagtaggggccaacagacagctcacaaaggtgggtgcccctctaggacaaagcttcaagaggaaagatcaggcagcaatatttgctgttctgcaatatttgctgttctgcagcctctgctggtgatacccaggcaaacagggtctggagtgggcctccaacagcctgcagctgagggacctgactgttagaaggaaaactaacaaacagaaaggaatagcatcaacatcaacaaaaaggacatccacacgaaaaccccatttgtagatcaccaacatcaaagaccaaaggtagataaaaccacaaatatggggagaaaccagagcagaaaagctgaaaattctaaaaaacgagtgcctcttctcctccaaaggaccgcagctcctcgacagcaacagaacaaagctggatggaaaatgactttgatgagttgacagaagtaggcttcagaagctcagtaataacaaacttgtccaagctaaaggagcatattctaacccattgcaaggaagctaaaaaccttgaaaaaaggttagatgaatggctaaccagaataaacagtgtagagaagactttaaatgacctgatggagctgaaaaccatggcacgagaacttcgtgacgcatgcaaaagcttcaatagccgatttgatcaagtggaagaaagggtaacagtgattgaagatcaaattaatgaaataaagtgagaagacaaggttagagaaaaaagagtaaaaagaaatgaaaaaaccctccaagaaatatgggactatgtgaaaagatcaaatctacgtttgattagtgtacttgaaactgacagggagaatggaaccaagttggaaaacactcttcaggatattatccaggagaacttccccaacctagcaaggcaggccaacattcagattcaggaaatacagagaacaccacaaagatactcctcaagaagaggaactccaagacacatacttgtcagattcaccaaagttgaaatgaaggaaaaaatgttaagggtagccagagagaaaggtcgggttacccacaaagggaagcccatcagactaacagcagatctctcagcagaaaccctacaagccagaggagagtggggaccaatattcaacattcttaaagaaaagaattttcaacccagaatttcatatccagccaaactaagcttcataagtgaaggagaaataaaatcctttacagacaagcaaatgctgagagattttgtcaccaccaggcctgccttacaagagctcctgaaggaagcactaaacatggaaaggaacaaccagtaccagccactgcaaaaacaccccaaattgcaaagaccatcaatgctaggaagaaactgcatcaactaacgggcaaaataaccagctaacatcataatgacagaatcaaattcacacataacaatattaaccttaaatgtaaatgggctaaatgccccaattaaaagacacagacaggcaaattggataaagagtcaagacccatcagtgtgctgtattcaggagacccatctcacgtgcggagacacatataggctcaaaattaagggatggaggaagatctaccaagcaaatggaaaacaaaaaaaacacaagggttgcaattctagtctctgataaaacagactttaaaccaacaaagatcaaaagagacaaagaagaccattacataatggtaaagggatcaattcaacaagaagagctaactatcctaaatatatatgcacccaatacaggagcacccagattcataaagcaagtccttagagacctacaaagagacttagagtcccacacaataataaggggagactttaacaccccactgtcaatattagacagatcaacgagacagaaggttaacaaggatatccaggcttgaactcagctctggaccaagtggacctaatagacatctacagaattctccaccccaaatcaacagaatatacattcttctcagcatcacatcgcacttattccaaaattgaccgcataattggaagtaaagcactcctcagcaaatgtaaaagaaaagaaatcacaacaaactgtctctcagaccacagtgcaatcaaattagaactcaggattaagaaactcactcaaaaccacacaactacatggaaactgaacaacctgctcctgaatgactactgggtacataacgaaatgaaggcagaaataaagacattctttgaaaccaatgagaacaaagacaaaacataccagaatctctgggacacatttaaagcaatgtgtagagggaaatttatagcactaaatgcccacaagagaaagcaggaaagatctaaaatcgacaccctaacatcacaattaaaagaactagagaagcgacagtgaacaaattcaaaagctagcagaaggcaagaaataactaagatcagagcagaactgaaggagctagagacacaaaaaacccttcaaaaaaaatcgatgaatccaggagctggttttttgaaaagatcaacaaaagtgatagatcactagcaagactaataaagatgaaaagagagaaaaatcaaatagacgcattcaaaaatgataaaggggatatcaccaccgatcccacagaaatacaaactaccatcagagaatactataaacacctctacacaaataaactagaaaatctagaagaaatggataaattcctgaacacaaacaccctcccaagactaaaccaggaagaagttgaatctctgaatagaccaataacaggctctgaaattgaggcaataattaatagcctaccaaccaaaaaaagtccaggaccagacggattcacagccaaattctaccagaggtacaaagaggagcggttaccgttccttgtgaaactattccagtcaacagaaaaagagggaatcctccctaactcattttatgaggccagcatcatcctgataccaaagcctggcagagacacaacaaaaaaagagaattttagaccaatgtccctgatgaacattgatgcaaaaatcctcaataaaatactggcaaaccaaatccagcagcacatcaaaaagcttatccgccacgatcaagtcagcttcatccctggaatgcaaggctggttcaacatatgcaaatcagtaaacgtaatccatcacataaacagaaccaatgacaaaaaccacatgattatctcaacagatgcagaaaaggcctttgacaaaattcaacagcccttcatgctaaaaactctcaataaactagatattgatgaaatgtatctcaaaataataagagctatttatgacaaaaccacagccaatatcatactgaatgggcaaaaactggaagcattccctttgaaaaccagcacaagacgaggatgccctctgtcaccactcctattcaacatagtgttggaagttctggccagggcaatcaggcaagagaaagaaataacggtattcaaataggaaaaaaggaagtcaaattgtccctgtttgcagatgacatgattgtatatctagaaaaccccatcgtctcagcccaaaatctccttaagctgagaagcaacttcagcaaagtctcaggatacaaaaatcaatgtgcaaaaatcacaagcatttctatacaccaataacagacaaacagaaagtcaaatcataagtgaactcccattcacaattgctacaaagagaataaaatacctaggaatccaacttacaagggatgtgaaggacctcttcaaggagaacaataaactgctgctcaacaaaagaggacacaaacaaatggaagaacattccatgctcatggataggaagaatgaatatcatggaaatggccatactgcccaaggtaatttgtagattcaatgccatccccatcaagctaccaatgactttcttcacagaattggaaaaaaactactttaaagttcatattgaaccaaaaaagagcccgcattgccaaaacaatcctatgccaaaagaacaaagctggaggcatcacgctacctgacttcaaaccataatacaaggctacagtaaccaaaacagcatggcactggtaccaaaacagatatatagaacagaacagaggcctcagaaataacaccacacatctacaactgcctgatctttgacaaacctgacaaacacaataaatggggaaaggattccctatttaataaatggtgctggcaaaactggctagccacatgtagaaagctgaaactcgatcccttccttataccttatacaaaaattaattcaagatggattaaagacttaaatgttagacctaaaaccatcaaaaccctagaagaaaacctaggcaataccactcaggacataggcatggacaaggacttcatgactaaaacaccaaaagcaatggcaacaaaagccaaaatagacaaatgggatctaattaaacttaagagcttctgcacggcagaagaaactaccatcagagtgaacaggcagcctgcagaatgggagaaaatttttgcaatctacccatctgacaaagggctaatatccagaatctacaaagaacttaaacaaatttacaagaaaaagacaaccccatcaaaaagtgggtgaaggatatgaacagacacttctcaaaagaagacatttatgcagccaacagacacatgaaaaaatgctcatcatcattggtcatcagagaaatgcaaatcaaaaccacaatgagataccatctcacaccagttagaatggtgatcattaaaaagtcaggaaacaacaaatgctggagaggatgtggagaaataggaacgcttttgcactgttggtgggagtgtaaattggttcaaccattgtggaagacagtatggtgattcctcaaggatctagaactagaaatatcatttgacccagcaatccaactactggatatatacccaaaggattataaatcatgctactataaaaacacatgcacacatatgtttattgtggcactattgacaatagcaaagacttggaaccaacccaaatgtccatcaatgatagactggattaagaaaatgtggcacatatacatcacagaatactgtgcagccataaaaaaggatgagttcatgtccttttcagggacatggatgaagctggaaatcatcattctcagcacaccatcacaaggacagaaaaccaaacactgcatgttctcactcataggtgggaattgaacaatgagaacacttggacacagggcggggaacatcacacaccagggcctgtcagggggtgtggcagactgggggaggggtagcattaggagaaatacctcatgtaaatgacaagttggtgggtgcagcaaatcaacatggcacatgtatacctatgtaacaaacctgcacgttgtgcacgtgtaccctagaacttaaagtataaaaaaaagaaaatttaagaaaaactaaaaacactaaggaaatgtcttctctcttaaatatttcatttgcaaacttgttctcaaaattataattttaaaccagctaaaaacctccaattaggactaattagtgcttagggcaataaaactcatcattgtcagcggtaagaattcccaagtgtccaattacccaagacacagtcatagtgactcaggcaagcatgatccccatgccttagggagccaatgattaagacagagtgtccactttgaccagtaaatgggttcttttcaattatcaagtcattttcaaagatcctcacgcactatggcttgttattacaaagactggatgatgccaccactcaaatcgcagctactttcaaacataactaccattgtaaatgattatgggaggctggtgaggtgaagctcaagtccacagaaccaagaaaatccttagttcaaaacatcaccattaccctgaagatgattcctgcttgagtgaaggagaatttgaataaagcgtcccttccatgagtgtacgatatgtttatttcaaaacccctctgggatgaaatgatattatgcctgatgttttcttcagtattacttatggcttgtggcaggagggaagagaatgactgaagtatagaggcaataaaattggttatgggttaatcattgttaaagctctgtgatgagtacatgggattttactctatttttgtatgtttttgatttttttctaataacaagaagtaaatttaactagcatacggcataaaaagaggtaataacaaaactaggacttcagtttggtatcatgaaactgttttggtgtgcaagcttccaaggagcttgcaatgtcaaatgattgggcaacagatgcccaagttactacaatgcaaaaatgtagcccagactaaaataacacaaggacagctaatgcaagttgaacagttactgtatttaaggcactgttctgtgttttgcatgtattcattcaactaattctcgtagtaaccctctgaaataggtattatgattttccccttttggaaactgaggcacagagaggttaagttacttgtgcaaggttacagggctaataagaagtggaggcaggatttgatgccagtgggtcattggtctaggattttatctaaggcaataggtagagttgggagtagggaacgaatgtatcccagggcaaggatataatctggacaaagataggctggcggggaggtgcaggatatgttcaggaggtggtctggataactgctgtgggatttggaggctggtgcaggaggcagcattctaagaaggatccgcaagtgaggtggagcataaaagggttgaaaaagttgctaggagaaagaaataaattctgtggttgggtcagaaactgggccaggggcatagatgaggctcattctctcattacactcaagataatgctgctactctcagaagccccaatagcctggagcctggcacttgttgttggctggcataggacccagcatgagcctcccaccagctgtgcagacaccaaggcatcccacaggttcttcaggtgttttctgggcataggcaccaaatccgatgccccatctctgttcagcagagttggggctcttgagaaaggctggtgtcagcatgccctgaaactccagtatagggctgacatgctgagcagcgataggcttgttgctattaactattccagccacactgactgccacaaaggctagttacaatgcaggagcaattgcttcacaggaaaaggcagcggctgtccagcacgagattctcactgctgtgaaaatagaaaataaaatgcactataggggacactcaaagaagtaaaatgttccccttggttgggagactgagttcaatagcaacacatctctcctaggttttcctgacactttaaaccatcatctcataccctctgcatttactcattgttttcctttattaaactccacgccaagggtgctttaggaaaacaaacttcatacatatgcagaactgcttttagggaatgtgtatattagaatagcttgccttgtgctcgatttgcttttgttggattattcctgtttaagcagagcaagcgtatttattctactgtgaaccatttaataattacatgcagtatctgagctccagggatgtacttgaaatacagttaagacattttcaaaaagagtataattttctcttagcttgcaatgagcaaaatacatttgaccaaacaaaataataataatagtaactcaaattgtaaaaaggtagaaaatacacatttaatcagcatcagtaatgtgcaaaacagatataactgatttgctgagagctatcaggatttagcatcacattttttcccttgctggcactcaaaaaatattgactgactggttgatagatgagtggcatacctttcaaccatgccaagatgttgagtggccttgacatctgtccattgtcaagctgcctgctgctctcaaggtctgcagcccacgttttgtcaataatcttgcagccctgctcattttaggtcaatgtttggtgatgcattgcagatctgtattccattactgtgctgttgtccataaaaatctctcttgcatagcatttctttgacaggtgttcactactgaaatgtcatccctgccattgacgatatttatgaagcattggggacgcagcatactctatctattaaaccctaaacagtgagagattctaggttagatgcaattcttggctgcagaaagtttactataaattcaggaagagagaagacatttattactcaagcaaacaaaatggagggaaggaagatggataaatggaggctgaagaacatttatctctttgtgagccaatgtgattgatagcattagttaaaccttcaaataagaaaggttttctgggattaacttttattttcttattaaaagtcatacttcattctgaagaaccccaagcaacaggccacaaaaaagtgtgagaaaaaaggccctctctggttggctattttcacactgatgtaagctgataccttaccctggtgatacttaatggtttgggagtagatgaacatctttcccttatgtctttatgaactaattctgaaacacctcctggataataaaatgcaaactgttttcaaagacatagtctttttcatgtgagctttaagactacctcatcagtcgatattagctcaaaggttactgcttgtaaccaaccctttctacatccaaaccagagcacagtgaaatccaacagcatttaatttttaaatttctagtcccctacctggattagaaaagtatttattatttaaatttttccttcagctaaaaggagtagatgtaatatagatttaggggttatggagaaaattataaagatggtaaaagaaagacctatatttgggtataattagttctactttgtaagctaatgtgtacatgccatatagagattttatggtactcagacggcaatcaataactcttttcttaagagagagaaatacagcacattatgtagacaaatgtaatattatgttaattgcttggtatggaatgagtgatccctgaatcagttcccttatctataaacagggactaaagctcccaccttgaaggcttgtactgcggattcaagacaggtatagagtgcttggtacagagcatggcacatggtaagcactccctaaccgacaaccaatagagttgtgaaattcagcaaagagatttctacaggagctaagtcaaagattattcaacgacaaagaaaagtaggagaatttatgctacaggagtaaatgtagcattcacccacctttctcagacatctgctctctcatttaagcttttgacagaaactggataacagtcagctcaaggttaaactctctgtcaagattctagtgcctgtgtttctgcattgctgattgaaaaaggagttatagccaaagataccttgtatgcatgaaacaaagttgatctattaggaaatttgaaatgtctagcatctggcctcagaaagatgaggagtctgctcacttctccagaaagcaatgggtgcttgccagcagactcagggacttccccagaggcagctttgctcattctcacctgtcacctattctaacctattctgcctgagctattcatttctcatctattctatcaagtaggctcttgaaaccccaaagtcttaccctgtagagctcattggacattagccagcaaacgtggtcgacgccaaactagccaggaagtctctgcatttcagttctaatatgtctaacactggagcttctttctccaaagccaagggtgaaaagactgcagctggccaccatgggtcttctgttgtctaagaatctgtagatgcagagagactggagaccagaagacaaagacagcctcatgtgcatgaacttagccaagttgcacactggcttgctgactaatctgtcttatctccttatctctgtgaatgcagatccctgaaacactgttgtagaaactggttgtcagaaacagaactaaggagtcaattgaaacaatcataggaccagtagccaggaaaggaagagaggtaaaaaaaaaaaaaaaaaaaaaaaaaaaaaaagacgaaaaaatatctccacatcaaaattatcctaaaatccactattccaaaatgcctgaaaaaaatacacctaaaaaaactaaaaatcaggatattaatttgtactatatgaaatcggttctatgaagcagtcttgaaaaagactttatcataagttatttttagtttgttcagagtgataaatgcatgggtgacatacattttaaagaaaactaaatgatggtggaaacataggcaaaaacaaaagcatggacatgaaaagaaccaattgcagctgaaaaatacagcctgtggaataaaatctcaataaatggtataaaatctagcctggatgcacttgaggagttaattatcgaattgaagataacagcctgtttatcaaaaacctacagcaaacattattcttcatggtgaagctttgatagcattctctaagtctgacaagatgtgggttctccctatcatccctttaattcaacactatgctacatttcatagctgatcaaatagttataaatctaagaaaaggtgtgagatcattaagaagaaaattataaaatttacaaaagaataaaggagtcctaaataaatagagtggcatactaagctcagggataagaagatggaacaatataaagatatcatatcaaattaatatattaattcattgcaatttcaattaaagtttcaatagattattcagtggaactagacaaaattgttttaaaattgatatggaaaaacaagtggccaaaatagaagaagacaagtaaggaggaggaaaaaaggagaaaaaagaggaagagaatgaagataaagaagaagaagatgaggttgaagttcagcaacaacagaacaacagcaagatgggaagctttgccgaccggataccaaaacattacacaaccataataatatgagattgtagggttagcatacagagagacaaaaagatcaagaaacagaatagagagtgcaaaaacagacaccacataaaaggaaccctaatatatgattaagatagcaataaaaacaataaggaaatgatggagtgaaggtattcaataaatgtgataactatgcacatggggagaaataggcacccacaccacatactgagcataaataaattccaggagaatgaaagacctaaatggatataaatcttttaggaaaaaataaagaaaaacatctttatgatcatgacatagggactgatttcttcccttttctccccaattgatttagaagtttattttgccaaggttaagggtcatgacccatgacacagcctcaggaggtcctgagaacaggtgcccaaggtggttgagtcagagcttgattttatatgttttagggagacataagacattaatcaatacatgtgaagtagacattggcttggtctggaaaggcaggacatcttgaagcaggggcttccaggttataggtagattcaaagattttctgattggcaattggttgaattattacctaaagacctggaatcaatagaaaggtgtgtctgggttaagataagggtttgtggagaccagggttctttttatgtagatgaatctcctaagtggccactcttagaggcaatagatgacagatgattcctgttcagacctttaaaaggtgctagactctcagctaatctctccaggattggaaaaagatctggaaagggcagaggattctctacagaatgtaaattagggatggatttcttaagccactaaaccacatggaaaaataaatgattaataaagctggctacattaaaattaaacacttttgtacaaaaaaaaaagtcacaataaataaatttggaagacaagccacagactagaagacgtgcagcaaattttatggaaaaaaaggcttaatatagaaaatttgtaaagaacagctacaaatcaatgaaaaataaataaatacccttgtagaagaaatgggccaaggttattaacaggaaattcacagaaaagaaaatctaagccaaatagcctatgaaaagattaccttgctagtgatgaggaaatgcaaaatgaaacaataacataccatttcacaccaactggactagcaaaaatggtaacattcaacaatgatcaatgttgaaaaggattgagcaacaggattgctcacaccttgaaggaggtagtacatagccatataacctgttttaaatcctacaagaagacctcagagaaactattccttatgggtacatggaaataataaacaagaatgtttcttttcaaattatttgtaatagcaagcaaattgcaaacaaattaaatacctatcattagaagtataaataaataaatcacagcatatttataaatggactactacacagcactaaaaatggatgaactagaattcacaagttaacttcagaaaatgtagcaaatgaagccaattttacatagatcatacactaggaaattttatacagtttgaaacatgcaaagagtgacatgtatgcttatgcatacctgattataagttcataaaaatgttctgaacagcaaatttagtacacttgttacctctgaggaagcaaagaggggaaggaatggcatcagagagggcctcaaattgtatctgtaaagatttatgttgtttcttggcgcggagggggttgttttttgttttttgagacagagtctcactctgtcgcccaggctggagtgcagtggctccgtctcggctcactgtgacctccgcctctctggttcatgcgattctcctgcctcagcctcctgagtagctgagattacaggcacgcgccaccacgcctggctaatttttgtatttttagtagagacagggtttcaccatgttggtcaggctggtctcaaactcctgacctcgtgatctacccacctcagcctcccaaagtgctgggattacaggcgtgagccacagcgcccagccttttatttttatttgagacagtctcattctgtcacccaggctggagtgcagtggcgtaatcttggcacactgtaacctccgactcctaggttcaagcaattctcatgtctcagcctcccgagtagctagaactacagagacaggccaccatacctggctaatttttttgtgtttttagtagagacggggtttccaggctggtcttgaactcctgatctcaagcaatacgcccaccttggcctcccaaagtgctgggattacaggagtgagccaccacacccagcctataaagaattatgtttttctaaaaataatccaaagtaagaaaaatgtttggctttgatagacttggatggtggctatatgagagtcatcatactattcactgaaattgtctatatttttttaaatatttcataatttcacatatttaaataataagcctgagccaaaatggaaaccccaaagtgtcagacaggcccattcaccattaaaagacccacttctacacaccagcctcaaagtgcgcattaaataaacgaatgccaaaagtccatcatgcaccctgcacacacctagtgagagggtaggggaattcgaccactagacaaggcagccattttttttctgttcatcaaagactgctttgtactgatccttgtcacccaacatctctttttgtgggatccttcaaattagtttatgtcacttattattagaatttatccttccaaaacagtttatcgagtaggatctaataaaattataggaataatcaataggaataagattaaaatgtgctagttcatgttatcctagtagctgtaacaaataaatcttggccctgaaatattagtggcttagcggcttagcaccaaaagaagtgtatcactcacccaccagtccatctctgtgttcctggtggagcagctctcctctaagcagtgattaggggatgcagactcctttcatctttggcataggtttccaatgttcctgggcttttttgcatcaaactacttgaggggaaagagagtgaataattgcccaagggtaatttttatgggccaggttaacaaatagcatttacccatctgctcacatatttgccataactcagtcacatggccacatacaagtgcaagggaggatgggagccttactgcagcctggggagaaaagagaatgactggtgaccatttagcattttctgccaccaacaaaaaccatgttacagagtgagagacaatactgtaccagaatacctagttgaatggtgatatggtttgactctgtgtctccactgaaatctcatcttgaattgtaattgccataatccccatgtgtcaagggcaagaccaggtggaggtaactgaatcatggggtcagtttcccccatgcggttctcatgataatgagtgagtcttacaagatctgatggttttataagcatctggcatttcccctgctggcactcatttactccttcctgccaccctgtgaagaggtgccttccaccatgattttaagtttcctaaggcctcccaagcaatgctgaactgtaagtcaattaaccctctttcctttataaattacccagtctctggtatttcttcatagcagtgtgaaaacagactaatatgggtattagcaaatgactgaactaagaaaccagcaaaagcagatttaattacttagttactttttgttttagtcatggttctccagagaacagaaccagtaggatgtgtatacatataaaaagaggttcattataaggaattggctcacctaagtctggagactggcaagtccaaaatctgcagggtgagccagcaggctggagaccctgagagccaatggtccagcttgagtctgaaggtagcctgctatagaaccaggaagatccaacgttacaggtgaagtccaaagacagtcttccagagaattctctcttctcagagaaggccagatcttttgtctatttaaaccttcaagtgattggatgaggcccacgcacattatggaggacaagctgctctagtcaatgtccacaaattgaaatgtgagtctcatccaaaatacccttgcagcaacacctagaataatgtctgactgaatgtctggatacctcgtggcccagccatattgacaaatgaaattaaccgttacaattttaatctgcatgtttctaataggattacatgatagttaaagatcatggttaagagcagggctttggaagcagcagacctgagtttgaattcttgtcctgcctcctatttgagaagtgacttcacatctatctaagcttcagttttctcatctttaaaatggggataataataggctgttgtgaggatttaataggataatacatgtaactctctcagcacagggcccatctcatagtaggtgctggtaaaagaggttgttttattcatattgctggatatatctaacactattccctaagtgtagtacatatataaatacatgcttttggctggaaaaactaagtgagatgatcaaatcactctgatggaaaagccagcagtgtggatggaaaaggtgtgcctgttctttctctcaggaaatccacagggttgcgcacagggcctcaggttttcatttggacaccccagcagcccctcaatacaggctattcacaaaagccccaatacagtcaccctgacagtccagctgtgaaccctggctccccacacgtgagccatggtgtccctctagccttgttcattcattgtgtcagtaatctactgccatgataacgctgcataacaaattattccagaattcagtagcttgaaacaataagcattgattattgctcccaagtctatagtttggctggaaagttctattgatctggaccaggctaggcttgtcttggctgagctcacccttgtctccctggtcagctggcaggttgctgggggctgattggtttaggatgacctcactcacatgttgatggattactgttgactggggtgtcaggcattacaggttatgtgtctttcatcatccaataggctagcccgggcttactcacatggagcctagacagggtggcaagagaaagcagaaaagccacatggtctcctgaggcccaggctcatcacttctgccacattctttcagtcaaaataaatgacaagagaagtccagattcaaaagcccagggttgtgagaaggcttggtgttaggaacaatcgtaagaaacctctatttatggctgattgctaattagtgttgcctaatttagcaatgaaatgtttcttcccatatgttcctctggagagcccatggcattcctctcccccgcttaagggccaaaattaagatacagaagacttatttaatatctttactttgttcaagctggttcacatacacttgtcctccagcctttggtgaactgttttaggacagggacaggtttaacacaagggccgacctctgcagtgacactgggtttacatatctgggtacatgataggcgggtttcattcttgttccaaagagaattttgaggcatgaaatatgtagcctttatggaggcaggatttactttgactcatacagagaaagaaaatgtgtgtgtgtgtgtgtgtattttcaatccttgcatgtgatatttttaagggctggtgcgatagctttgcttgccccaagaggatgtcccagacagtgcactagttgatgctgcagaaatggaaaattcctagggatatgtagccaatgaaccccttcacccacatttcctgattgtttgccacaatttgaacagtgagtggaaagaccttgtgcattccgcaggccatactcgcactgtcccagcagacctgggaatgtgcccatttgattcagtagttgttccacccaccattaaaatggacttttctagccacactcagcagctcacagctgtaatcccagcaatgtgggaggcttagatgggaagatcgcttgagcccaggagtttgagaccagcctgggcaacatgggaaacccccttctctacaaaaaatacaaaaaattagccaggcgtggtgcacacacctgtggtcccagctactgaagaggctgaggcaagagaatcacctgagcccaggaagtcgaagctgcagtaagccaagattgcaccactgcattccagcctgggtgaccgaggagactctgtctcaaaaaaaaaaaaaaaaaaaaaaaaaaaaaaaagaataaataaatataaataaagtggacttttcatggttggatctggtagttccagatgatttgtaccattggaatcttttgcatcttgaatgctgtttgggtctgaaaacacagccttctcagtgattcagcttatacttgttttatttctctattgcggctttacaaaccaccccaaaatggggcgctttacagaaaactaaaagacaggtagataatggtttgctcagcactttaagtcttcacagaactttaacacaagggctgacctcttcagtgacacagggtttacttgtatatgatacgcagatttcatttttgttccaaagagaattttgagcccatgagagatctagccaaattcgtttcactgcatatctaatgtgtctttatatttttccaaagccacgggacccgatgtgcaggagaagtttctgctgccgccaacaacaatatctgtggagttggagtagcatacaactccaaggttgcaggtaagccatccctgccaaacagaggcccccactaggtatcacactgatctcaaggctgactgtggcccagcaaaaaatcccactggtgcagaaaagctaggatccacagatttggcacaagtgaaaaaaatttttttcttttaacctgcataacaatatcaatagttttaaatttttaatttaagcataatataaattcaaaaaagttaacaaatcataaataagctaatgacttttcccaaactggccatacccatacagtgatcaggaaacaaaatgtaaccagcaccccaaacatgtccccttccagttactactctgacacccaagaataatcatgatcttgttttttaacagcaaaaaaaaaatggttattgccagtttttgaaatttatataaatagaattgtcagtcactactcttctgtgtcagtgtcaataacattttaatgagtctcaaatatagactatagaatacaaggtggtgtgtataaattatttgtaaacatactcagagctcttcaaaatgttttgcacaatggaactcatctttaaaaagagaaattctgcctagaacctttttcttacatttcattgggtaggatatttaagaatttcctattgatggagcctttagaaataagagtggcaagtcactggaaatttagaacccaatatccctcccctctcagaaaaaaaaagagagagagacacagacagagacagagactgagagattcataagctttcaacgagatgtctgagaatggagtggcaccagtctttttccaagttttgcatcaaattgattcttaatttattcaggctgagtcacccaaccttgtttttcttttttcttttcttttttgtttacaactgtcctgatattttcttttcctggcaatttaatggaaccataaacctactttctgctgacactccatttccatggaactaaataaagcaaaggtaacctatacaaacccactattaacctcttttcaacactgtttgctaagaggcttgcctgaactgggtgctgaatgtcacaaaagaatacatctggaggtttctaaaatgtaaatagaggaggcttagcccctgggtttcagctctctttactttgtgcacatccaaaatgctggcattaaaatgtcaggagccattatgagctcaggggaaagaatatcactcggttaatattttataagccaggctcagacctgggatggaatctaagggaggcgggttctctactcacaggacagaactggaagcaactgaaaaattcaaacctgaatttcttgttcacacacccaaggtaactggtttttggaacaaagtaaaatgaccacctgcaaaagttaaaagagttagggggagctcacagctttctggaggttcctgggagcttctttttccatctccttcttttccttttttcctcttctcttattatttgcactctgaaaacacctgagcattgagtgctcatcaaatgtatctaattctcctgctgtcttagtttgctctgcctaaaagcaaaacctgagacaaggattccgggcaagcagttaatgtgggaggtggtccccggaagccagagtgagggagttggggaagaagacaggaaaggaatggaggccaacgaagtgagtctcatggacaacaggggccccgtcctgcaggtaattctctgaggaagtgtggagaacacccctcagaattgaccccgctaatgtgaggaggctgcggcattaatctgccagttcccatctttcattgttcgggggtgccgtcgggcctgtccagcctgcccagctcgcttgaactgagtggagctccttgagcagaggacacccccaggcaaaaagccagggagcaggccagaggacccggtgggtgcagcagcctctgcctcgcctgctgaatgcagcctgacacctcaaagacgcgactgggcttctgtgaagcccaatgacagctagggcatcacagcaacgttttgaggttccagaaaccaagaacagacatccaaagattttgagcaagggaggctcctttctttcttttcccactcccttagccccagcttggctcccctgtgaccacgtacgctggttctaactacaagggctgcgaggctccagtcccatgcctgtgccttagggaacccagtgtcctctggctccctggggcgtcagcatgaattcttgaggaagcactggggaattactcatggattacaaaaacagcagagtttatcttacaaatttaaggaaaacattttattcatcctggctggcaattccaaaagttggctggtttttaattatttgctaaaaatgagccaaaccctccagagaatctttccattcgggagctttctgggctaaggaggtctaaagcgccacctggtggccaactcggatcgttgctggtctcaaagtcgaggtgttcgttcgttacaggttaggggggcgcccctgtgatgtctgaggtccttccccagcacccctccacgctgtctccagaaaaagcccaaagttaaaatgtggttgaatcttaacccagggattcaaaaaagaagagtggagattgtaaattgagtcctctgaacagaagagagcattgagcatctctgcatctacctgagttcctcttctgttcataaatttttctcatttttccatcaaggctcctgtctttttcttgttgatttgtaggcattcttggtgtgtcccaaaggttagcccctaacccattttaatcaatgcaaagatcttctccttcatttctcttcgcgtccgtcttcatttcaaactccgtgacatgtagacccgcacatacgggatgtcccaaaagtcatcctgcagtcttcaagctttaataaccccaggaacattatttgaaagtttatttacatttccattttcactgatttaattgtataaattttgaagaaaaatattactttttttattttgaaaatgcctttattcaagtaactgtcttttttaaaaaggaccccattctttccttctttcttttttcattttaatttttaagtaaacaacatcttcaatcaaaaagattgagtcaaaaattaaaattaagtgtgttattcaaaatccacaaaaccaagcaaatgtaccacaaacaatgaccttccaaatgatggtttttgcaaatttgtcaaatgtatatttctgaaaatattaaagctcgagaccacatcaaggagtcgtaacactgtctcctgccttcaggccttttgtgtggtccatagttactgtgggcaccttcctgttgcaggggatggaagctggcggacaggtcccctgccccatatagctcacagtctaggaggagaaaaagacagggagcaaataaaaaaaaatcagataacaactcatgaaagaggacagagagtaaccagggctcagggacaagaggcgcctgagggtggggctctacagttcctcactgttctggatttctgcagagactctcagagcagccctaagagggggccaggccaggtgggtttggtcctattcaccttcctttttaaaccaaagcacacagatttacacaccgggcttcgggatgagatcacctttgattgaagattttgaaaaatatttaaaaaccacactgttgaccattgtgaaaatgccgtgaaatttctctaccagctatgaagtgctttcacatattattatcactattattattggccaatgaatctcataacactgcagataaacatattttatctgagcttttcaataaacaagtaaaaatcactgtaagtacaatgactaacatgagttttcagaacctaaaacctggatgagcatgaatttcctccttatcatccagagctaatattcatgagcacaaaaagtggcattgatgagcaccgaagtttgtgggcagatgtagtatttactggaggcagggacaggcacaccttgtgcaacaggagcagaggcagagagggtgcagctcaaatcccctggacatgcagcccccggggcaccagggctagccacagtgcatgctgcacaggcagacagagaaggctctaaatgaatggaagagacccacagagtcacctctactcattaatgtgctgtgcaggcctgcctggggtcagatagaaacacttgatgtgtgcctgtgtctgttcttgcccatcaaatacacatatcagcattgttagggatgtgaagacacagactcctagctcctttgatttctctctctctctctctctctctctctccccccacttccttccctcctcctcctcccccccttcctccctctctccctctctctcttcctcccctcctcctcccccccccttcctacttctctccctttcctctctctttccctctcctctccctctctctctaccttctctctcctacactctccctctctccctctcctctctccctgtcctctccctctctctctaccttctctctctctcctacactctccctctctccctctcctctctctctgtcctctccttctctctctaccttctctctctctcccactctctccttctcctctccctttctctctacctgttctccctctgcctctctctatcccattctctttgtctctctccctctatctacgctctctctctctctctctcccagtctgtctgcctctctccctctctctctccttctctccctctctctcactcggtctactctctgtctccaccccacattcccctgtagctcctagagcatccaggggcagaggagaggccttccctaaaaacccttgggtcacgctgagcctctgtcttggcttggtgcagttgcttgcaaaattaatactgtatctcattcaattaatgcatgcctcattcctcttgagcttaacaagattaaaagaatgtcgggtgcctggtccctgaatatgaatgagagacttgctctcagcctgtggccaccctataatgttaaaacagtcagaagattaatacacatccactctgaggttcttgcgcagcacagagggagcccatgaaggtgataagagctgcaaagaggaagagggttcaaggcacagctggaagtgccatgcaccagccctggcaaaatccagggctggcattcgttggtttgtggggcagcagaaacctgctttggccggggttgaatttctcaccttccagttgagtgggccattcagtcctggtcatcttggcactaggcaagttcaagagcatctgagcaagtgaacgccagcctctgtctatttcccacccacagagtgggcgtgactttgcacaagaagaagctgcactgaccagtttattctgtggttcattggtcacctgcattaaataaagtttttaaataaataaaaacataggtggaccaaaagcaaaatacagagtcttaaatttcctatctccttataaaatgaaccataaaatttaacatctggaaagttcaaaccaaagactaggcttattctagataatcttcctccaggagaaagaatgctaactgataactgggtgtttgttgtcaaaaatggtgattacacttatgggttaatagtagaagatggataagcagagcctgttattcattcttctggacctgttatttgtgttggggagaaaatcaactaaataaggtaataatgccagatatttattcaccaaatatttgtcaagcttaaaataaataccaagcatcatgttgatcctcaaggacatggaagtgaacaaaatagacacatgccctatactcaaagaccatgccatctggtggtatatgaaacacgcaaataagtagttgcgatagaaggttaaaggtacacaagaagagggctatgagcactgaagaggaaagtgagatcctcgagtctcctgaggactgaaagtagtagtccctcaggaaagaaagcaatttcatgtccatttcagctgcctggcaaggacctgggtggcttttaattcgattgacgtgctcgccatgttagagagtgaggcttgtgaaatagtgtccttcaggcacaacatcctttggccaccggggacaaggaaggagttttggggcccagattttgactgtgcatggcccaaccccttcattccataatcgcagtgggtggaaagactcaggtcagcttcactagcactctaagctccatgccacagaattgtgaacccactgacccatccagatgacaaagcctggagagaggcatgtgaccccgtcagcgaagttttgagggtagtgatggagagacagcacacccaacccaatggcggctactgagatccccctggagaggcctttgtggatggccaaacggggaccggaggcctaggagcaccagctctgcgggggcagcgccagcaccttcaccctgtgcccctgtgtcttaggattgtgtgtcccacactatcctggactgcaggactttgctccttcccaacattctgtgagaaatcactcccacgaggcatcagagaggaacacaaactttacagcgatgctatagggaagaaaggagaggcagccgtcagacacagaattactaatacagtttagaatagccatctctgcctttctgtcctctccgaagtccctctcagctacagtgcaaatgggagttcctctttcctgaccccacccgctcctgcactgcccctgcccctctctctgtcccctgccctctgccctctgcctgctggaatttctcctcaaatatcaaatattgattgcctcccccatctatcatatgtagtagctttatttctcccttaaaacttggctgcagccaacacccagttctctgaggccaagcttctacttagaaacgagcttatcaaagcatcgcttcagcaaaggtggtctctcccatcatgaattctagtaagttttgctaggggaataaaattgtctttaaatcattacatcagcaaagatgtgggtgggatgcagaaaggagccagtaggaccgtctgtgcctctttcttgatccctggactgcacagtggccccagagcacctgagatctccaaccattccaagtacccagggcccaagccctcctccacctccttgtctcctgcgaactggggaacccaaacatggtgtcctctgctcaacgtgtccacaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaaggtaagggggccggccccctaggccccggccactcacaagttgggacaaagtgggtggaggggtagatgcaactgggtgaaccactgtcaccctgtgtgtgagtccaggtcctgcaggaatcagacagcacaggggcttagccatgcaggaggctgactgcagggaggcctgtgatggataaggagagagggcagaaaagcctcagacgcgatgcctacctggctcctgcaaacgacagtgggaaggaaggggccgggggggggagggtctcagacagcagtccccacgccaaagctgcccatcacagacagaaaggggcctgcactggcacccccaccacccactcagtcgttggctggcagtagcacacaggattttgggtctcggcgcacacagggcggtagatccaggaggcagcagccaagactatgaccacaatgctcgtggggcagggggtctgagcatgcattctcacagctgctcctctgagattagcccaggcttggacagagctgaggagaaggaagctgggcagagcctccaaagggatgagatgcaggtcagtgctgcatagggaggggaagggggccccttctctgagacgctggggctggagccaccccagaggagacatgaccccaggctcagggaccagaggatttctgggctccagtctatcaggaagtgacttagcctcgcctgtaaaacggtgataatgaggggtcactatgatgtataaatgagataaagatgcaactgctcggcactgagaagtgcctgcaaagagtcagaatttgtcccagtctcgactgccgcttaagcaaccaccccaaaacttcatagcacagaacacaactcctttactacgcttgggatgctctgggtcaggaatttggaccgggcacactggggatggctcatccgtcctccatgattcctggggcctcagccgatagattcgttacttgagcatccattaccaaactgttgcgtcttcatgagctgttctgatgcatccatctacttgccacgcgtggcacagctcccacccctaggcttacgcagtcttctcaggcctgtcctggctgccaggccagcagttcccccccacccacaccgtgctcccagaggactctctgtaatcagcctggacgtgggactcacaccacaaggtcactgccgtgtgtggagtgagttgtctggtgttaagtgagggaaaggacagtgtgtgagattttgtgtgtggcttttggaactccattttgggaatgtttttaaatttgcttcttagattttggtaaatttcaaatagatgaaatggctatagaaaccagcactattataaatattttataaaatgcatctgctccacatacacatttaagttatgtacagtctgtttatggaaaatgcataaactcattacttatacattgataacactaaaataagtgaatgtacagaacgctatgtttaacgcaggcataaaaaagagaatattgaagaaaataagagtgggcaattgaaggctgcttttccatacatttcttgaggtcagaaaacatgtgttttcctgcccagaccatcctcaggaactggcccggggtttgagaacatagtggatgagctgttcagggggcaggtatggaattaatgcagacacgaaatggtacggttgagaggctgaaagtcacatcgaaatctatgactacaatggatgccattggtgcccaccaagatcccctttaccaggcctgggggccaccccagctgctgtgagtgttggctgctgatggctcacagtgggccctctcacgaagcattgccttgacgatggaatcttctctcccagaaagttatgccccccacacccagggcacagcccacagccgatgactaaggcaggagcctgtttgcctccaacagggaggagtcttcaatgcaatttatggtccagagccccctgtgggccaggccaagggaaagctttacccaagactacatagttttggagttccttcccctctgtatcttacttcacttccttgctcgcaggttgctcctgagagccctccctcaatgagtctggggcagccgaatctctgcctcaggctctgcttctagggaacacctcccacaaacactgcctcaaaatttaccccattaggtttccctttttcctttggctgccaggaagcttagaactaagtgtgtgcctattaccattggttttttagactaggttttcttctaccttttttttttcttttgagatagggtctcactgcatcacccaggctggagtgcagtggcacaatctcagctcactgcagcctcaacctcctgggctcaagtgattctcctgcctcagcctccagagtggctgggactacaggtgcatgataccatgcccagctaactttttgtagacatgtttcaccatgttgcccaggctagtttcaaactccgggactcaagagatcctcccaccttggcctcccgaggtgggattacaagcatgcaccactgcacccggcctcttccaccccatttttctccatctcttcaccactcacagcctccaaaatcatcccttagcttctgtccctgtgtccgtgtttgtattcctagtgagtctaagcctctgaatgctaggcaatgtaaaatttgtaaaagaattgatgaaatgagctcagtctgattagattatatttagccatgagaaatctaactttggatccttactaaattgttgcttgcttacacacattcctagtcttaccagactaaagcatctcactggacaaaaattggcaagttcacatgtaacttcctcagagtctcagccctaaacaatagtaaacaatatttcaaaccaagtggaacccttcagcgcagtgggtggccaactttggtacacaggctggatctaacccccagacttgctttgcaaagacagtttccttgggacacagccaggcccttccaggtctttgtgacattctgggcacctccaaccacagctgtcacgggtcccaggggaaggaagcacatagggcaccaaatgaaggggctcatctctcagaatcaggcttttctggatgctggtcaacgtctctgtcttcactagagagccgacactgcacagcagcaggtccgtcctgttgcagggatatttcagcaggtggagagctcttgacagtggagagacctgagttttaacctcagtcctgccccccattggctggggaacttcagactagtcgatgtctccattcctcactttttgcaaaatggtctgagtcagtgcttctcaaagtgtggccacagcccacctgggagagtgaaaaatgcaaaacctcagcgcctcctcccctcccacagatgccgcattttaacaagatcccattaaagtttgcaaggtgttgctctacgtgatcttgaggatccaaatcatctaaccctgagatcctaagaccctaacatatggtttcttaaaacctacaatgaatagaaaagggcagcaggggtgacacatttccagaaaggaacagccctgtatttcctcatcagacaatgggttggacgggtgggctgtgtgatgactgagccacacgccatttgtctctgtgttgaagaaacagaggcctaggtagcccaaataaattggtttctcgtaagaatgcaccaggagggccttggcatagtggctcacgcctgtaatcccaacactttggggggctaaggcgggtggatcacctgaggtcaggagttcaagaccagcctgatcaaaatggtgaaaccccgtctctactaaagatacaaaaaattagccaggtgtggtggtgggcacctgtaatctcagttactcaagaggctgaggcaggagaatcacttgaacccgggaggcagacgttgcagtgagctgagttcatgccattgcactccagtctgggcatcaggagtgaaactctatctcaaaaaaaaaaaaaaaaatgcaccaagagggatcagggcaatgagatagattcaggcaagacctcatagtgcctgggaccagacagacatcctgatccaaggtggctgcaggatgccagccccaagaatgtgtggaaagccacaggagggctctgcggtcacggggctaggccacactcaccctgtttgcttctccccggtttcgtggctccggctctccaactcacccttccccttccttgaggcttatgcttagaggtgtttccacttggacaccaccccattggcacccttgcttgttacaatctgtcagcctctgctccagctgccacctgcccttgatgctttcagggaaattttggctcaaaattaggggaaacaccccaagatgagcctccaaaaccaagaagtgtggttctgttgggaaggtttggaacttgcagggtcagaggccagtcagatggtttctaataaaacccctttctttctcctctgaggacatcaaagggtagttgtctatattcacagtcttcttaggcatctgatggagtaattttttctgagctgttgaattctttcaaaggtctgaacagaaatataagactgtatgcccctgtattaatctgttttcatgctgttggtaaagacatacctaaggctgggcaatttacaaaagaaagaggtttattggacttacagttccacatagctggggagacctcacaatcatggtggaaggtgaaaggcatgtcttacctggtggcagacaagagaagagagcttctgtagggaaactcccctttttaaaaccatgagatctcatgagatctcataagacttattcactatcaagagaacagcatggggaagactcgcccccatgattcagttacctcccactgggtccttcccacaacatgtggaaattcaagatgagatttgggtgggggcacagccaaacggcatcagcacctcttctgttgtgggttcaattgtgtccccaaatattcatatgttggggtcctaatccccaatacctcataatgtgaccttatttggaaatagggtcattgcagatataattaattaagatgatgtcatattggagtaggatgggcccctaatccaatatgattggtgtccttatttaaaagacaaaaaaaaaaaaaaagaacaggaacatctgggcacagataggcatacagggagaacagcatgtgaagatgaaggcagaggggctggggatgcatctacaagcccaggagagccagagatggccaacagcccaccgggagctgggaaaggaatgggatagattccttctccagaacttctaggaatggaattgaatctattatgtctccagaacttctagagatggattctattcctagaagttctggagacggaagtgtcagcagggttggctgacacttccgtctccaggatttctaggcaagaaatttctgttgtttaagccactcagtttgtggtcctttggttgttactttggtcctttggttgtggtccttctgtagcagccctggcaaactaatgcaccttccagtcttagaatggatcatcaaaaaggaggtttggcagtgcgggaatgacctgctcactgttcaaggtcaccttgatgtcacctggccctctgctttacagccaagatggtcaatagttgatccaattacgacttttttcttctagttcaggaccttgagaagtctccctccctcccttctctgatgtagcttcctcgaaggaatgagcgtgtgaaaatgctcacgatgcagtcctaggagagaaacatgtttccaagttagggagagtgctgtgctgaaatgctcccaataacgtcacactgggagcttgaaattcaacatggaaattgacgaacactaaaaataaagcccttttacgcccccttcagggagctggttgttaaacattgaatagcacacctctcgttagaggactcttctgacttcccttaaattatagcacttacatacctatgtgttctccctgcaagtaacagccacccttgccttcatgagtctggaagttccctttgcgaagtggaaaagctggaggaaaaacacctgaaaccccaaggttttgtttccccaaaatgacaagtttcccaaccagagtcctaagttaccccaagactgtggaggacaacttttctaagtcaaggaaagatctcacactttaaggaattcaccacttttacattaaatacaaggatcccaaaaacacaattatgagatgggaaacagagtcctcgaagtgaacatcatggtgacagcagctaaatgtccattgctacactgttcaggaaatagtgaagacgctttattacaaggttatgccagtctgctgttgaaattcaacccatctgaaacagcaacaggagcctgacatttgagtgacacaatgcggtttacagagaatgtctgccaacaggatcgggtggcaggaaagtgacgtccctaccctgtttcaatgcctggtctccttaagaagcatttaggatgaaatttttgatgcacagacagcctgtttccttattgcattattcattgtgtgactggagagaaattgttacacatccaagccccagaccaggtgacagcaggtgcccaggggaacagttggcagattccccctttcctcagcagacatggattttcactgagaggcactttttttgacacctgaggccaaaagagagtcgggaaggtaggagatgtgtgccctctgtccagactgacagtgcagatggtggcagcgctccacatccctgggtgcccctgtcattttccacggacttctgcacttctccactgcctctcgaagcaggatatttctctctcctccatctgtagcctccctggctgcaggtgaaaaggccctttcaagtgtgattgtcctgcaaagcatgccgagcccgctgaagcttaagagaaaaattgttatgactgatcttcagatgacagcaagtacatcttttagaaagtggagtgagtatgatgaaaaatacattatttcacatttgacttttccccaagaaatgggaataaatttccccaagcaatgggaataaatttccccaagcagtgggaataaatctttccttgtttcaaggtgacattttttggacaacattgtagcattttggaagtgagggttcattgtgcattagcgaaggttttctcctagtgacttccactgcctggtctactctaaggaaaaatccacttctgaaaggcaatcttcacacaaacaaaggagtcagagaattacctgttacacaaggcacttcttacgtttgtctttcaattttatcatcctgtacatatgttttgtttgaccaacatggtaatgattaaaaggaagagaacaaagaggagatggataagagacttttatcggggcatgcactgtttgccatagatcccaccattcccagttgtctgatggctgcttcacacaaacatcacctacctgactccttagggatttgaagtttgcacctcctacatttgcttagtaaatacttgagagaagcagtgaggagtgggcaagaaggaaatcctttttttcttttgcttagtagtctatgtgttgggtttacagttacagcatttttcacgttgtatatgggaagagggtgacagtcagaggcccctgaattaccagagggttcaataattgacttctgtcttagttttagatctcctagaagcagatcctgaggcaagatttgggatcaagtagtttattgggaaggtgaagagaataccagtgatgaatgggaggtgtggcaggaaagagacagggccagttaagggtatgttatcctgccagtcatcgctgtcagcaactggagcttaatgccactgggaaacttcagaaaaccacaccaaaacttgagaacacaccccaaaggtatcccaccctgtgggaaaggagctggaataaaacccattgatgaggtttgttcccaaaaccttgtaaatgccccagtgctttcagcctgaggacagatgcacagagcagcctttcagcctcttgggaggaagcccttagacaaaaagatgcatatgctgacatttggaaactcccaggcacagggaattctaaagcccaagggatatgggctcacacacaactcccaaagtgcagcttaagcaaaacctaacctgagacttcgagtcatcactctctggataaataaagcactggcaaggtgatgtgtttactgttcaggaaaaggatgtagcccttgcaaagagggagctacaaaaaccagccattatgggacacagcatcttattttgctctgacaaccagaaggggaattcgggtgacgctagaaggtcttgaaagtgacaactgattcatgaacgtctttccacaacttgaggaaatgcagccacccagggcaaccctggcacaccttttgctggctctgatgactacatcccaacttcttcttaatcactcttcagagttgctgctggagggaatattttaggaatatttaaagacaaggctacaaaaattctctaaggtacagatgagacagcgcattgattgtttactccctaaggggctgcaaagggcaaagcacagaactcaggtcttcttccagctggaatgtatggacagggaccacttacaagaaaaccaccatccaggaaagcaggggacagagagctgcctggggagacagtgattaatcaggcatgggcgaggggaggccacagtgcctcctgctgaaatttaatcagagccacgggtcgtacaccatggcggcgagtgccagggcctctggcagacgatgaatgcctcctgccaaggagctctcacgaatactctgtgagcccagatttatgctctgcagccagatgaaggtcgcaactgagcagaactgctgcagcgtggaatctgcagttcagccttggaaacagctggtgccgttaccgtccttcctttcatttctgggataaagagaactaagagaaaagtctggtgggtttcgggtgatccttgtgaccagccgtctcattttgccagggactttcctgtttttagcattgaaaagtcctacatctcaggaaacccctcaatcctgggcaaaccaagacagttggtcacccaccctttggcgctattagtagcgttggcccacctgggcccagtgagaaattcacccgaggttagaagttgacatgaatgtaaactcagcagcacctctgacatcagaaagattcatcactacaatggctggatcctttgagcagtgagacagaataacacaggattctgacctccaaggtggttacacgaaaaccagacaataactaaagacaaccacaggcgccatcaaacactgaatcgaggtgaggatttaaatcagaggccagggcaactgcatcatccttagcttggcttttccagagaacctgataccctactcccgctgaactaccacagaacccacagggactctgcagagtctggaactgaccagtgaaagttccaaactacaaaggataccatctatcatcactcccactcacaactcattgattaaaatggcttataagacctcacccaaccacaaagaggcctggtcatgggctcagaccgtggacagtttgcaatatttagcaagcagcagcaatgactaccacaatgtgtaccgaaacagttaggtagctcaagaggtaaccagttgacctagtgaggacaaatgtgcaaatgtcgaagatgtttgtgaatagtttgaataaaatttgccaaagatgttcatgaataatttgaataaaatttttcatgaactacgagtgcagaaaggcaatattcataaatcaatacattgtttcatgtgcaatttaaaatgtgtttattttaaaattcatattttaataacagattaaagtaatataatggaaaagtgtctgcaagtctaaatccaacacatcaaagaaaaaggaaaaactgagtaaatatatatgcacatagataatgaaaatctagctcagtttcttaatacaggaagagctcttacaaaccaataaaaggaataccatgaggtcaggcgaggtggctcacacctgtaatcccagcattttgggaggctgttgtgggcagatcccttgaggtcaggagtttgggaccagcctggccaacatggtgaaactccgtcatctctactaaaaaaaataaataaagaaaaataaaaattggctgggcacagtgctatgtgcctgtaatcccagctacttgggaggctgaggcaggagaatatcttgaagctgggaggcaaagactgcaataagtcgagatcacaccattgcactccagcctgggtgacagagctatactctgtctcaaaaaaaaaaaaaaatctatgaaagaaaaaaacataggcaaagcatattatcttttggggcttggggctttgctaaataataaagcaagaatacaaatgagcaggaaagacacaaaaagataaattcaactttagtgaaaaaatatataactcaaaacaataaggtactatttttacccaccaaattggcaaaactatttttaagaaatgacaattctaaattatgacgcatatgagctgaatatagagttctcatgcactgctggtaaacatataaactgttaacaaactttatcaagaacaataatatggcagatggactaagaatcgtcattcattttttttcacccagaatttcctcttttagaaacactgcctaagaaaataaacatacaaagacatatataagattatgttcattttaaacataaagcacttttttaaaaactagagacagcattccatgtacattcaagaagaggtgtaaataaattgcggaatggctatttcataaaactaataaaaaattatggtgtagaagagtatttaatcacataaaaaaagtcaattatataaattgtgagaaatacattttaagcaggccaagaaagttgatctatttttattatcccaatttcactttcaagcccgttcttatactttgcatttatatgtaaaattggcaagaatccacaaaatatcaccagtgattatctattcatgtaagattataaaggacttttatttccttcatcttctatattccaattattctataataaatattattttcatagtaaagaatacaataactttttccaaggtatgctaatgttgtattaagaaattaaggtgactggaaaataaaaattactataattgtttacaaaaagataagctctcccaggcttgcctcaccaggggtctgcaccctgcacccataccaaccccagaccagcacctgttctggtcattaaccctggtggctacccattggttagggtggagggactgactcactttagccacaagtttctcagagtgggatttccacctcctcaaatgtaggcaatgcgctggggacacagcaagccactgcaccagtctctagctggaatgtcaccttagctgacggtaagcaatttgtaacattctttttatattatgagcaaaataaaaaaattgcttgaatgtttcagaaattttgggcttgtgagaggctacttaaggccatgcccagcaagttccaactcactgctctcactgagcagggtttctcagcctgggcatatggacattctgggcaaaatactgttttgtcggtggtgaggaggttgtcctttgcatagaagtttagtagtctccctggcctttatggactagatgctagtaaaacacacatggttgtgatcaccaaaaatgtctccatcactgcatcctggagaaaaagtccacactagttgagaaccagggtggttaagtacactccatagtacctaggttaaaagtttccatttggtaaaaacttttgagaaacactgtaatcccactaaactccaaaagactggcagaattcaaagtggagttgcaccactcacttaatttcacctaaatgcacttgcctttttttttttttttttttcctttcacccaggctggagtgcagtggtgtgattatagctcactgcagactccagctcctcaaactcctgggctcctcccgagtagctaagactataggtgtgcctcaccacgccaagctaattttttcttttgtacagatgggggtgagtgggcctctcgctactttgcccaggctggtctcaaactcttggcctcaagtgctcctcctgcctcaaggctccacttcccagagcactgggattacaggcatgagccatcaggctggcctacttgcctcaggcagctgacagccattccactcactgagcatgagctgcaggattagggtggagaccccgccccccagcagacagccccacccacagtgctggctcttgggtcatggcctccctttgtccttcagctccagggccaccctctaatccatgggtgaattcccatttcccttttgggttttaggctttcctttaacacctattccctggataaaattccctctgttgacctgccaagtgtggcaatatttgcctggctgaatttcaattgatatattgtatatttattgggataatgttacatatatataaatatacatatatatatgtatgtatgtatatatatatatgtatatttgagactgagttttactcttgttgcccaggctggagtgcaatagcgcgatctcagctcaccgcaacctccgcctcctgggttcaagcaattctgactcagcctcccgagtagctgggactacaggcatgcaccaccacgctcagctaattttgtatttttaatagagacgaggtttctccatgttggtcaggctggtctcagactcccgacctcaggggatccacctgcctcagcctcccaaagtgctgggattacaggcgtgagccactgcacctggcacatttatatattaacatagggaaaattgacatctctgtgatcctgtctttctattcgagaatatggccaatatctttccatgggatcaaatcttcatcttcgtccctccttccatagagttcagagaggttcaaagccttatttagcacttccttagcttttttttttttaagtttgttgaatttcttcccttttttttttttttttttttttttttttttgtgacggagtctcactgtcgcctaggctggagtgcagtggcgcgatctcggctcactgcgggctccgccccctggggttcacgccattctcttgcctcagcctcccgagtagctgggactacaggcgcccgccacctcgcccggctaattttttgtatttttagtagagacggggtttcactgtgttagccaggatggtctcgatctcctgacctcgtgatccgcccacctcggcctcccaaagtgctgggattacaggcatgagacaccgcgcccggctcttcctaagtattttatcctttatgtggccagtgtaaatggggctgcctgtagggtggctgtgaagactgaataggataatatgtgaagtacttaacaagtccctggcatgtagtaagtgctatggaaatgcttgctgtgatagtcaacctttgttttctgcacttcttcctctaacgggttatggtttagatgtgagccatagttgttctgtctcgatttctgcctagctcctgttcaggtgaagctgagaggcagaaatggatcaagccttaagcagatgcccaagatcaaggcactggcaggttcagtgtcttgcaaaggctcactctctgcttctaagatggtgccttgttgctgtatctcatagaggggacaaacactgggtcttcccatggtggaagggccaaaaggggcctagctatttccctggagcccttttataagggcagtaatcccattcatgaggaccaaactctcatgacttaattacctcctaaaggtcccacctcttaagactatcatgttgtgtctcaggttctaatatatgaatttgggggggacatataagttcaaaccaaagtagggtggcatgccagcaacagccccatcccataaccagctctcagtcctcttatggaggtcccttccccactcatttctgcccccagaactagagaattttcctcactggcccatcttccccagaagccagagactttttggtgctaaaacccaatcaccagaagcaaggacacaattattattgcttcatgtgtcctatctagcttaagaaaacaaagtttaatattcctagaaaacgaagcattcttgtgggcaagtctcatggtttaaaacaaaattaacgtttgctgtttactgttcacggttcagaaacaggctgacaattgctctctgtgtaacagtgagctggctgcataacaaactgccccaaaactcagtagcttaaaataacaatcatttaattttgctcttgggtctacaggtcagctgcgttgttctgctgatctgcaccaggctaggctaatctcaggagagtgagttagagactgacggatcgaggatggcttccctcctgtgtctggcagctgtcagcaggggcagtgaatttgactggaatacttctctcttatcaatcaggaggctaacctaggcttatcttcatggtgcaacggagttctgggagagatcagagaacataggagttcttgggactgatgtttggaactgatacagaatcactttcccccacattctattggccaaagcaagacataaagccagcttggagtctaggggtaggaaatagaccactcttcttgatggatggggctgcaaaggcatagtgcacagggcataaatacagggaatcatgaataattagggtcacaatcaatctaccacactccccacacaaagaagagaatgtttagcatcgatttccttcattttagcaaacgttgcttcatctcactagcagtctacatatggactgattcaggagaaagttctgcagatggtcaacctcactcacccatttattgtgaaacacatcagttgtactttgctttttttttttttttttttttgagatggggtctcgttctgtcacccgggctggagtgcagtggcacaatctcggctcactgcacctcccgaatagctgggattacagacatgtatcaccacacccagttaatttttgtatttttagtagagacagggtttcaccatgttggccaggctggtctcgaactcccgaccccaggtgattcacccacctcagcctcccaaagtgctgggattacaggcatgaaccaccgcgcccggccacacttttgctatttcttgataccgagcccaaatctgagtctgtttgagagtgtgatcctccacaccaactgtagggatatctatttccctcgctgtcctggtttctgagagcagttccttgttttggttggagttttccagcatagatttaccaagatgctgagaatagttcccagctagtggttgaataaatatttgttcacttgtcgattcaatcaatcacaggctgattaattcccagtgctgttagaagtgattgaaaatgtcacatctgattgtcaggcggcagagagcacttggaggtaatccagtcatctctcttccttctggcttctccactcttaaaccactgattctgtgtcagtttcaagcgtaaggaccatggacacctggtgaccacacagggagagactttccctgacaatctcttctgtcttctccctctagagggtaaccaagccaccctgggccaggctgtggagtggctggaggttgcacctgccccttgcctccggcactgcatggctgcactcctatccaccctcccagcccacaggtgaacactaagcagccccaggccccattgccttggggtaagaaagtgggaagcaagaaactaatggtccaatcctgggttgtttaggtagagaggaaaatactcagaagacaaggaaaaggatttttaagaacctctaagaacatggtttgaggagaagagccatgctaactgtagggacttatgcaaagtttgccatttaaactaattagcatgtggcaataactactgtgcttactactgtgtgtttaaggttttattcactgtgtgttttacttgatcatattagactttcctcctacatttggagttcccttgctcaagtaaaatgtcatatattatgtgtttaaaaggattctagtatccaattgaataaaaaagaatatatacatatgcacacacacgtaagatttttatatatcatggagtaaatgtatgctttatatttataatgtctacatatcatatttaaatttatatattgatatatagctatttaaaataaaaggtatatatcttctataaatgttttgtatagcttatgtagctaagaaaaattatatgtccatatacttgcattttcactaaaaaatgtctgatacataaagagatgtaagaatgagataataattacctctagagagttgttttttattttcctttccatacagttagacttttcattgtgagcatgtaccacctttctagcttttttaaaaagcagtttatttgtaaattttaagacagttcttccaattttcttacctcattatccccagcttaaattgtaaattcagttgacttttttagattgaattcttcctggaaaaaaaaagtttcccacaatgccctgccagaaggatatggtgtccaacccagtttaaaaagtgcacccagtctttaggttcaactgctgaagaagcccaacccctgggctggagacctcccctgccccctcgcagcccaggctgtgggtagcggcagcgtctcccctgctctccccagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggtgagcacgtccccttctgtccttgtttccttagggccactgcacctctgtgtcagggtgggatgctgggacactggcttgctcccctcctgtcccctccctcagagcctgaactaaggctctgaagggaagaccccttttctctatgcccagtcctgctttctaacaaagcacagacctcccatctgcgagctagtagcatgatcggtgaggactcctttctggatcgttttccatagattttcttgtttattgtttctggcttacaagtaatgatgaagtctggtttaccaatcagttgccccattccatcacttacaagaataactaactcattgtaagaaccaaggcatcacactgtaaccctgtctgaaacaagaacccatctgtttatttatagcaatttaaaaaacaacattcacggatggacttttctggatccataaaccccgtaaaattgcacacacatctgttattttctcagggaaagagttgtgattttcatcatattttaaaatggagccatgatttttagaacaaaaagattaataatcacagatttattgtttgttgctcttttctgagcaaagaaaaaaaaatcttcctttcttggcaactaggtataatggtgaattttccaagcccctgggaaatacatcatctgtaaagcataataagcttttttggatcttttcctctctggagattttgctcacagatcagccttttcttacacctccaaaccaggatttagtaggtggttcagtagtcatgcatgaattatatcctgactggctgcacccatctccactgaggcttcttgagacaggaggacaggagctcaggacaaaatcattagtaccatccagtgtttcgatcccacgctcccacgtgggatcccaacttggcaagatggccatgcccctgcgtgagcgaggagaagccctttacctggaagggacgcagaccttaaaagcctgtccttcccacgagccctcctgcattcccccttggtcttggggaggatgaagaatgtgccagctcctcccaaacagaagggggctttgacccctcttatcctgtaagctgtatggacagaaagggagaagggcagagcagacagggacaggtgaggtgacacttcactctcacgcctgaaagctccactccctaccccaaagacctctcagtggtgtaaatttgtcctcgacccgtatttatgactctttctacttgggctggctaaaggccttgagtttcctgtgagtactataattttgctcaatagatgcccttaaacctccctggtaatttcttcctcaaaataataagctctcttgaggatcctacagacagaggaagaattcccgtcgtttatacatgattttaatgaacaccctggctctcacaaacattgaaaatgaggtttttcactttgtgaaagtcctttaaaaatctgtttaccagtctcccctctaaataagagttgtggaggtgatacccacatattgggttgtcttgactcaacacatctcagaatctctccgtggattttagatgtagagaaacatgttttaatagcctgcccttctagagagactttagctgagcatgttgattctttcctcttcgggaatgccttctttcccccaagaaggaaaaagaaatgctgatgaagtggcctttggcctttcaagggccagtcccaatgcaacaaaactagggtgggggtattgacatcactttccacttcataatgtttccttttaggtttcaggaaataaatctctctgtagtctctggaatagccacagatatgcttctttgaacaactcatttatcttgtggacactgtaactataactgactatatatccccttttacgtgggctactaggaagctcagataaaatctagggcaaaagagaggcatatggatgctaagtttatccttagtttcatcttaatcttcttgggaacaaagcataggttaaataaaaggagtaggctgggggcagtgactcatgcctgtaatcctttggaaggctgaggcaggtggatcacctgaggtcaggagtttgagaccagcttggtcaacatggcgaaaccctgtctctactaaaattacaaaaattagccgggcatggtggcacgtgcctgtaatcccagctaattcaggaggctgaggcaggagaatcgcttgaacctgggaggcggaggttgccatgagccaagatcatgccactgcactccagcctgggcaacagagtgaggctgtctcaataaataaatgaataaataaaaggagtagataatcccctgctccacattgtgcgggggttcaaaatagcgtgatttatccactcattactcattatcttcccttccaggcaaccacagatttgtacggcaactgcactctgaggcattctgggacatctgcagctgcccccgaggcagctggtgtgtttgcactggctctggaggctaagtatgttcatagctctgggtccagggccagctctgcagggtggactaacacgtgtctctctgcccacatgccaggtgtccatggagggaaaagttgatgtgagaggccatgaatagtcagggccaatgaactctgctgtgcatttctaagtggcccatgtgcccaccagcacacgtgcgtgtgcatacacacacacacgcacacaccataaaaccacattcctgggagcacacaacacccagcagcacgtattagcaacttactcagatacccagtgaaggcacagagatatttctttcttcatcaaatttacccctctatcctctgtgtatccctgggctcttctactccagtgatattcacaatcagctacttgaagacaaatcaaattgccaggctggtgtttcagaacatgtggcaaacaaagtggtcccactcaagatttgttaatttgtgaagtggattcactttttaacactgaaacaagataggcaaagtcacgcagtgtagaccaagatatgggctttcctgggagaccttccaagctgaaggtaagaggagaccatctcctatgtcctcaccatcctatggagaggccacatattgctactgctggacacaccttggatttgagtagcagtggaggtacctgcccacctgctactctactttcttttaatgatacctgaggctggccttatgttcacagaatgaacacatgggcttcagacaccacacacatagtgtgagtgtaagtgccggctgtgtagggaattgtcagagaatgcagttcccagcaacttgtgagaagttggattcagtctcttggggaaggagagtagagttgctaggcaaccagggctcccagcatcaatctctaggcagccctgcttgtctctctccacataggcagtgcattttctgatttgcaaaggaggcaggagttggttcctagaatagaaaggggcttcaacagattacctagttcaaccctctaccttcacaagaaaaggcataattatcctccctttacagataagaccccaaattgagagtgacttctctttttggacaagtctaaactttgactcttctaacaaaattcagatagaaaatttatgatgccaagacactggtcaaagctcaactattaggcacagagacctctgccctatcaagcacagaaaacaaaatttactcatatccaatgtacatttcctgaagataaaactgttcatctcagggtctgagtgggccctggagcctgagctggccttgctcactgcatccgcaaggagacaattagcacagcctgctgcctgtagctgagctgtgcagagccagggaacaggagtgctccaaaagcgagaagggtttccggttgccctttcaacctcagaagtcaggacttgactcacagtcttctggatttttgacaaacaaaatcctatgcctatgcctagatccataggcacacaaatggaagacctaaataaatcaaagtgggggagtgaggctgctggactcctagagattcatggctctgccttgattagtcaccattcttttagcacatacgtccagatatcctacagaaaagaatgcagtcaccattcaggcatgctttgttttgaagcaatgatcatgaacttaatattctctgctggcataaagaggaaaaaaatataacacctggcagcttgtgggtaagtccatcacgggagccggtcctaaaattcttcaaaataccaactttctgaggttggaagcagaccctgagatgagattttggtgcaagtgatttattaaggaagggatcccaggaaaggcagtaagggagtaggggaaacaagttagggatggggaagaatccaagcaaaggttcaacttcaaaagttctggcctcagtctaatcccgagtgtaaattaggcctcagagtttgttctacctccaggcaaggaagcaggactgtcatattcttatatgagtcagtcatcggctaagagctactctggagaagtaaactccaaggcatctctagctttaggcaaagcggctccaatagccaaaagtgaaaaccattggtcaggatgagatactccaaatgagagcccagagggatgaggaatagggcctccacagagcagtcccaaagctcatctctctcttatcttgagataaggttacaggaagtcctcatgcataacaacaaattatctaaatgtatgtccatcaggaccttgaaagagagagaacaacacttcccccatcatgactgtaggggagaaaaagaaaaccatctctctctcctaaccagttgtcactttgtagtttaatatcataatgtacttttctgcctaatgcttgaaaatgcctacttgagtcacaggaaatattgctcccatctcccagtatcaccaatatcagagaaatttcaaagaattttagtgggggatgactgccaccttcgaatatttaggtttctctcatatgacctggtgctttctctgtggtcctagagggtgagctaggctcgaggggtagatgtcataagaagatcagtttttgactcaagaaaatcatctggagtaaagtggtccacatgctggactggaacaacatttccaaaactgaccttccaggggatggatttttaatgtaaactctttagcgagtatagtatatagaaagaaattcattaggtgtggctccatgacattttaactaaatgaacagacccatgtagccagcacccaaatcaagaaacagacgatttatgtgccctgttgctcagcagtgcaagagattcctccatgttcctgtatgtagttataggtcgttcattctcattgttgaatatcattccattgtataaatggatatttggattgtttccatttggggctactatgagtgatattgttaggaacattcttgtacatgccttttggtgaacatacagatacatttctgttgagcgtctactagggagtcaaaatgttgggtcattaatatacatatgtgcaattctagtagatatcgtcaaatagtttcctgaagtgggtgtacccattgaccctaccttgagcagtatatgagaattacagttgccccacatccttgccaaaatgtggtattattagtcttctatattttagcattcttatggatgtgcagtggagtcatattatagttttaatttgcacttccctcatagctagtgaaattgagcacactgggtaaagttttttaaaaaatacattcccaagcctcacccaagcctcatagaatacaaatccctagggatgggtggcccaggaacctgacttttcaatgcctgttccccgggaatacttaagctgccagcctgtcgctgatctgtgaactagggtgtgaggatgatcaataaggcaatagctctgtgaatctatgactctgggtgcagagtgtgggtagctggcttctgcctctgattaggtgttggtattcagtcaagatttaatgtttctgcatgaaacaacgaatccaaataataacagagacaagggtttatttctctgtcatgtgaaagaaaatacagagataaggaacccagggctggtttagggtaccggggtaccattgtgaatcagggaatccagctctttctagctttctgctcctttgctctgccactttcatgttctctagacgtgctggaactccagccaccatgtttacatttcaggcaggaaaaggagaagcacaaagggcaaaaaaataaataaataaacaaataaaagagagagagagaaggagagagagaaagaaagagaaaaataaaaaaagaaagaaagaaaagaaagaaggaaaccagctgagtcagccatgttgaaggggttttccaaggagccccacccagtggcttctgcttatttctcattggctagaactgtcacatgaccaccgccacacttcaagggaggctgggaaatgtaattttatagctgaatgcattgctgttctgaataaaactgaagttttcttaataaggaaggagaaaagatagatatggagggaaatacaactgctaatgtcttctggcatctaagtggacaatcactcatctctggatctctattgtcttatcaacaaaaggtagcaagttagatcatcaataaggttccaatgacttcctggaatattttagctctgcttctgaaatattgtttttttagggaagttaatattttaattggatgtctggtgatttttaaggttgaatatgccttaaagctgaaaaacgttcatttacatacttttaaatattgaggtcaatacttaggaaatagtaatctaatttactttaacttctgatatatgtgatatatgttatcattaataataataaagtctttttattcagtgtccagcactgtgctaggtactttacatacataatttacatttacatcctgcaacaaacctataaggccttatgcccattttaaagatgtaaaggctagagctcgaattgttaaagtaacttatccgagttcacacagttggctttaagcattaggatgcctgttccactgggctctcggtggaacatagaaaaggccctgccactgtcttgcctgtggggctcaccactcatcctgccatggcaatgggttgcagtgaatgagttagctcttcctcaaacatgatgcacaaaatcaggtttcactttctttgagatgagattttccacaccacaactacaccagggagtcatgaaaactgaatttcctctcacgtccttataggacgtgagcaaacaaaggctatggagaaaataccagcttgactcacaaatgcattatttttctcagactggaaataatccaacctttgaaattattttttaatcctatcaaaatttagaggatagactcagaattttaaaaatgaaagaaaatgaatggatcttttacgactccaaacatctcttatgatgaagagaacgagacccagagaagtgaaacaacttgctccaggtcacacagtttacattgtcagataaagatcagatccaacaagtaaagggattaaaattctcctgttgacttctagaatttaccagatgttaggagaagtgattcctccaaccttaagactacagcatcatctttaaaacatttccattttcaatttctctaaagatgcatgtgctgactttaaattacttttgctgccttgatcattaggaggaaaatgttaattgggttcaggggaacttgatgctgtaaatagaagtactatgctctgaaagagaatggtgagggaacagccttgcacacgagaaaaacaatccattctgttagaagtcaggttcctacaaaggataaatgcttgaggtgatggataccccatttaccctgatgtgattatcatgcattgcatacctgtatccaaatatctcatgtaccccataaatacatacacctactgtgtacccacaaaaattaaaaattaaacattaaacaaaaagtcagtctgctggtcagccacttcctaagagatgcttgctgacccctggacccaagtttctcagatttcctgatgatcagaatcctggagtgcttgttaaaaacacagataccctaagcccactggagatccatagaatcagaatccccaggggagcccctggaaagctctatttttcaccagcgcccccacccccaccagtgccgtccaggaagttaggaagctctcccctgaacgaggtttgctgcatactgaaaatactaaatgtttggaggaatccatggaatcaaaacctctgaacctggacatcatttttttaaccatccccaggtgattccaatgtgcagacaaggttgagaaccactgtcccagactaccaatgttctcaaacatcactgtacagaagaatcatttggattaaatgcaaattctcaggcccacaatctccaagatgctgattcaggacaggtggaaattcacatatgtcactaatggtcctgacacagggggattgaggatcacagtgagaactcctgactaggataacacagaggctccactgatgcctccctcagcatcctgagctcccccatcatgacagccctcacattttcaatactgagttgtccctctgtccccctaggctatcagctggtggggacagggacatccgtctgacatgcccagagttagcacgatgcctgaatgtggtagacactcaacagacatccatacaatcacttcattgcgcagtaccttctcatatatctgcatcttattttcccgactcatataaaacatttgagaacagggaagaacatgtcacatttcttgtcctacagtctccaaaacagtgacctgtatatcgcagatactccataaatttattttttaattatttaataactatcacctgtaattcttgggctgctatggtacaattaaagcaggttgatgaaataaatacctactttacagaatattgtagtctgtcaattcctaaatcattcagaagggatactagaaggaacctggttttactcttcagacatatgcaaatagcaggtcaaacagtgtcatagactcagttacactggagagtgaactatgctgtggtttatctcaaaagtgaaaagttccttgttctgaaacattatttctctctctctcatgctctctctctttctaaaatgcaccccatgagaataaatctgcagagaaacatttaagggagcccttctccaggcatcagaagtacagcccattttcatggcaaagatgagaaatgagaaacctgctagccagccctctggtcatttagatcctcatttgtcaacacttctgagattaataaactcagaatccccttccagcaaaacactcagtttttagccataatcaacttaaggaacttttacaccattttacatcatttacaccattttacaccacttacatcattttacaccatatgtccaagacatgttctgaatctcctcaaataagcattgaccttccttggaacttgcttcttttctttttttctttttttttttaattatacttttaagttctagggtacatgtgcacaatgtgcaggtttgttacgtatgtatacatgtgccatgttggtttgctgcacccattaactcatcctttacatgaggtatttctcctaatgctatccctccccatccccccaccccccacacacacacatgacaggccccggtgtgatgttccccttcctgtgtccaagtgtggaacttgcttcttaatagaagaaggtctgcattcaagagcacatggatcatttgaactcttggttctgattcagatcttccaaccaatgaactttgcatatgttgaaattttatcaaatgagttatgttgctcctggtcctttgaattgtttgacttctgaagagaactgtagtgcaaggttttgccaactttttgaccagaatcctcggtgagtaataaattttgcactgcagctcagcacacacacacacagctaccctccaagtatttcatgaaaaaatagcttcctgtattatgtgcagtgcatactgcttttctattctgttccattcattttttaaaataataacaccaaccattaaatcactggttctcaacattggctgtctgttggaatggtctgagaagttttaacagtttccaatgcctgggtctcactcccagagattctgatttacttggtctgggatgaggccctaggcatgagatcttcaatgcccctaggagaaaattttcatgggcagtcccaacaacctgtgcgataacctggcccaaaaacaaatcatgatttgcaatttgaaaaacatagacaatgtgtagtaatagacactaatttccaaaaacaataacatttacaagaagactagtttattcactgaacaatgtgccaaggaccatcctggacactaaggatataaatatgctaaatataatttctctacccttgaagaactggtaccctccttttcaaaaatggaacacacccacatgccagttcccagatgaagggacagcaagaccagcactcagaagctccctgtatccccttccagtcactgccccacgagactgaccactaacatgacctccaacagcatagattagtcattcttgtttttatattttaaacagatggaatcatactttatggtctcttttctgcctggcttctttaggccaacatggtatttgtgagatttttccatgttgttcagagtacctggagttcattcattctcactgctgtatagtaccccacattctataagttacacctcaattagtttactccctatcttttggatggcatgtaggggtttcacagtttggggctaggagcattctagtacacaggtctggtgaatatgtacacatttggtcaggtatatgcctaggaaaagaatttccaggccatagcttaagcttaactttagaagatacagccaaacagttttccagtttagttggaattacttgcacgctcatccacaaagtacatgtgttccagttgctccacatcttcaacacttaacattgtcagtctttttcattttagccattccggtgtgtgtgttagaatagacttttgaaatcaatttatgtaagtaagaaaagcaagaagatttctttaattgacttatatagtggttttgaatggtgcatggacaccctcccttgaatttgagagttcacagagattccaaaatcttacaagaggtctgtgtcctgagtaatatttctcttaatcattgtgcctctctccctctctcaccctgccttttgcccttgccctcttgctctctgcttcctgtatccagcctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagtaagtgggggtagtggtccctctgctgcatgtggaaagtgcccctgagatggctccatggcattggcataatatcacattccctcttcatgtttgggtcaactgtattttttgtttgtttgtttgtttttttgagacagggcctcactttgtcacccaggctggagtgcagtggcgtgatcacagctcactgcagccttgaacttctggtctcaataatcctcctgcctcagacttccaagtagctagggccacaggcatgcgccaccacaccctgctaattttttttattttttgtagagacaaagcctcactatgttgtccaagctggtctcaaactcctgggttcaagtgatccttctgccctggcctcccaaagtactgggattacaggtgtgagccacaatcctcggcctggatttgactcagggacaaccagtttccaagcagagctgcaggtttgcataaatccaggaggcaccatttacatagaacacagaacccctgcttttggttgtgagccttaactgtttcagtgatgtatgccattatttctaagggcacaaatcaaccactataaacatcacccagctcaataaggagaacatgactaacacccccaaaggccccctgccgtgaccactgccattaacatccccatgccagcgtagccatattcttacttctaactccatagcttaacttgcctgttccatacttactagaatcatacactatgtcctgttttacaactagattatttcgcttggagttatgtttgtgagatccagtcatgtttaatgtgtacttacagcttttctcattgctgaagagtgttccagtgtatgactataacacaattcgtttattcattctacctgtgggacaatctaaggacttgattttccgctgagtgaggtggattttgccacttggagggatttgtgtatggggttccctacacagaaaccacagcgttagtcaactgcacccacttcccttccaactgccccaccttggcaagtggattggtcagtaaggatacttcttaatttctctctgtcctccttgatgcattagtaaaatggagatagtaatttttattattatcactgaggtattatttacatgtcatcaaatacacagaacttaagtgtatcatttgagtgttgataaatgtatacaccctggtaactaccactgaatcaagagatgaggcattccatcaacccaggaagattcgtcatacctgcttccagctcgtccacacgctccacaggcaccctttgtttttgcttctctctctgtagattcgtttcaccagttttcagactggactgtgtccagtttctttttctcagcatgaggcttgtgagattcgtccaggtcaccatgtgtagtcgtagctcattcattctcattctaccttgagaatacacctccgtggcttacatcatttaaatggtggtaaaattcattccctgccagggtcatatttccgaggaccatcgagcctggccagagtccaacccctctcagactttatcctcctcgccactcttcattggtcctagacttgctgcatctcttctactcagttacccagacctgaattccaatcttgacttcaccaacttagacaatacttttgacatttctgaccctctgctttagcaattctcaacctttgtgccctgtctccctttgacagcatggtgacgtctatgggccccatcagtctaatgttctccaaattcattagataaaatgcactggattgcaaaggaaaccaattatgttgaaaccaattagaaaataaattcatgctgaaatatatgtccccttgtcagcacattaagtaaaaagctctagtggcaagtctaatggccacaataatttcagagcagcagtgatgactaattgctgctgcaggatccatgcagtggctgtggtgggacacgaaaatctgccagctctttgatgacaaagtccgaggaggagctaatgccactctgctttgtggcctgcattcataatcgaaagagaagaaaagtttctgttataatctagtgaaaattaaaatgtggaattttttccattgaaattattagaccccctgaattctatccaaatgggccccaaaataagagatttttttctctttcctcaccagtaaaacggagctaatgtttttcctccgcaggctgctgggagactttagcaacacacaagtctacagcaggcacacagtaggcacttaataaatgtaacattgcctctccttctcattcatgactagatgtgaacacttctagcttacacctgtagaatcaaaagacagtaatctcctagagtttttggtgaaataattgtctgatttttatgcaaattccaaatcagatatcctctcagcctaaaatatcctccaatggacaagcatgtgccctgggattcccatcctcccatgggccagcagcctgccatagatgggctgcctaccataggtaagcatcctcccacgggccagtgtcctcccgtagatgggcagcccaccataggtcagcatcctcccacaggccagcatcctgccatatacgggcagcccaccataggtcagcatcctcccatgggccagcatcctgccgtagacgagcagccaaccataggtcagcatcctcccacaggccagcgtcctgccgtagacgggcagcccaccataggccagcatcattccacaggccagcatcctgccgtagacaggcagcctaccataggtcagcatcctccacgggccagcgtcctgttgtagacaggcagcctaccataggccagcatcctccacgggccagcgtcctgttgtagacaggcagcctaccataggtcagcatcctcccacgggccagcgtcctgctgtagacaggcagcctaccataggtcagcatcctcccacgggccagcgtcctgctgtaggcgggcagcctaccataggtcagcatcctcccacaggccagcgtcctgctgtagacgggcagcctaccataggtcagctcctccacgggccagtgtcctcccgtagaagggtagcccactataggtgagcatcctcccatgggccagtgtcctcctgtagacgggcagcccaccataggtcagcaccctccatgggccagtgtcctgctgtagacaggcagcccaccataggtcagcatcctcccacagaccagcatcctgctatagacgggcagcccaccataggtcagcatcctcccaagggccagcatcctcccatggacaagcatcttcccatgagtgagcatcctcattgtttactcactgaacccctagaaagtggcaccaagtggattactgccaagctgagtattttttttccatgaaacagtccatgatttaagaaggcctcactctaatcagcaccacatggaaaaaataaagcttcagcccaagccctataataatctaaaaacacagagctgcccaagtcccaagtgatgttacaaatgtcctataataaaaatagctactctgcacagttcctcaccattttccaaagcttctgtgtccacacatcatttctgttcactcccgtatccctcctcttggcaggacagacttctctgagctctaaacaagttgattgacacagtcaagcccacagaggctgtaaatgtgagactggaagtcacttttattgagtgccaactgcatgctatgtgctttcatacacgtaagcttcacagccaccctattgttgagggtgtgccttatactcgcacagtcgaggtgggagcaggggtgaatattttgcagccttaacaacaaactggtcccatgctgggtgtcagggagaaacaccaactaggtgtggtatatgctaggcccatttacattactgtatttaatccttgtaagcccaggaggtgtgtcctatcattattactttttatacacaaggaagctgagatccagaaaggataaaaaaaaaaaaatgtgctcagagtcacaaagggcagagcaggacttgaagcaaagcccatctaaacccaaaccccaggctcttttcactacatgaccttgaccttaatcagctcccgtgcatacaggtcctacattaggccgtatgtgagagcagccctactgtgagctcacagtgccattactgatgacaggaggttgggaaaggtcaagggcatgctaaatgtcatccagctactaagcagccaaactgggatctgagcccagtcactttgacccctcacggtgggctctcaggtatctcagtgactccccctggagaaggtgaggcttgggtaggggagggagtttcagtaaacattcccctggggattctgaaacacccacctagtgggtgctcccatctcccaaaccccatcactggcattccagaggcccttttcactggtctacaatgccaaggtctgccgtgtcttttgggaatgaacaaagagacaagactgggaaccactgtccaaatgggggatttaaggctaaaccctactcatcataactaactttacccaaagtcaacatgaaatgggcgttgacaactgtttcccttgttagagttcagaataatttcttgagaaatttggaagtgcagtgactttctgcagtggtgaaaatgttctgcactgtccaatacaatagcttgtggctattgagtgctagaaagtggatgaccgtgattaagaaacaagagttttcattttatttcattctcattaatttaaatttaaatagcaacatgtggctggtggctaccatcttggacagccatgtctaaggcacatctggtagttacatcttagcaggagggatgctgaattgtgcaaaccgaatgggaagtggagatttaataacataaactctatgaaggggtgtcaagaagatgagactgcaagaaaggcttgctggtccattttatagcctcatgccttcccccagcacgacatccaattgcagcatcctagaagcctaaaggcagccttgggagggtgctagtaagaactgctgctaagaacttctctcggaaagtcactgggatagcactttattccactatctcatttaatcacaggaggttggcatccctagtcttaatttaggtgagaaaacaggatcagacaaataaagcaaacggccttaactccaatgtccttatccattccacaaggccctggggcctggtacctcattcccttattgcaaaaggagaaagacttacgatgtctgtgcctttacagacactctgcaagcagggagtgggggctggaatgtccctcacaggcagtgcaactggcacgatatctacacttacttgcatataagcaatatttacaattaacaaaaaggcagcaccgttgcagtatttaggggaagagttagcttggaatgtactgcggccctcttagtcaagctacgtgtcaataccaggctatattttctgagattgcactggacaagccagacggacttctaatgatcgtcaagcaccatatgattatgagagagggcaggaggggagcaccgcgggagagaaggagagagagggaatgagggcgtatgctgagatgaacggcagtttatctcccagtttctgaatatgcttagcattccatcataatctgcatacatgtggaatttaaggccagagagaacactggaaataatgttatccaagtccctgtaaggaatctgaggtccggagatgtgatcatcccaacatctcacaactatccaggaactttatgcaagatcaatgcagtgttttcaatgaagagaaatgggaaagcactatatttcagcactaactcagttggggcctcccaatggactgggccctcgtctgtcatattcatggtgtaaccctagtgcctacaatagtgctgggcatatagtagacaggtgataaatattttttaaatgaatgagggaatgaaaatattcagccagcagcagccggacacaagggaaatgtctgactgctggcaataggaccggcgggccagcaaggcaaatgtgggaaggaggctctgccttggttggaagggctctgcctcctctcagtgccctccggtccctcgtccacccccacaccagaacttgttctcagatgcagatgagttaggtctagggcaaatacacttgttgaagaatgcagaggctccacagggagatttggagagcagccccagggctggctgtgccgcttgacagaggaggcccttgtgaccacgaagcacactcgaggagcggtggggtacaggaatcaacagccgtggcaatcgccactctccataatgtgcagggctgcacagaaacagcttccaaggtggagtgagtggtgattgtcaggtttgtgggtttccttggcattaatcttcccggagatggagtcaatttgaaaagcaattttctaaagaggctttatcaagagagtcagtgaaggatgctcagctacaatcaaaggggaaaatacacctggctgtgaccagctgcaccagctgtgtgtagaatgagcagagccagcccaggccggccccatcagccagctgggagtgacctgtctaacacagctgcccccagcccctctgggcaccctgaggggactgttcactgagctcctttaaggctgtgccaaaatatgtgatccagctctgaagtttaagtgaatttggaaataaatgttaaaacctggtatcaatgccggaagcagcatgggagtgagaggtcagcgtgtgctcggccctgtgccacctgggggactgtggaccagcactcccgagctgcagaggcttcctgcacaagttcatgcccacctgactctgctacagggggaggagaaaacctcaccatggccacctgctgcgtgtcgtcatgtgactgccacaaaagcaggcatcttgggcacttgagaaagagtggctgtcattgttactattgtgattattctatcaaaacaatcacagccttataactttttctttttttttgagacagagtcttgctctgtggcccaggctggagtgcagtggcacgatcttggctcactacaacctccactgcccaggttcaagcaattctcctgcctcagcctcctgagtagctgggactacaggcatccaccaccaaacccggctaatttttgtatttttagtagagctggggtttcaccatgttggccaggctggtgtcgagctcctgacctcaggtgatccgcctgccttggcctcccaaagtgttgggattacaggcatgagccaccacagcttcataactttatcttacagttgaagattcataacacaagaagcattccccagggcctcctgggaagcaacacctatttcttgacacaaggcagtttaaacacttacttgcaatgatacacaataaaataaagatacaagccaccccgacaaccccaagtttgtcttttataagactggaacactacgattttgcatgttatctctaataggtcaaagaagaactcttttttttttttttttttttttttgagatcgagtctcactgtgtcacccaggctggagtgcagtagcgtgatctcagctcactgcaacctccgcctcccgcgttcaagcgattctcctgcctcagcctcctgagtagctgcgattacaggtacacaccaccatgcctgactaatttttgtgtttttagtagagacggggtttctccatgttggtcaggctggtcttgaactcctgacctcgtgttccgacccctcggcctcgcaaagtgctgggattacaggcgtgagcctccgcgcctgacctaagaactcttaaacctccagaaagcatgcttcattttctgcagcaaatgagctccagatcatggcctggaaactaacaccctgtgactatttaaaatgtttctgcagagcctctttttgttccaccaccaacctcctcctatttaaccttcttataaattgataattcctgagcatatatctcctttttgctttaaaataagaatgtttcattccttttcttctcataaaagcaatacatggtcactgtaagaaaatcagaaaatgcaagtgagcaaatgaagagagaaacaagaaacatctggaaaatactgttcctaggctctcccaatgccacgatgccagccaaaaaaacctgacctgtgaggggagaatggtgttctttctctaccaagttcgctgcctctggaattcacagcatgcttttaatttaatttcatagtaacttaatattctcagaagagtccagccacatgtctcctctctcagcagacccagctcctgtgcaggaagcagttcacatggcagggcaggatcggggcgtttttctagctggcagtctctccgtggtgctaaaaaagccagactcctcagccaacgtgaaaagagttgttctagtgctgggatgatctcttatgatggaaggagagaaatacagattggaccaaacctgagatgaccttcaggcacaccatggctaagggggtttcagtagatggtgacagtgcctcttgttcaggtccccttcactgggctatgcaccaccccagctactgtgggcattggctgctaactgtggtcttctgcctgtgtctctgaagaatcaccctcaggggctatggaaacctggctgaaataagaatacataaaacccatgctcctgcctccaagcaggacaactgtgtggtggcgttgatgctccaaagccagcatggcctgtgacccccaggcacaccccagtgtccaaggcttctaggaaaatgtgtgattcttaacacaagtttgtgtgtttgtccctactcccacctgtctttcggctttccaaggtgcatggaatatgtctttcagtctccctccatctctcccttgcaccctctatcacaaatgcacaccactcactctcaaataagacctttagcctgggcaatcggtggcctgtgttctagtttccccttctcagcctcgctgtcattttccctcccttagtcttagtcgctaaggccttccccatgagcgtggggctcctgggagaaacagatacgacagccaccatagaagattcacacagacaggaacacaccggcccttgttgttctgccagtgaggctccttcttgggactcaaattccaggctcctctgccatgcccttaatgtcaaagtggtcgccggcctacatctatctttacaataacttcttaagggctttttaaagaaagcaaaagaagtgaggtgactgagcccacagatggaatgaggcccatattctgtatcaccaacgatgacataaatatagtcaatagtcctcagacactgtgcagagggatgtggtaatcagtttccaattgctcttctccagagacagataacacctgttttaggttgggttgctcggaagcagagcctgagattgggtttgagtacatgtgctttattgagggagggcttttcagggagaactgtaggagagtgagggatttgggaggggcagaagtagccaagaaaggatgtggaaccaggtatgtgcatgtggcctgacccaccgggggctttggagcatcaacgccaccacacagttgtcccgcttgggggcaggagcattggttttatgtattcttatttcagccaggtttccatagctcctgagggtgattcttcagagacacaagcagaagaccacagttagcagccaatgtccacagtagctggggtggtgcacagcccagggaaggggatctgaatgaggcactatcactatctaccaaaacacccttagctgtggtatgcctgaaggtcatctcaggtttagtctaatccatatttctctccttccatcataagaagtcatctcagcactagaacaactcttttcacgtagcgaaggaccttatagttaattcacagaaacttcatgtatggtgggctgtggtcttatttctagcaaaagtggctgtctcatctctgattcttagccaattgaagaaatattttcagttttccacaaggcaagcaatgccatttttctgccagagtttctacaaattgacttgtaaagggtctgtcactatgactccagtccacaagggtcctgggtgcaaattgggacagaaaacaaattttcttagaattcagctggtgttctgaattcttaagataatagtgaccactgcacttgacaaatgattagtgatgttttataatatctataatgattgccactcagttacagtctttggttgttggcttgtgaatttccttcttgaaacttttcaagaagccctagactacaggaaagaaaagagagctcaaattcaacacagaactcagagccagggtctctcttcctgttatcattctctgcttcctgcaactgtgcttctcaaagactcccaaagcccctctggctcaactctagaaggaaagcccgattctgggcctggctgcttgtctgcctagaaaccctgtgatagaatgtgtcatttccctcataccttgaggttctggatgaatatttcagagtcctccagagaggtggccagaaaacctgcaaaacaaagctgcagtttccccaactgcttttcctagagcctgtgagccgggaaaaaactgaatgcccttgaaacagaaggccaagagactctctgcctgttgttgttgttcttatcagattcaaattcaacatacataaacaatttagacccgcactgtccagtacagacgcaaccagccacaagtggttatataataacatattagattagttaaaattgaataaaataaattgaacattcatttcagcactcacatgatctatgtttcaattgctcattagccacatgtagccagtggctaccatactagagattatatatatagaatatttccatcatcgtagagtgtcctattggccaatgctggtctagacatttgtaaatatactatgtatatgagtatacatgtatatacacatatagacacgttatatatatgtgcatatataatgtatatgtaggataatttatcttgccagcaactgttcagggcaggaattaatagctcagatcatgcaaatacttgcccacaactggactcgtactctgagactctttgtgctaccctacacagctgtccactgctgggctagagcccaatctttagttattcatcaccttacctgttttgtttctgatcttgttctgaataaatagcaccatctttgagaaatccaggttatggccctcattaccccgacccgcaaagttggcttaatgcctgctttccaccaaatggatggtttccccagatcctgggaacagaaagaccaaccccaccatcactggatccccatagctgatggacactccatacatgattcagcatcagtatccgggggtgggagaggggaatacagcagtactccatgaaaccgtttaagtctatatttgtaaagttcctccagagagtattaatgaactgcactgtatgtttcagcaagccctcccaggttcatggccttggttcctagggcaatgcagaaccaaggcttgactccaactgggcacatgaccactgtctttttgtaaatgtgctttacaagatgtgtgtttaaaaatattttacttatactccaaaataaaagccatattgaggaaggatatttgcataggcaatgggccagtacatgtgccaagcattgtgcctggtattttattttattttattttatttatttatttatttatttttcagcacaggaagataatatttattatattttaactagaaacagaacagatagcaagttcacgaggtatgaatatttttttcttaaatcaggcttaaacaacaataataaaaaacaagtctgcatatatatgttggtcactattataatcttcaagggcacaaaagccagcagcataaagaaacatgaataatgactgagaagttttgatgtgccaaaaacaaagatcactgcgttgaactcctttattttgttaatattattattaaacatttaacaggtattaattattgttatttggcaaaatatccaacatgcacatggtattcctacaagaatcttgccttaatattgttaatattaacactaagtttattcctctccaaaattcaatgagttatgattccactctctgtaagtgttagtgttagtggtaatatgcaaaactgattttgtgtgcagggttaagtagcagattgacttcgcatttggtggccagctgtgtaccctaatttttatctattttcttaataaatttaattacatttcataagccctgagataacctgctaatgattgtatacttttaatctatactttattccactcaatttgaaccccacataataagtcttcaaaattatttacagatggttgtaattaaagcaatgacaaaatttactacttgtatagataagactgataataaggcctttaactaagagttgcatattttacatgcacttttaacttgctaggagcaactcttaaaattacatctatcattctgtcagaaagcagttaagtgcttttcattttgcttacttctatatgtgtaaccagactcacttttttcctcccgtgtaaaacaactgttttttttccttccccaaatattaatacttgtcttccaactgaacaattgctaaaaggaacttagcatttacacagcacattgataactatagtgctcagcagagacatatgcccataataggcatctgataaatgtttgttccacatggaatgaattgtaaggcagctgtttgagtcatatactgttcatcatatactgcaactaattttgtttaactaggaaattcagtttaccagatttaattcaccctcaagtataaatccaaaaactttaaattaaaaaaaatcgatttactaatcctcagaaaaagtaaacaagttaatcatagttgttactatgctattagttgatagaaaatttttaaaaattactttccactaaatattgtgtacaactaagtgaggggaagaaagttttaaaaaatgaaaagatattagctaattctcatcattttctccacatttatccttgcagcttatttgttcatatatttattcctgttaacttctctagctgaaagagaattttattatctgaatggagttccccatcaccttacgtacaaaatattagtgaaaagctagtgtaaatgtaagattgtattttcatgtcatgccatatttctgcatttattttttgctagcattaaatttttcgtatttaaatgatgctgtatagaatatgagataatctgccaattgctatgatattgcttgcttacaatattcagtttttgttgatagctttaaagtatattgcacacttgtcatctagcacactaataaataactatttttgaaaggatacactgacaaattcttaagttaatggctttaacccaacatttttagtcagttaaagaacagcaatggcaaaaacattgacaatacagttcatggtccagttctcccatcttacggtacaggttccatcagatgtggtatcccaaaaacaggagctgctgtgcgaaagccatatgcgctcttctggaccactgcacatttcacaatacatttataagcttttcccagcttaggcagatgtgttaacgataattccactatgcttgcggtccactggttgatgttgttgtaattataatcttcaccacctaaaaccccgtctgcacattctttgacaatattgtgggcttcctcagcattgaggccaacctcgtcgcagtggcgatggtactcctccatggtagcgcctgttctccctgggggcggagctacgcctgtgcctggtatttcatacatggtcttatttaaccacacaagaatcatacggccgggcgcggtggctcacgcctgtaatctcagcactttgggaggccgaggcaggcggatcacaaggtcaggagatcgagaccatcatggctaacacggtgaaactccgtctttactaaaaatataaataattacccgggcacagtggagggcgcctgtagtcccagctactcgagaggctgaggcaggaatggcgtgaacccgggaggcggagcttgcagtgagccgagatggcgccactgcactccagcctgggcgacagagcaagactccgtctcaaaaaaaaaaaaaaaaaaaaaaaaagaactatccacaatgacagtgaaacttcgagtgcttaaataacctgcccaagctctcatgagcagtaaacatagaagcagaattctaatccaaatgggtttattctcaaagtctggagtcttgatgttacaccacgcaatcctcaaatgcggtttccttttttccttctttctactgcaagaacctttgagcttctcccactccaagaaggccatctccagaaaggagattgcctgtaaggacagcctagagagtacttgggcttaacctcgctccaactctcgccaaagactcccccaaagtctcctgatcattcattggactgcctttcactggaattaatttacccattttcagcttttctttttttttttttttttttttttgaggcagagtctcgctctgtcacccaggctggagtgcagtggcgcgatctcggctcactgcaagctccgcctcccgggttcaagccattttcccgcctcagcctcccaagtagctgggactacaggcgcccaccaccaagcccggctaatttttcgtatttttagtagagacagggtttcgccatgttagccatgatggtctcgatctcctgacctcatgatccgcccgcctcggcctcccaaagtgctgggattacaggcgtgagccactgcgcccggcccagcttttcttaatggtagtaatggcagtcatattagcaacagcttctatttatcaaagcacttagcactttgaaagaaagacattatgagttcctgcctcagtctgggttgtcccagaagtccaacctgagacaagacttgggtgctgacagttttttgagaaatgatcccaggtaacacaagtgaggaattggagatgtaaaataaggaaggggagaaaagccaatgaagagtgcattaatgagcgagttgccaccgtgggcagctgagctcagtcccactagggacactgagttgtcacgctgaggaatagagaaaccggggtaaaaacctgtcagtcactgggagagagctacccctcaaaggttaaatccctgccacctttgggccgccctgcacgcaggctgtgcaggcttccacggaggtgggaggaagcccagggggaacacggggagattctcgtgcctggggtgggaagcagtggacgtgcaagggagcttcagctgcaggtgaactcagaagggacttaggagactcaggagggacatcacagcatctactacattctccttccacacagaaggttccaagcgtaagtaacttgctcacagccgggcgtggtggctcacacctgtaatcccagcactttgggaggccaaggcagctggatcacttgaggccaggagttcaagaccagcctggccaacatggtgaaactccgtctctactaaaaatacaaaaaattagccaggcgtggtggcacatgcctgtaaccctggctactggggaggctgaggcatgagaatcacttgaacccaggagctgaaggttgcagtgagctgagatcacaccactgcactccagcccgggcaacagagtgggaccctgtctcaaaagacaaaaaaaaaaaaaaaaaaaaaaaaaagagataagtaacttactcaggctcacacagccagtgtgggaactaaacccaggtctgattgatcaaccccaaagcccttgccctttccgccacctgaagctgccctcaaaatcccttgtaaggtgcacccaccactgcttatcctatctcctcttcactctgccctcaggaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatccatgtcctatgtgtgactctaaattctttatttctgtcattcaaatgggtgatatcctgaaaaaaaaaaaaaaaaaaaaactgggacagctttcccctcatttttttttttgtttctgagaaaagaacgtattttaaaagccacatagagtgactccaagaacaattgtccatggtctcaaacaaggggctgttacataacaagaaaatcaaagctgaggacagggtgtgagcgccacatctctgaaagcacaggagacactgtgctataaatcctttggggagcgatgttttgaatttagtgagatttaccagggatgtagattaaggtgatgtgattcaaaagatgccattcatagagagccctagttactgcatggggaaagagatccaggaagcatgagtgctggatattttactaccaatgccaagataattcactctactcagccggcgtggcaaatataaaacttacagagcgtggctgtgctctcaccagctgctgctctgagttatgttaaaatccgctagagcagcccaaatttttctcagtttgtatagagttcatcccagccccaattttctggggctcctcacatagctacccaaaagagaaaaaaaattaagacaagcctggcaacacacctggtgaagagtagtttactagcttttcaaacaagaatgtcccttttcctaagtcactttgaggtgtctcaatctgatctgagtgagaggcgacaggagtatttttttttttttacagctttacacacacagatgtgggctttgatttccaagtaatataatggaagagaaatctcatactcccccacagtttgatgtcattaatgtgttgggaaaaaggcctctgtcccggaagagtcatgggaggtgaaaggggcacgtttgaagatgcgagcgctatcttcacatagttctccagttgtatggagcctcttctgccaagagagggccatgcaattcatcccagaggaacctgaggcctgaaggaggtgagagaagacctctgtgaggaaagcacacagtcaccttctcggcaactaagcagtccctgagaccatttaacatgcaacccgaaggttatggtcaatcccaaaagtcaccactccattcccaactagacattaccaaagtgacctacccagagattgcttctcatccccagtcccaatgcacatccattcccaagaaatgctttgtcttcagcctctccaggcaccatctcccttcctgtgggagcagagagcttagcctggagcacctttccttcaagccagcaacacagagcactaggttcaattccctgaaggtggccactttaagagagaaatctgaaaaccccatttgctttcttttctcccatattggcatggatttctgtcttctctaacaccttgtgaccttctctatatcatgctttaaagtgtaataatatgattttttaaaagaaatttattacttgttgcaaaggtctttttaaaccagtttagatttcaagaaaaaataaatggaaatcatcgaaaattcatttcacattaatggtctaaaaataaaccaaaggacattatgtgtgcatgtgtgtataagtgcacacagaaatatatatacatatgtagactatatacatgtgtgtatatatgtgtatatatacatacacttgtataaatgtatatacacatatacctataatgtgtgtatgtgtatttattgaagaaacagataccatactcatttctaaaagaatattcagagaatatcaagatgattctggctgaaaaaggccagtggaaattcaggtgaaaatgttcatcaattcccattgcatcacctctgtaatttttcagctctctgtataaacattaaatgtcttatatagcagcaaaaatataaaatagttgtccatattttcacaggtgtggtgtaatttataaaattagaaagcaacttatcagctacttaagagaaatggcaagttttgatatgagtatacaatatataaaaatatatatagtgctatatatataaatatttggtctctatttcattttttgcatcagtattaatactaaaatatgtctcgctagtgatgtttttatgatatccctgatcctaactgaagagacagttatttatagtcatttattttaaaaaatgaaaataagtgaataataattaggttaacattgttgctccctgtgacaaaattttataagcaaatttcaaaagacatgttgtaaattaggaggctcaacaataaaacattatgctccagaa

SEQ ID NO: 1528 - DNA, 257626 bp, Homo sapiens; identical to SEQ ID NO: 1527

SEQ ID NO: 1529 - DNA, 33000 bp, Homo sapiens
ctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctccagcggtgcacccgctctgcccctcggacacggagatcttctctggcaatgggcactgctaccgcctggtggtggagaaggcggcctggctgcaggcgcaggagcagtgtcgggcctgggccggggccaccctggcaatggtggacagtcccgccgtgcagcgcttcctggtctcccgggtcaccaggtgcctgccccaccccccgaggggccataggttgggagatctctgaagcagtggggcagagcctgcggctggggagtctcaggaggagggaggtgggagctgggccggccctggtgagcaggtggcgccggccggtggggccgttcctgtcagctctgcagatgcagaggtggacgcgagctgggggcagcctccggacactcctgggcacgccatacgggaggtggcctgcacggggatccctgccggtgcccacaggccccgtgggtgggtgctgctgtgagcctgggctggtgggccctgttctccgggctctgagcctcagtttccccatctggaaagggggacagtgacggggctcccagcgggctgctgtgagggtgggaggatggaggagtgccctgagccccctgccatcccacacccgcccccaggagcctagacatgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcggcctggaggtgtgcgaggggccaggcaggggcctgagacgctggctgtggttaggggcctgccgagcgcccgcggtggagcctgggctgaggaggaggggctggtgggggggttctcgggcggctcggtccccagtctgttcgtcctggtgtcctgggccctggcccggcgcctcactgtgcacttgccaccccaggcccagtgcaggatgccgagaacctcctcgtgggagcgcccagtggggacctgtagggacccctgatgcctctggcacggcaggacggcctctcagccccgcacgagcccgtggaggtagtcggccccccacgttctataacctgccctcctgcctgcccctggaggcctcgcctgccctgcccactgtgggtctcgccaaaaaacttgggggccttaatgttgcttgtgcccagtgaagatggttgggaaaatccagagtgcagagaggaaagcgtttactcacattacccccaggccttttctctgagtgtgggtgagttattcctgaaaggcaggtcaggggtcctgccccccatggacagtttccatcggagtcttcctctcgagcgacaggagccaggcctgtgggggtccgatggctcgctctccttccctcccctcttcctgcgaagttcgggtggggggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctggggtggtgggcgccgcaggactcggggtggcctctctgagctctcacgtctgctggtcctgtggccatcagagtggttcccagtcttaggtggacagagcaggggttccagagacaccagctcattccaggtgtcctgggggtggatcgggtggggcctgcctggggaccggcctgggtcagtcagctggccggagacagggacgcagcactgggctgggagtgctgcccgggcggggagacctgtcctcacagcaaggccaggctcgctggtgcaggcagttgggcatctctgacggtggcccatgggcgaatcagggccccaacaccctcccctcctcgcagggaccccggagaacggcagcgagcctgagagcaggtccccggacaacaggacccagctggtccccgcgtgcatgccagggggacgctggtgccctggagccaacatctgcttgccgctggacgcctcctgccacccccaggcctgcgccaatggctgcacgtcagggccagggctactcgggtccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgcgcagcagacacacccagcctgcaggcccctcccacgtccttgccacctctgacctccgacctccgacctccaacctccgacctctgcagtgcctttgcccctctcccagtgggagaagctctcgcctgggcccttggcacgagctgtgcctcctcttcctctctcccagcacagccgctccttcctgtctgtcaggtcttggcctgtgtcctctccccgtgtgtccccctgtctgcaactgtcctgcctgtccttgtcacgagcactgtggggaggctccctgaggtgtggctgacgaagcggggagccctgcgtgtccaccctcatccgtcgtgcaggggtccacgggccatgaccgtgaggacgtgatgcagccctgcctccctctccacaggtcaccctccacggccaggatgtcctcatgctccctggtgacctcgttggcttgcagcacgacgctggccctggcgccctcccgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcctgaggcccaaccctgggctgcggctgcctgggcgctatgaggtccgggcagaggtgggcaatggcgtgtccaggcacaacctgtcctgcagctttgacgtggtctccccagtggctgggctgcgggtcatctaccctgccccccgcgacggccgcctctacgtgcccaccaacggctcagcctcggtgctccaggtggactctggtgccagcgccacggccacggctcgctggcctgggggcagtgtcagcgcccgctttgagaatgcctgccctgccctggtggccaccttcgtgcccagctgcccctgggagaccaatgataccctgttctcagtggtagcactgccgtggctcggtgagggggagcacgtgatggacgttgtggtggaaaacagcgccagccgggccaacctcagcctgcgggtgacggcggaggagcccatctgtggcctccgcgccacgcccagccccgaggcccgtgtactgcagggagtcccagtggtgagtatggccgaggctccaccaccagcccccaggcaggtgcctgcagacagggtgctcacacagggcgtgaggcctggcttcccagtgagggcggcagcccagttactggggacgtcggccccgggcaggtcctgctggctggctcctcaggctacctggtgggctttaaattcctggaaagtcacggctctgacagcggctccgctaactcattccaccgtctcatttcacgaaatgaatttaaaactccgctccctgacctcacacgagtccccgtgagtctctcacgccctctgctgtgttctcgcctggctaaagcaagtggcttttgaggtggagtccgaacccctgatgggaaactgcgggctgcccgcagtgccaccatgctgggtacatgggggacagggctgttccatcttgcgggtacctgccccttcaccaggggccttgggaggggccatcagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctctcatggcatgcagagccccgggcacctcctctcctctgtgccccgcgtgggactctccagcccgacgggaggtgtgtccaggaggcgacaggctaagggcagagtcctccacagagcccaggctgacaccagtccccccgcagaggtacagccccgtggtggaggccggctcggacatggtcttccggtggaccatcaacgacaagcagtccctgaccttccagaacgtggtcttcaatgtcatttatcagagcgcggcggtcttcaagctctcagtaggtgggcgggagtggggaggggaggggatggggcggggcgggggcgggctccaccttcacctctgccttctgctctgcttcatgctgcccgaggacgctgccatggctgtggtgagtggagggagggacgccaagcagggcaggcctctcacctgccacctgggcccactgatgcctgtccctgcagctgacggcctccaaccacgtgagcaacgtcaccgtgaactacaacatcaccgtggagcggatgaacaggatgcagggcctgcgggtctctacagtgccagccgtgctgtcccccaatgccacgctggcactgacggcgggcgtgctggtggactcggccgtggaggtggccttcctgtgagtgactcaggggccggtttggggtgggcaccaggctcttgtccgggcaccaggctcttgtcccggctccagcctcagccgagggaccccacatcagggggttgcttttctgagcctcggtttccctgtctgttgggaggtactgggtgcacaggagccctgaggctgcacgggagccgggagaggcctcagcacagccgggtgggccctgaatggaggcccggggcgtgactgcagagtggagcctcggctgggtcccaagcaccccctgccccgccaccgcgcacctgtgccccgccactgcgcacccctgtcccggttcactcactgcctcccaccgccccggcaggtggacctttggggatggggagcaggccctccaccagttccagcctccgtacaacgagtccttcccggttccagacccctcggtggcccaggtgctggtggagcacaatgtcacccacacctacgctgccccaggtgagggatgagggggtgagggggccactgcctttcaggctctgagcacggggcccccccagtcccccagtcaagctgccccgcttcctccccaacagccctcactgtgacctcacctgggctgatggcttaggcccctactggggtgagggaggggccaggcgtgggaggagtggacagggaagctgggccccctgaactgccccccaccgcggcctggctcttgctgctctgctgccccgagtgcagctgcacttggaggcggtgccgtcctcaccaggcagccctcagtgctgctgcacctgtgctccgtcccgcacgtggcttgggagcctgggacccttaaggctgggccgcaggtgcagccgttcaccccgggctcctcaggcggggggcttctgccgagcgggtggggagcaggtgggggtgccgcggctgccccacttgggcctgtccccacaggtgagtacgtcctgaccttgctggcatctaatgccttcgagaaccggacgcagcaggtgcctgtgagcgtgtgcgcctccctgccctctgtgagcgtgtgcgcctccctgactggggcctgctggtaccccagagtgggtgtctgttccccagtccctgctttcctcagctggcctgattgggggtctgcccagaggggtcgtctgaggggagggtgtgggagcaggttccatcccggctcagcctcctgacccaggccctggctaagggctgcaggagtctgtgagtcaggcctacgtggcaactgcggtcctcacacccacacatacgtctgttcccacacgcatccccccaggggccctcagtgagcattgcctgcctcctgccagggtccagctgggtccagtacaccagaacgcacaccccagtgtcctctgccctgtgtatgcccttccgccgcccaggttggaaggtggcaaaccggatgagtatcctgggagggggtgagctcaccggcagtggccaggcccctgggaaacctggagtttgggagcagcatcctccacgggtcccccagaccttccagcaggccaaatagacctgtgttggaggtaaccccactcccacgccaggtgctgatccgcagtggccgggtgcccattgtgtccttggagtgtgtgtcctgcaaggcacaggccgtgtacgaagtgagccgcagctcctacgtgtacctggagggccgctgcctcaattgcagcagcggctccaagcgaggggtgagtgttgagcggggtgtgggcgggttggggatgggtcccatggccgaggggacggggcctgcaggcagaagtggggctgacagggcagagggttgcgccccctcaccatcccttctgcctgcagcggtgggctgcacgtacgttcagcaacaagacgctggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgctgcctcttcccactgggcgctgtgcacgctctcaccaccaaggtgcacttcgaatgcatgggtgagtgcaggcctgcgtagggggagcagcgggatcccccgactctgtgaggtcacggagccctcctgtgatgccgtggggaccgtccctcaggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtgagccaggccgtgggagggcgcccccgagactgccacctgctcaccacccccctctgctcgtaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcactgtgctgaacgaggtgagtgcagcctgggaggggacctcacatctgctgcatgcgtgctggggaccaagacctgttcccctgcctggagctttgcggagggctcatcccgggccccagagataaatcccagtgaccctgaagcagcaccccgacgttccgctcccagcagccacacccaccaggccctctccggcgtctgctttccacaatgcagcccccgcccaggagggcccatgtgcttaccctgttttgcccatgaagaaacagctcagtgttgcgggtcagtgcccacatcacacagcatctagcacgtaactgcaccccgggagtcgtgggcatctgctggcctcctgccggcctcctgccctgctgacagcttgctgtgccccctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggtaggatggccccacatgctctccccgccccgcatgcctgccagggtactgggttcagccccccagggcagacgggcagcttggccgaggagctgagcctccagcctgggctccttcctgccatggcgttcctcggtctctgacctgcttcagtagcctcagccattctgctgtcctgtgtgaacgcagggtgcctctcgggggacccagggtgtaaagaggggcccagatgtggggagggactaagaagatgctgctctgtgccctccactctcccctcccctcccccttccctcccctagcccctcccctccccttccctcccctaacccctcccctcccccttccctcccctagtccctcccccctcccctagcccctgcctcctcccccagcccctcccctcccctagcccttcccctcctcccctcccctagaccttcccctcacctcatcccgctgagcccctccactcctcccccagcccctccatcccctcacccctcccctcctccttcctcccctccctctcctctcccccttctctctccttccctctcctctccccccttttctccacttccctctcctctctcccttctgccctcctccttctctcatgtgaagaggtgccttgtgtggtcagtgggctgcatcacgtgttccccaggtggaggccctgggtcatgcagagccacaaaaaatgcttagtgaggaggctgtgggggtccagtcaagtgggctctccagctgcagggctgggggtgggagccaggtgaggacccgtgtagagaggagggcgtgtgcaaggagtggggccaggagcggggctggacactgctggctccacacaggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggtgccgcggcccgtgccccacgccacccgcccgccccacgtggcccgtccgccccatgccgccctttcctctgcctccctcctccccacaaccgcctcgcctttgccccatcccatcttcgtccccctcccctccccccaattcccatcctcatccccctcccccaattcccatcctcatcccgctcccccaattcccatccttatccccctcccccaattcccatccttatccccctcccccaattcccattctcctccccctcccccttccctattaccatcccttttctccatctctctccccttttctccatttcccccccgatcctccccgtccttttgtccattcccctcatctttcttatcccccttatcctccttcccctcccttatcccccttcccctcccttatcccccttatccccttcccctccctttcaccctgctcctcttcttctcccctttctcttttctctacccttttccttcctttttcctccctctccccatcatccccctcatcttcgtcctcatccccatccccttccccctccccctccaccactctctctccagcttccctcttccttctgcctgcacctcgctctctgccccctcaggttccccctttctcccagtccccaccctccggctccccctttttgcctgcccccaccctccctctgcctccctgtctctgcactgacctcacgcctgtctgcaggagacctcatccacctggccagctcagacgtgcgggcaccacagcgctcagagctgggagccgagtcaccatcgcggatggtggcgtcccaggcctacaacctgacctctgccctcacgcccatcgtcacgcgctcccgcgtgctcaacgaggagcccctgacgctggcgggtgaggagatcgtggcccagggcaagcgctcggacccgcggagcctgctgtgctatggcggcgccccagggcctggctgccacttctccatcccctaggctttcagcagggccccggccaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgcctcaccgtgaaggtgcccaacaactcggactgggctgcccggggccaccgcagctccgccaactccgttgtggtccagccccaggcctccgtcggtgctgtggtcaccctggacagcagcaaccctgcggccgtgctgcatctgcagctcaactatacgctgctggacggtgcatgcagcggttggggcacacgcggccccctggccttgttcttggggggaaggcgtttctcgtagggcttccatgggtgtctctggtgaaatttgctttctgtttcatgggctgctgggggcctggccggagaggagctgggggccacggagaagcaggtgccagctctggtgcagaggctcctatggcctttcaggcccatggcagagggtgggctcaggagggccatcgtgggtgtcccccgggtggttgagcttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggtgagctctgcgggccggcctggcagggcagggcagggcatcatgggtcagcattgcccgggttacgggccccgtggggacggcaggcagcgaggggactggaccgggtatgggctctgggactccgacatccaacctggcggagcctgggctcacgtccactgccccttcccttcccaggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcatgcccccaagccatgtacgctttgtgtttcctgtgagtgaccctgtgctcctgggagcctctgcagagtcgaggagggcctgggtgggctcggctctatcctgagaaggcacagcttgcacgtgacctcctgggcctggcggctgtgtcttcacaggagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtgaggggcgcggcggggtggcagggcctcccctgctctcactggctgtgctggttgcaccctctgggagtgagtctcgtcgcaggcgtcagaacaaggcagtttttgcagtgctgtgtgaagggctcgtgtgttcatcctgggaatgacctcgtgagcactcactgtccctgaggactaggacagctcctagctggaagtaggtgccagtcagtcagggtgggcagcccacgttctacacagtagcgtagccccacaagttacgtgagcatcgctaccactgtgggagaccatgcatccacccgcgatcctgactgcatagctcgtctctcagacggaggcgccagcaccctccccgtggctgtttcttcaatacctccattttcctttctttggaattgcccttctggcattccctttttgttttcgtttttctttttttggagacggagtctcgctctgttgcccaggctggagtgcaatggcgtgatcttggctcacagcaacttccagctcctgggtttaagcgattccccttaagcgattctcctgagtagctgggagtacaggtgcacaccaccacacccagttaatttttcaccatgtcagccaggcgaactcctgacctcaggtgatccgcctgcctcggcctgccagagtgctgggatgacaggtgtgagccaccacacctggccgtgttcccattttttatttccatgctgctttcatcttcatttcccagttctttcttttgattacctacttttaaaaactgtcggccgggtgcggtggctcacacctgtaatccgagcactttgggaggctgaggcaggctaatcacggggtcaggagatcgagaccatcctggctaacggtgaaaccctgtctctactaaaaaatacaaaaaaattaggccggcgtggtggcaggcgcctgtagtcccagctcctcgggagactgaggcaggagaatggcgtgaacccgggaggcggagcttgcagtgagctgagattgcgccactgcactccagcctgggtgacacagcaagactccatctcaaaaaaaaaaaaaaaaaaaaatactgtcacctgggtctgtcactgggagaggaggtgacacagcttcacgcttcgcagtctgtgcatgaactgagggacgggtgtgtggtgcaggtcaccggttgtggcgtgactgaggtgtggacaggtgtgcagtgcgggtcactggttgtggtgtggactgaggcgtgtgcagccatgtttgcatgttacaagttacagttctttccatgtaacttaatcatgtccttgaggtcctgctgtttattggacaaattgcagtaaccgcagctcctcgtgtatagcagagctgtgcaaagccgggactgcctgtgtggctccttgagtgcgcggaggccaaagctgagatgacttgcctgggatgccacacgtgttgggcagcagaccgagcctcccacccctccctcttgccctccaggtaccacggcccacgtgggcatcatgctgtatggggtggacagccggagcggccaccggcacctggacggcgacagagccttccaccgcaacagtctggacatcttccagatcgccaccccgcacagcctgggtagcatgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcggagctgtttcactcgcatccagagggccacctgctgcgttctcctcatctgtctcttcctgggcgccaacgccgtgtggtacggggctgttggagactctgcctacaggtgggtgccgtaggggtcgggacagcctcttcctgcccagcccttcctgcccctcagcctcacctgtgtggcctcctctcctccacacagcacggggcgtgtgtccaggctgaacccgctgagcgtcgacacagtcgctgttggcctggtgtccagcgtggttgtctatcccgtctacctggccatcctctttctcttccggatgtcccggagcaaggtgggctggggctggggacccgggagtactgggaatggagcctgggcctcggcaccatgcccagggccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctgtaatcccaacacttcaggaggccgaggtgggcggatctgagtccaggagtttgagaccagcctgggcaacatagcaagaccccatctatataaaacattaaaaagggccaggcacggtggctcatgcctgtaatcccaacactttgggaggccgaggcgggcagatcagttgaggtcaggagttcgagaccagcctggccaacacaatgaaaccccatctctactacaaatacaaaaacagctgggcatggtggcgggcgcctgtagtcccagctactcgagaggctgaggcaggagaatggcatgaacccaggaggcggagcttgcagtgagccgagattgcgccactgcactccatcctgggcaacggagcaagactccgtctccaaaaaaaaaaaaaaaaaaaatcccacaaagaaaagcccaggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccagcaggggttgctcccgagtccgtggcaggaaccagaggccacatgtggctgctcgtatttaagttaattaaaatggaacgatggccgggtgtggtggctcacacctgtaatcccagcactttgggaggcggaggcgggcagatcacttgaggtcaggagttccaagaccagcctggccaacacagtgaaaccccgtctctactaaaaatacaaaaaattagctgggcatcgtggcaggcacctgtaatcccagctactaaagaggctgagccaggacggacaatcgcctgaacgcgggaggtggaggttgcagtgagctgagattgcgccagtgcactccagcctgggtgacagagcgagactccatctaaaaaaaaaaaaaatgaaatttaaaactctgttccttagctgcaccagtctgctgtcaaccgttcagtggcacatgtcgcgaggggctgccatcacggacggtgcagatgtcccatatatctagcattctagaacattctgtcagatggcaccgggctctgtcctgtctgctgaggaggtggcttctcatccctgtcctgagcaggtctgagctgctgcccgctgaccactgcccttgtcctgcaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggtgggttccctagagaaacctcgagccctggtgcaggtcactgtgtctggagtaccgggggtgtgcgggctgcgtgtccttgctgggtgtctgtggctccatgtggtcacaccacctgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttggccggacctgctcagtgacccgtccattgtgggtagcaatctgcggcacgacccccacttactgggtctctccttttacaaccaacacaaccgaaatctagggcttcttctttttttttttttttttttgagacagagtctcattccattctgtcacccaggctggagtgcaatggtacgatctcggctcactgcaacctccgcctcccaggttcaagggattgtcctgcctcagcctcctgagtagctgggattacaggcgtgtgccaccatgcctggctaatttttgtatttttggtagagacggggtttcagcatgttggtgaggctggtctcgaactcctaacctcgtgatccgcctgcctcagcctcccaaagtgctgggattacagacgtgagccaccatgcccagccaaatctagggctggaacatggctgcagcatataaatagaattgaattccatagttttgttaaccctgttttttgtttgtttgtagttgttgctgtttttgagacagagtctcgctctgtcgcctaggctggagtgcagtggtgcaatctcggctcactgcagactctgcctcccgggttcaaactgttctcctgcctcagcctcccaagtaggtgggactacaggcgcccaccaccacacccggctaatttttgtattttattagagacagggtttcaccatattggccaggctggtctggaactcctgaccttgtgatccgcccacctcggcctcccaaagtgctgggattacaggcgtgagccaccacccccagcccctgttttgtttttgttttgcttgcttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagtttgggcacactctgtgtgatcgggcagaaggcctgtgggaagtttagctgaggacagggccaggaaaggtgatggacagtgggggtctgtcctggtcaccaggcccctgggtcctgcccacctgcttggagctccccacccatcacacatgatgctgccaagccctctgggtattgtgggcaaataccttaggagagaagctgatgaactttgtttcttgaaatgcacagattccttggacgtccctgagagctcagtcatgaaagtcagcttggttttctccccctcatttgggttcagaatttaaagtccacacacacgggcagtaagatgatatagataaggacatcatcactcggtttcggatgttaaaatgtctaggtgggttaggggtgatttgagatcacacaaccttgtgccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttttatgatcagaaacatgctgtgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggtttgtgaaggttccagagaggacctggccttgggaggagcgtgggggactgagaagggggaggggtcattgggatgatgcgggcgctacttggaatgtccattgtgaggcaccaccggggtcatcagggattggtggagagagagtctaaagccccagggttgctaagggagggcccagaccgaagaaggtttggtggaaagcagaacctttgtctcctaattgctcctaagcctcacgctcccttgccccgcctgtcctgttgcttccctgatcttctccgtgacctgtagctaaaccttccaccagcgcttgagaacttaatttgaaccggatcctttcccagacccctttcttcttctcctcctcctcctccccaacagcccccttctcctcctttcccttcccttacttccccccttcccctccccttcccctccccctcccctccccctccccaactcagatcgggcccggtccccgtccccttccctcccccctgccctaagccacctccacctctgtcctggctgcctcagggcgccctgaaaggaccaggacatgcgggtgcggtggctgctcttttggctcctcttttggctcctgctgggatttatcagccatcagtccacctgtgtgagtagatgggtgctgtggctgctcttttggctcctgctgggatttatcagccatcagtccacctgtgtgagtagacgctggacccgcggggtttcttcctttttactgggctgtgtcacgcggcatgaaattacacagctcaggcctgtaatcccagcactttagggggctgaggtgggcagatcacttgagtccaggagttgaagactagccagggcatcatagcgaaaccccatctctacaaaaaattccaaaaaagattagtcgggcctggtggtgcgtacctgttatcccagttactggagaggctgaggtgggaggatcgcttgggcccaggagctggacgttgcagtgagccgagatggccccgctgcactcttgtctctaacaaacaaaacggaccaaaacaaagtgaaatgtcatttgatttgtgtcatctggtttgatgacttttttttttttttttaagacagagtctcattctgtcgcccaggctggagtgcagtggcaagatctcggctcactgcaacctccgcttccggggttcaagcaattgtcctgcctcagcctcctgagcagctcagattacaacgcctggctaatttttgtatttttagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttatttgagacagtttctcccttgttgctgaggctggagtgcaatggggcaatatcagctcaccgcaacctctgcttcccaggttcgagcgattctcctgcctcagcctcccgagtggctgggattacagacatgtgccaccactcccagctaattttgtatttttagtagagatagggtttctccatgttggtccggctggttttgaactcccgacctcaggtgatccgcctgcctcggcctcccaaagtgttgggattacaggcgtgaaccaccgtgcccagccaagatctacactattatgtcaccccagaaagtgaactctcactcttcccagccagtctctttcttatcatagcttagcttgcttattctggaatttcgcgtatacagatgcatgccatgccataggtactcttttgtgtctgctttattctgctcaacaccatgtttctgaaatcattaccattgttgtacggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcagaagctgtctgaacttactcaggggaagtcttcgtcttcactcacataagagtctaatggaattaatatcaacaatcttagagaaatcccacgctattcatgccattttcatgatctccaccttggtaattttttttttttttttttttgagacagagtctcgctctgtcacccaggctgaagtgcagtggtgcgatcttggctcactgcaacctctacctcccaggttcaagtgattcttctgcctcagcctcccaagtagctggaactataggcgcgtgccaccatgccctgctaattttttgtatttttagtagagatgggtttcaccgtgttagctaggatggtctcaatctcctgatctcgcggtccacccacctcggcttcccaaagtgctgggattgcaggcgtgagccaccacgcccagcccaccttgttactttttaagaactaaaattcgatacttatttgtgaatgaagtaatctcttcattgtattttttttttttttacttatgctgagctttaaatgacaaagattcatataatccaagagagaagtattatttagagggattcttttaccatgtgatatataataaatgcatccaatgttatacatcaatttaaaaaacaagtaaataactaaagaaaagataactactggccaggtgcagtggctcacacctgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatgacaaaaccccatctccacaaaaaatacaaaaatttgctgagtgcactgtcaggcacctgtactcccagctactcaggaggctgaggcaggagaatcacttgaacctgagaggcagaggttgcagtgagccgagagcacaccactgcactccagcctgggtgacagagtgagaccccatctcaaaaacaaacaacaaacaaaaacaaaaaaaatggcctggcacggtggctcacacctgtaatcccagcactttgggaggccgaggcaggcagatcgcctgtcaggagttcaaggccagactggccaacatggtgaaacctcatctctactaaaaatacaaaaattagtcgggcatggtggcagagacctgtaatctcagctgctcgggaggctgaggcaggagaatggcttgagcccaggagctggaggttgcagtgagccgagattgcaccactgcactccagcctgggcgactgagtggagcggaactctgtctcaaaaaaaaaaaaaaaaatttttttttttagatcatcagctattgttagtgttagtgtatgttatgtgtggctcaagacaactttgcttcttttaatataggcagggaagtcaaaagattggatatccctgctttataccaagaaagacaacaccccacatttgcaatgcctaaaaacactaccagccatctgaaaaacatgagacttctctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattcacgtttctggacttcattatgaatatgtggttttacccaaaaaatcagggaaatgatttattagcataagaattatgaaaatatctgccatttacattatgaaaattaaataggtcggtgtttaatagaatgtcaacagagcttttggtcaaaaataagtttttttaacctttgtgctatttgtcacaaatggagtatgagatttcgtcacttaaatgggaaagtctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggctggatggttgatgcttaaagagcaccctcttctgagggtagagggagatagatggagatgtaggccatttagaggggcagcaaatgatttttaggggaaatgaaagagcccaaggaacaaacagttggcctgagacaaagttcctctgaggtcatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggaatgagatcagtatgtcaaaagtctatacttggtaagaatttggctgctaagttgtgccataatttgtcttttgagccttttatcctttgcgtaagttgagctctacattttgtcttgccattcatgacaataaaaatgtggttgtgtgggggctgaacctccttctgaacaatgatccaagataaaagtactaaaccacaatgcttttttatattcaagggaagaggaagtatgtttcagttttaccgcctagataattacacgtcatttggcactgcctttcaagatatgtagaaaacagaaaatatatgagttatgaagatatctaggcacatttaacattctctatgccacttagtcctgaacagagaattttcggtataaattggaggaagcttttttttttttcttttctcacccccaagaggagtctccctctgttgcccaggctggagtataatggtgtgatctcggctcactgcaacctccacctcctggcttcaagtgattcccctgcctcagcctctcaagtagctgggattacaggtgcccaccaccatgcccagctaatttgtgtatttttagtagagtcggggttttaccatgttggccaggctagtctcaaaacccgacctcaaatgatccacccgcctcagcctcccaaagtgctgggattacaagtgtgagtcaccacgtgagccaggggaagtttttaaatttaccactttttaacaattccatttaggaaagttcagttgagctgttggacttggacaactttgcacctctcatctttgtccttgtcatctagtcatctataccattacctcctaagcagggacatcatgggtgccatgaagcattcatgtgtgatggcatttctttgcttctcatttcttcatgtgtttgacatttctcctagctccaaactgggccagctacctttcctatgaaatctagcagtagctgtgggatagacgtggttgctcttttcatctttttagattacccattgcttctcttgaaatcctagtacatgatttttttttaatcctatgtgcagaaatcaggaaaaaacaagttctacaaagaatttgaaagatattatttcaggccaggtgtggtggctcatgcctgtaatcccagcactttgggaggctgaggcaggtggatcacttgaggtcaggagttcaagaccagatgggccaacatagtgaaaccccatctctactaaaaagacaaaaattagccaggcatggtagcaggcacctgtaatcccagctacttgggaggccgaggcacaagaatcgcttgaatctgggaggtggaggttgccgtgagccaaggtagtgccactgcacttcagcatggttgagtgacactccgtctcaagaaaaaagtcatttcaatgactacctcaggagattcataggtatctgacccacatctgagatgggatttgcattgcattttagctatgatgagaacaaatatttaatatcttcgaagattaaaagcatactgtgataatatggaaatcttggtgggaattcagtcattagtgagaatgttttgcgttaagttcaaaccagcctcaacgaagctgatgtgagggaagggaaagtgaactctgagtagagcagggacagaagaaagatgctccagtgcagatcaggaaggagcagggggtgaaatgttacaaattctagaactcagagagctgaaggtaattaattacttccttttcaagttgtgaaacatgttaacctgtggtaaaatacttacaagatgataattaccatctaaccgtgttgaagtgtacagttcagttgtgtgaagtatattcatgtcattttttttttttttttttgagacggagtctcactctgtcaccaggctggagtgcagtggtgggatcttggctcactgcaacctctgcctcttgggttcaagcagttctcctgcctcagcctcccgagtagctgggactacaggcgtgcgccaccatgctcagctaatttttgtatttttagtagagacggggtttcaccatgttgcccaggatggtctccatctcttgaccttgtgattcacccgcctcggcctcccaaagtgctgggattacaggcgtgagctaccgcacctggcctatatatttttttttttttttttgagacagagtttgaattttgttgcccatgttggagtgcaatggcacaatctcagctcaacacaaccttttcctgctgggttcaagtgattctcctgcctcagcctcccgactagctgggattacaggcatgcaccaccatgcctggctaattttgtatttttagcagagacagcgtttctccatgttggtgaggctggtctcaaactcccgacctcaggttatccgcctgcctcggcctcccaaagtgctgggattacaggagtgagccaccatgccagcctcatgtcattcttgtgtgttgtgtgtgtgtgtgtgtgtgtgtgtgtgacagagtctcattctgtcactcaggctggagtgcagtggtgtgatctcggctcactgcaacctccacctcccagcttcaaacggttctctgcctcagcctcccgagtagctcggattacaggcgcccactgccatgcccggctaatttttgtatttttagtagagatggggtttcaccatcttggccaggctggtcttgaactcctgaccccgtgatccaccctgcctcggcctcccaaagtactgggattatacgcatgagccaccgtgcccagccgtcattcttatattattatttcctaggtgtctttcctgaagactatcttcccgtctcaaaatggacatgatggatccacggatgtacagcagagagccaggaggtccaactgccgtagacaggaaggtatggctctgttggagtccccatagtgtggaaatgagtttgccctggaaagggaaagaacagcttcttgccctcaggtttctcaccttctcctctcctcactctcaccaagggctgaggtccgtttgtatgcacacaaagaaaagagtttcttcctttccaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacagtaagatgtgccttgacacaaatactgttgtatgaaccatgtgccaatcaaagtagacaactgtaaagtccttgagaatattttctacaatatttgtggcaaattcagtgggttcaaaattgagcttgtcctttctgcttcattagtttaagctgtataattcctttcccttcctacattcttgtttgtcattttttcaggggaagaggagttgctagtactggcattggttttcctttctctctctctttttttttttttttcctgaaatggagctttgctcttgttgcccaggccgtagtgcaatggcacaatctcagctcactgccttttgggttcaagcaattctcctgcctcagcctcccaagtagctgggattacaggtgcccaccaccacgcccagctaatttttgtatttttactagagatggggtttcaccatgttgtccagactggtctcgaacttctgacctcaggtaatccacccgcctcagcctcccaaagtgctgggattagaggtgtgagccaccacacccaggctttttttttttttttttaattttgagatagagtctcgctctgtcgcccaggctggagtgctatggtgcaatcttggctcactgcaacctctgcctcccagtttgaagcaattctgccttggcttcccgagtagcttggattacaggtgtgtgccaccacattcggccaattttttttttttttttttttttttgagacagagtctcactctgtcacccaggctagagtgcagtggcatgatcttggctcactgcaacctccgcctcccaggttcaaacgattcttatccctcagcctcttgagtagctgggactacaggcatatgccaccatgcccagataatttttgtatttttagtagaggcagggtttcaccatattggccaagctggtctagaactcctgacatcatgatccgcacaactcggcctcccaatgtgctgggattacaggcgtgagccaccgtgcccagcccaatttttgtatttttagtagagacgggttcaccatgttggccaggctagtcttgaactcctgacctcaggtgatctgcctacctcagcctcccagtgtgagccaccgcacccagcctggattgttgaattcaatgcttgggtcacctccaaattcattttcacagtctttcatgttttggtcatactacattgtattttgctgccatatgactgatctttttttgttaaatgtgagatactttttaaaaaatatttaacaatgcattgaggcctagtagcatgttatcttgctgcagaagagatgggagtctacttctgggggatggtcaggggtcctccgtacaggctgcaattgaggtcgtctctgcaggctcagtccctacaaaggccagggtatttcctgtccacctctattctgatgcatgactcttctgggtctcaaccagagccagtggacttcagtatggatcgctttcattggcagaccctcaatccacttgttttccatctaaccccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatgggttttatattctgtttggtgtcccccattgttctcatcggagatcagaagcttcagatgcacttatgtcaactcaagagtagaatgcttccttagcttccctccagagtcaggttttgtgtttctagttcccaagtgcacagcaggagtagtgctgtcctcactggcttctcatttgcattaaactgtgagcttctttagcgtggggacaggaccctgctcccattgcattgtcagcacctcaccacacacaccttgtttgaggccactccagacagcatgtgctgaaggatgccctgtggtcagaaacaagttcattaactttctctttgaagtgatttcgtccctgtttcctagcgttctgggaattttacacatccttcctataaaaccaagtatcaggtgagatccttaggatcaggaccatgaatcaagtggtgtgagggcaacacagcaaacttacccttttgaggccgtttcctttttctgccctcaatctctgtgaactgaaccttgttaaagtcagtcaacaccagggtggatggtttgccgttgtcacctattttcaggacataacatcctgacttaggagccattccgatcatttctaattcaatagatgcgcccagcattcagattgccttttcaggatctttaaagtcgatgacaagagttccagtcctgaatcatggcaaagtgcagtagtgaactgcggggttaatgacaccatattctggaaggatctctctatggctgatggtctcagttccggcatcagcctctgactgagaatcaggtctcacacaggaggagtcagatgaggagcaatcctctgcttccgatggagttagttgtgatgaattggtgaggtctggtttttcacactgaactaaaatgagctttcgctgtgtcaagcacaagactgaccccagagacgcacatagtgcacctcatagaagcttttaatagtctttatatttactaaagaataggactaactatggaactatgaagatgagctggaaatgacaggtgacttgccagcaggccagagtgtgatttttttttgtccctcaatgggaggtgtccattcttccttcggttgtgagaatcagttggttcatttgtgggaaggttgcaggggggatctttgaatcagccttcagatgccagaagggcagagggaatcccacacgtgctggtggatcatgtgtgtgcatttctctcccttctagtctgaggaaactaagcatgaaagaacgtgagcacggagaaaaggagaggcaggtgtcagaggcagaggaaaatgggaaattggatatgaaagaaatacacacctacatgtgagttcagaaactgaaccccaccctcttgggaaacgcccattggagtgttgtttttaacctttgtacaatgtttagacccagtaaatgcagaaatagaaacaaatggtcagaagacatatcgtgagagagagagagttcacaaaacagaaaacaaagtaccttaatatttaccagtgaccaaaagatgtgaagtagcaaaacggctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaaactatcatctcagaagtcagcaggcagtaagcaagaggaggaatcaatatagcaacagtttggatcagactgtacagttttttttgtttttgtttttgtttttgtttttctgagatggagtctcgctgtgtcacccaggctggagtgcaatgacgtgatcttggctcactgcaacctccgcctcccaggttcaagtgattcccctgcctcagcctcccgagtagctgggattacaggcgcctgccaccacccccgcctaattttttgtatttttagtagagacggggtttcactgtattagccaggatggtctcaatctcctgacctcgtgatccatccgcctcgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcagtgctgatgcagatgatgccacggcccttagactctctcaacattcaatttctcatgtgttggctttttcagatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaactgtgttgcgcaaaaacaccttcatccccacccagtggggcccccatctaatattctaagtatcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaatgaatactgcagtcctta
